United States Patent 9,328,346 (POLYCOMB-ASSOCIATED NON-CODING RNAS) - sequence listing, part 110

SEQ ID NO: 21496 - RNA, 40269 nt, Homo sapiens
ccgccauguuagauucaccccacagggauagcggcagagccgguagcggacgguccuugcauuggccuccggcaggcgccccccgggggcgggaagcugguaaggaagcagcugcgguuaccuagggguggggucacgucacgcuaagaggguuuggggaaguucaagggaggaauccugcaaagaagaggggcgacuuuuuccguguuucgggacagcuaaucuuuuuagugacaggaugagagagcccuucauguucagagggaccgaguuggcgagaagcgccggagaguuggagagucugugggucagaacauccggcuucuacugauggaaggccacgacuccccaguggaaugagggccuaggcaaagaaaaugagagagcccucgggguagugacacugucuugggaacauggagugcuaggaaacgaaaacuggaagacuaggaugaacucugcaaguaaaaaaaugacacuacuuacacauccuucucaucccauccucguuuuuucgagaccuuaaagagaucuccuugguuagggaccuucgguuuuggaaaggcacuguuuuuccuuuuugucaaacacucagcuuucaggccacacuuuuuugagacagagucuugcuuucucaaagaccaacccaggcugggcuugaacugcugagcucaagcgauccucgugccuuggccucccaaagugcugggauuacagguauaagccaccgcucccggccucaggucacacauuuuaaagccuggauaacuuggcuuguaaaggccucugguggagacaguaaucaaagcucagguugccaggucuguuucauuaaagggauuuuguugaggcugaaaaaaaaaucgacguggaggaaaagcuaacuugugccaagcaaaggugagucaguggcauggacuuacaauaaugccaguuaugaaagcugaaggccuaagacccagcuaucugacucuacuggcuguagaccuaaggggcagauaggguuaaccauagcuuugguguuuacacacguuuaagauuaaugcuccugcugaaagaauuuuuuuacaugucagccaaagagaguuccuuaugaagaccuggauaugguccagccaagcuagaaucucccacuuccuguuuucucuuaguuggcccaccagcuggaggagcuccagaguaucuaaauuuccaauuguguaauuugagaaaaagagaggaagauucauuuccuucacaaguagggaaguguguuucuugaaguuggaaagugauauuucagaauacccacuuuuggcggacugagucacuucauuuccuugauuuuuugccuaagguccuggggaauugacaaagauucucaaauuuuaaggaccccaauaauuacauuucauaugaaugaauacuagaugucagcaggauuguuguuaagagacuaauauuauuuugguggugaacuugguucuugguagaaacaaagaauggagaaaauugggggauaauugucuuaggguuucaaaaaagugccuuuaaaugacagucuuaauuguaguauuuuacagggcagugcauuacauuguggaaaacaguacagguuuaugguucuaaagacugguuuauuauuauuuauuuauuuauuugagauggagucuugcucugucgcccaggcuggagugcauuggcgcgaucuuggcucacugcaagcuccaccucccagguucacgccauucuccugccucagccucccgaguagcuggaacuacgggcgcccaccaccacgccuggcuaaauuuuuuguauuuuuaguagagacgggguuucaccguguuagccaggauggucucgaucuccugaccucgugauccacccaccucggccucccaaagugcugggauuacaggcgugagccaccacauccggcccuauuauuuuuuaaaauguuuaauugaacuuaauuuuuuuaaggagacagggucuggcuuuguugcccaggcuggucuugaacuccuaggcucaugauccuuccgccucagccucccaaagugcuaagauuaccagcaucagccaccacacccguccaguuuuuuauuuuauuuuauuuuugagacagagucucgcucuaucacccaggcgagagugcaguggcaugaucuuggcucacugcaaccuugccucccagguucaagcaauucuccugccucagccuccugaguagcugggauuaaaggccugcgccacuacacgcagcuaauuuuuguauuuuuaguagggacgagguuucaccauguuggcuaggcuggucucaaacucgacucaaacgaucugccugccucugcuucccaaaaugcuggaauuacagacaugagccacugugcuuggccuuuauuaucauauuuuuuauauuugaaugacauuuugaaagaacuugcguacacauuuuuaauuugauccuuaugguaacacugugagauagucaaagcagacguauuagaccuauuuuauagguuaaagaaccgaagcucaaaagcgaacugaccugcucacaguuuuaugucuaguaaugggccggagguaugucuggaagcuaagucuucccaguuugugugcuccuccgccuccccucugccccccacccccacccccgcagaccacgcuguaaaucccugggacuuaaucuuguuccucucaaccuaagcuauuuuuucauaucuuguuccucucaaccuaagcuauuuuuucauaaagucauaaaaaccaguuaaacguaaccauucaucaguaaacaaaauccuuaauuaaaaacauaaugaucagaauagaaaucugauuaaggaauuguuaacuuguuaggcaugauaaugauaucuagacuguuuuuaaaaaauucuuaucuuuuagagguacauacucaauucuuaauggauaaaagcauagaugucugucaaaauaaucuaguagggaaaggguauugcuguaaaccuuugguuacagcaaauugguccugaguugauaauuaugaaagaagcuagcuuauggguccauagggauucauuauauucucucuacuuuuguauagauuuaaauuuucccauaaaaauauuuuaaaaaauaguccgggcaugguggcucacgccuguaaucccagcacuuugggaggccgagguggguggaaucacgaggucaggagaucgagaccauccuggcuaucacggugaaaccccgucucuacuaaaaauacaaaaaaauuagccaggcgugguggcgggcgccuguagucccagcuacucaggaggcugaggugagagaaucgcuugaaaccagaagguggagguugcagugagccaagauugugccacugcacuugagccuggacgacagaacaagacucuaucucaaaauaaauaaauacaauaauauaaaauaauuauauuauuauaguuugguuaaaacauuaguugacuauggucaguucauuguuggggcagaagugggagaugcggggguauaugugaaugaggauagccuugaguugauuguugguuuaacuaaguguuuauuacucuccacuuuuauauauguuugaaaucccccauuuaaaaaaucaguacaaggccaggugcgguggcucaugccuguaaucccagcauuuuggaaggccaaggcaggcagaucaugaggucaggagaucgagaccauuuugccuaacacggugaaaccccgucccuaccaaaaauacaaaaaaaaaaaaaaaaauuagccggaugugguggcgggcaccccagcuacucgagaggcugaggcaggagaauggcgugaacccaggagguggagguugcagugagcugagaucgugccacugcaccccagccuggggcgauagagcgagacuccgucucaaaaauaaauaaauaaauaaaauaaaauaaaaaaucaguagauugugaaaaaacauaguaacuuggauggagggcauugaaugcuaccucuguguaguuucuuggcuaguguuuuggccuguaaguucguaaaacugguagaaaaccuagguucucaaguuaggacaacccuccuucugcaagaaaaauguagaaugucacucucaagucauacaagaauacaaguucccugagggcagagaccuuaucucucuuauccauguugguauguccugcuacuaguaaguauuuguuuaguuaaccagucaucauaaaguaccguaaggauuuuacaaaugcuagaugauuucugggaauguggucaaaauuuaaauacuuucagcauacuucuguuuccacauguuuccaacauguggaaguuccuaauaacuucaagaauaauuuuugugacuuaaguacaagucuuuauggcaugguuuuagccuaucuuucuuuccugaaacaauuccuauuuaacagugaugguaaguuucguaagaacagggacaguguuucuuuuguucauugcugucucccaagcccagcccauauuggguccucacaaguauuugcugagugaacuuuuagugcaacuuauagaacccuuucuaauguguuuuucucucucucccaccaaccuucucaacccuagccucacagcauggaaccacagguuacucuaaaugugacuuuuaaaaaugaaauucaaagcuuucugguuucugauccagaaaauacaacuugggcugauaucgaagcuauggugaguguuacuuuauuuuguuucuccuugguuuaagcaugguuauuuuuuccaaagguagcuauuuuuagcaguguuguuucauagcugugaagucugucauaguuaccauuucugggccuuuuggaaaauugcuuuugauaggguuucaguauucauauaugagaugugccccaauaaagggaaccaacacauaaauuuccuuuugaacauuuuagaaagggaagguaaaauuguuuuuagugagauaggauuuagaaaaccuauuaauuuuagaaccaguaugaggagugaauugguguggacuccacccaaccagaucccaaggaaauguucucuugugugaggauaugacuuguguuuugcacaaggauauaacuuguguuuugcaagagccuaucaauuguuuuuauugcuaggucagagguugaguaucucagaguugagcaggaaaaacuuucauaccugcuuagacagcaguucaccuguuccguuuuuuugcuaaggcuuuuccuccucuugguuugcccuuuguacucuucuguuuuuguucaguuugcaguggugaauguuuuacuuccuguguugacuguguuucucucugaaacccuuugguaaaaaucuacguuuaccugguuauaucugaugauaacuaaaaagggaaagaaaugguagaucuuaaaagaugaucugagguaguugucugccuuccagcaaauaccuguucauacuguccuaucagugacagugagacccgucucaaaaaaaaaaaaaagauuggauucagaaagaaguuagaucuuguuugccaaaagaugugaaaaucaguuaucuuucuuuuccuaguaguuaaaugagcugacagcuugccuuuuuucuuccuuguaaauuuuaaauuguauaaguauaauacaugcccauuuuaagaagagaaaccaucucaagcaguuaauagcccuccauucuccccccccucaucuguuacucccaccuucuuuggguaaccaauguuaacagcccuguauguacuuuaaauuuuccauguucaugcagauaucauacuaggaucauacuauaaacauuauuuggccaggcacaguggcacacgccuagaaucccagcacuuugggaggccaagauggguggaccacuucagcucaggaguuugagaccagacugggcaacaugguaaaaccccaucucuaccaaaaaaauacaaaaauuagcugggccugguagcaggcaccugugguuccagcuacuccggagguugaggugggcgaauugcuugagugcuggagguugaggcugcagugagccaagaucaagccacuauaauccagccugagcgacagagugagacccaucucaaaaaaaaaaaaaaaaagauauuuuucguuuuuuuuuuuucuuaucuugaaacuucaggagauauccaucuauacacauaacuuauacacuguucuacaggauaaacucuguccuauacaaaugugagauuaaugggucacaaagcauuuuauuugaaauuuuaauagauucugccaaaugcuuugcagaacaauuguagcagcacacagaaauacaugacaguguccugaaguuuugacaacacuggauguuauggcuuuaaaaaacauuugcuguucccuaccccacaccccacccaaaacacacacacacacacacacacacacacacacacacacacacacacacaguuugguauucugaugagaugucaucucauugcuucaauuugcauuguucugaccaccagaaaguuugaaagucuucugauguauuuguuagguguucugauuuccucuuguaugaauuuuauguauauuuuuaccuggguuguuaauuguaucauuagcaguuuugcugguacucuggguguguugcagauauuaacccuuuguuauggguuauuaagguuguuuguuguuugucuuuugauuuuguggguuuuuuuuacuuugacuucuguguacauuauaaccugccuuuaaauauguaucucuuuuauagguaaaaguuucauuugaucugaauacuauucaaauaaaauaccuggaugaggaaaaugaagagguaaaauauauuauggcacuuauugcuagguguucagaauagggaucuuauuucuccagugauaugggcuuuaauaauucaaaauaguguuuagcuuauuuguguggugguuuaaauauauuugauaacugaauauucuaagaagacuugcagcaucugagauggaguugagaaauggagaagcaacacugaagaauaucucagagauaacuuucacuuaaaaaaaaaaaaaggaaacagggucucacuauguugcucaggccagucuugaacuccugggcccaagcaguccucccaccucagccucccaaagugcugggauuauaggugugagacacccaccaugccuggccuggccugagagaaccuuuuuuuuuuuucuuuuuuuuuuuuugugagaugaagccucacuccauaaccuaggcuggagugcaguggugcgaucucugcucacugcaaccuccagcuccuggguucaagugauucuccugucucagccuucugaguagcugggauuacagguguauaccaccacgccuggcuaauuuuuguauuuuuaguagagacgguauuucaccauguuggccaagcuggucucgaacuccugggcucaagcgaucagcccaccucggacucccaaagugcugggauuacaguugugagcuaccacaccuggccaagauaacuuuuaaaauuauauagugaccuuaaguucacauauagcacaagcuaccacuuaguuuauaauaauacaaauauaauggcuaagcuuuuuuuuuuuuuuuuuuuaaagagggucucacucuguugcccaggcuggugugcauuggcauagcuugcugcaaccuagagcuccuggguucaaggaauccucccaucucagccuucuggguagcuaggacauaccucucugcaucuggcaaaauuuuuuaauucuuuggagggauggaaucucacuuuguugcucaggcuaauggcuaagcuuuauugagugguuacagugugucagacuagccacaguaccauguauugaguacauuauuaucaucacuauuuuacucaugaggaaacugaggcacagagaggugaaaauaacuuguccaaaugcacaaaaacuuggaaguaguaaaguagccguucaguccauacccucuggcuguagaacucaagcuccuaacuguuauauugcacugccuuuuaauguaucugaaauaaaggagggcacaguagauaagcaauaaaauuucuuaaguguuauucaugacuagcaagugauauggaaaagcugaacgcuuggccugaguuuuugucuguccuauggggcugguccuaguaacagaaaugcucaacugaugagacacuuauaauucacuguugcuuuuuuuccuuuuauagguauccaucaacagucaaggugagucccuaagagagucuguucagccuuguuuaaaaaccuuaaucugcucauugaggcauuucuauuuauacucaaaccuuauugcaguauuaauuuuagagugacauugcacugauggacauuaguuaccuaggggauuuuauuguauagcaguuuuuuauauauaggaugaugccuuugaauggacccuaaggacagcuuuaaugggagguucucauauuuaagaugccaguccucugaaauuaauaugccucccaguucaacacauauaaguauucccaugguguugcauuuguuucugacuugguauauauguuaauaucaacuuauaaaacaagugguauuccaaaaguuuauuuaucagauguucagagcuuggagugcauuuucccauaggaaccauguuauaguugaagauuaguuucccacgauagccccuaaaaucuuaauuuaaucaggugaaaugauaguauuaacauugaacucucagugcguaaaugugagggaccuggguugagauuuuguaacuggaagauucccaguagugaugaaggagggauuuaaggggaagaacugaucuacaguagaugcuguuugcaacaaaaagggaguuugucagcaaaaagauaguugcuguucauauauaauaagcuaagaauucuuuaaagucaggauuagcuguacauuuaacaaauuuuuauuguauauauugaaggugcacaacaugauguuaugaaauacauauacaguaaugcaucgcuuaaugacagagauuuguacugagaaaugcaucaauuaggugauuuugucauuauauggacaucauagaguguacuuacacaaaccuagaugguauagccuaguacacaccuaggauauaugguauaaccuauugcuuauaggcugcgaaccuguagagcauguuacugugcuguauacuauagacaguugaaacacaaugguauuugcauaucuaaacauagaaaagguacaguaaaaauguggcauuauaaucuuaugggaucaccaucauacacaugguugaccaaaauguuauguggcaaugguuacuguagugaagcaaauuaacauaucuaucaucucauuauaguggcccuguggugcccugagcccuccccagaaaccagccauaaucuacucauuuagcaaaaaucaugaauauaauuuacgauuauuuaacuauaauauguuccucauguuguacaguccaucuuuaggauuggcuauccuuaaucuuauggaaucuuugguucuugaaugaaugaauggauguguacaaaauaaaaauaauuuuaaaauaauagaaucuuuuggggugugugaagaaguaucaugguguauauuuuuuguucuuuuaggagaauaugaagaagcgcuuaagguaaugauuauuuaaucucauuuuuaaauaauuuaaaaaauauuauuauggguugguuuuuuuucuuuuuuugagaugagguugugcucugucauccaggcuggugugcaguggcacaaucugggguugcugcagucuucaccucccaggcuuaagugauccucccaccucagccucccgaguagcuggaacuacagaaacacgucaccacgcccggcuaacuuuuuauauuuuucuuagagacaggguuucaccauguuucccaggcuggucuggaacucuugggcucaagcaaucugcuggccuuggccucccaagugcugggauuauaggcaugagccacugcgucuggccuaaaauauuuauugacugaaacucaaaccugaauuccauuaguuauggggagagacuaguacguauaaacacagugaaaccuguuuauagggagacugaugaaugggcacgacacucagcaaaaggcaauucauaauaaaaagguccuucucaguuacagucccaucucuuugcuggucuuugugcuacuguucuaguguuuaaaaauacaaauaacuggccaggcgugguggcucacgccuguaaucccagcacuuugggaggccgagguggguggaucacgaggucaggagaucaagaccauccuggcuaacguggugaaacccugucucuacuaaaaauacaaaacagccgggcgugggcgggugccuguagucccagcuacuugggaggcugaggcaggagaauggcgugaaccccggaggcggagcuugcagugagccgagaucgugccacugcacuccagccugggcgacagugagacucugucucaaaacaaaaaaaacaaacaaaccaaaaaacaaauaucuuggccgggugcaguggcucaugccuguaaucccagcacuuugggagacugaggcaggcggaucacccaaggucagcaguucaagaccagccugaccaugauggugaaaccucaucucuacuaaauacaaaaaauuagccaggugugguggugcaugccuauaaucccagcuacuugggaggccaaggcaggagaaucauuugaaccugggaggcagagguuacagugagcugagaucacgccauugcacuccagccugggcaacaagagggaaacuccaucucaaagacaaaaaaaacccaaaaaacucuugaugccccccuuuuuuuuuuccuaaagaggcugggucuugcuauguuacccaggccagccuugaacugcugggcucaagugauccugcugccucagccucccgaguagcugggacuaugggugugcaccaccaugccuguucuagaacuauguuuacugguucacauuuuucaccucuuucccucacucuguucucuccuuuuuuuuuuuuuuuuuuuuuuuugagacagagucucacucugucgcucaggcuggagugcgguggcgcaaucuuggcucacugcaaccuccaccucugggguucaagugagucucaugccucaguuucccaaguagcugggauuacaggugugcgccaccacacccagcuaauuuauuuuguaguuuuuaguagagacaggguuucgccuuguuggccaggcuggucucaaacuccuuacccaagugauucgccugccuuggccugccaaggugcugggauuacaggcaugagccacugugcacagccuaugucacucuguucucuauagcccauacaauguuauguuuaaggcagagaugacagccacuuuuuggacauggaaugcuuuuuuuuuuguuuuuaguuucuaauuuuuaaaaauuuguauguuuaaauauaaaaauguguauaaaaugugauguuuugaaauauguauacauugugaaaugauuaccacaaucaaguuaauuaacacauccaucaccucagauguaguuacccauugaaugcuuuuuuucuuuuuuuuuugcgacggagucucgcccuguugcucaugcuggaguacaguggugcgaucuuggcuaccagcagccuacaccucccagguucaagugauguuccugcuucagccuuccuaauagcugggauuacagguguaugccaccaugcccagcuaauuuuuguauuuuuaguagagacggcguuucaccauguuggccaggcucaucucgaacuccugaccuccggugauccucuugccuuggccucccaaagugcugggauuacaggcgugagccacugcgccuggcgucuuuuuuuuuuugagacaggguuuuaccauguugcccaggcuagucuugaacuucuaggcuuaagcaacccauccaccucagccucccaaagugcuaggauuagaggugugagccaucacgcccggccucuuuuuuucuuugacgugugugucauuccuuuuguuguuguuuuuugagauggagucuugcucuguugccaggcuggagugcaguggcgcgaccuuggcucacuguaaccuccaccucccggguucaagcaguucuccugccucagccucccgaguagcugggacuacgggcaugcgccaccacacccagcuaauuuuuguauuuuuaguagagaugggguuucaccauguuguccaggguggucucaaucucuugaccucaugauccaccugccuuagccucccaaagugcugggauuacaggcaugagccacugcgcccagcgacacgugugucauucugucauagaggcuggagcacaguggugcaauuauggcuuacugcccccucaacgucccaggcucaagcaguucucccacuucagccuccugaguaguugggaccacaggugugcaucaccacacuuggcugguuuuguuuguuuguuuuugagucuugcucugucacccagacuggagugcagugguacaaucucagcucacugcagccuccgccuccuggauucaagcaauucucauaccucagccacacuaauagcugggauuacaggcaugugccaccacacccaacuguuuuuuguauuuuuaguagaaauagggcuucgcuauguuggccaggcuagucuuaaucuccuagccucaagugaucugccugccucagccucccaaagugcugguauaacaggugugagccacuguacccagcuaccacaccuggcuaguuauuuuuauuuuuaaaaaguuuuuuuucacugacagcacuuguuaaaaaaaaucacuucgauauauuuuuuugagacgggaucucacugucacccaggcuggagugcagugguaugaucacagcucacauagcuggagugcaguggugugauugcagccuugacuuccugggcucaaguggucuuccuaccucaggcuccuguguagcugggacuacaggaaaauaccaccaugcuccgaugauuuuuaaacuuuuuuuuuuuuuuuaauagagacagggccuugcuguguugcccagguuugucuugaacuccugggcccaaguuaucugccucagccucccaaagugcucggauuacaggcaugacccaccucucaucgccccaaaauacuauucuuuuuuuuuuugagacagagucucacuuuguugcccaagcuagagugcaguggcgccaucucagcucauugcaaccuccgccuccuggauucaagcaauucuccugucucagccuccugaguagcugggauuacaggugcaugccaccaugcccagcuaauuuuugcauuuuuaguagagaugggguuucaccauguuggacaggcuggucucgaacuccugaccucaggugaucugcucagcucagacucccaaaaugcugggauuacaggcaugagccaccgcgccuggccccaaaauacuauuuuuauuggaaaaguaaaugcuuaauuauaggacauaucuuuaaguuucuugaguuuuguuagucuagaauuaaccuuuuuggaaaccugaguuaagauuccauagagagagucuuguauaaaaaccaauuagacuaggcgcaguggcucacaccuguaaucccagcacuuugggaggcugaggcggcagaucacgaggucaagagauugagaccaucuuggcuaacauagugaaaccccaucucuacuaaaaauacaaaaauuagcugggugugguggcgugcgccuauagucccagcuacucgggaggcugaggcaggagaaucgcuugaacccgggagguggaguuugcagugagccgagauugcaucacugcacucuagccuggugacagagcgagacuccaccucaaaaaaaagaaaaaaaaaaaaacagaaaaauaguaacccaguuaaggagaaucuuaccuaauuugccaucuuaaaaccuacuuuuauggguuuuuuuguuuguuuuuguggaauaaagcaacacaauacuuuugugguuuuaauaacaaaaccaaguucaugaccggccuggguaauguaugacaaaaaauuuuuuaaauuagccaacaggcauagugacccaaaccuaugauacuagcacuuuggaaagccaaggugggcggagcccgggaguucgagacuagccugggcaacaucaugaaauuucaccucuacaaaaauacaaaaguuagccagguaugguggugcgcaccuguagucccaguuacucaggaggcugaggugggaggauaguugaacucagguguccaagaccagucugggcaacacagugagacuccugucuccaaacuaaaacaaaaaccuuagccaggugugguggcaugcgccuguaaucccagcuacccgggaggcugaggugggaagaucgcuugagcccaagagacaggcugcagugagccaugcacugcauuccaacaugggugacagagcaaauugccaucucaaaaaaauaaaaauaaauuucuaggcugggcacgguggcucaugccuguaaucucagcacuuugggagggcgagguggguggaucaccugaggucgggaguucgagaccagccuagccaacauagugaaaccccaucucuacuacaaauacaaaaauuagcuggguguggugguuggcaccuguauguaauaccagcuacuugggaggcuuaggcaggagaaucguuugaacccaggaggcggagguugcagugagccaagaccgugccauugcacuccagccugggcaacaagagcaaaacuccgucucaaaaauaaauaaauaaauaaauaaauaaauaaauaaauaaauaaauaaauuucuaguuaacauucuuaccaaagaaauagcaaguugaguguaaacauuacauuuguuguuggauuuaauaaagcaaacacaaauccuaguauuuucuagcauaacuuaccacacucuucuguuuugaugucuuugaaauguuauuuaggagaagauaaucacgucgcauguuuuuguuucauaauguaugcucuuagauggcaguuaaacagggaaaccaacugcagaugcaaguccacgaagggcaccaugucguugaugaagccccacccccaguuguaggagcaaaacgacuagcugccagggcagggaagaagccacuugcacauuacucuucacuggugagagucuugggaucagacaugaagaccccagaggauccugcagugcagguaugaaggguauggcccagucuauccaauaucguuucuuuuuucuuuuuuaaauaaagcugaacagguuucuuuauuuuauuuuuuuauuauacuuuaaguucugagauacaugugcagaaugugcagguuuguuauauagguauacaugagccauggugguuugcugcacccaucaaccuaucaucuaccuuagguauuucuccuaaugcuaucccuccccuaucaccccacccccugacaggcccccgugugugauguaccccucccuguguccauguguucucauuguucaacucccacauaucagugagaacaugcuguguuugguuuucuguuccugaguuaguuugcuaagaaugaugguuuccagcuucauccaugucccugcaaaagacaugaacucauccuuuuuuauggcugcguauuauuccaugguguacaugugccacauuuucuuuauccagucuaucauugauaggcauuuggguugguuccaagucuuugcuauugugaauagugcugcaauaaacauacguuugcaugugucuuuauagcagaaugauuuauaacccuuuggguauauacccgguaaugggaucgcugggucaaaugguauuucugguucuagaucccugaggaaucgccacacugucuucaacaaugguugaacuaauuuacacucccaccaacaguguaaaagcauucuauuucuccacauccucuccaacaucuauuauuucuuuuuuuuugaaacggagucucacucuguugcccaggcuguggagugcaguggcgcgaucucggcuuauugcaagcucugccucccggguuaacaccauucuccugccucagucuccugaguagcuaggacuauaggcaccugccacuacgcccagcuaauuuuuuuuauuuuuaguagagacaggguuucaccguguuagccaggauggucucgaucuccugaccucaugguccgcccgccuuggccucccaaagugcugggauuacaggcgugagccaccgcgcccggccuccaacaucuauuauuuccugacuuuuuuuuuuuuuuuuuuuuuuuugagacagagucuugcaccuucgcccuggcuggaguacaguggcgugaucuuggcucacugcaaccucugccucccagguucacgugauucuccugccucagccucccgaguagcugggauuacaggcacacaccaccacaccuggcuaauuuuuuguauuuuuagcagugacaggguuucaguauguuggugagacuggucuggaacuccugaccuugugauccgcccaccucggccucccaaagugcugggaguacaggugugagccaccaugcccagcccuguuuccugacuuuuuaaugauugccauucuaacuggugugagaugguaucucauugcgguuuugauuugcauuucucuuuuuuuuuuuuuuuuuuuuuugagauggagucucacucugucgcccaggcuggagugcaguggugcaauccgggcucacugcaagcucugucucccggguucacgccauucuccugccucagccucucgaguagcugggauuacaggcgcccacuaccacgccuagcuauuuuuuuguauuuuuaguagagaugggguuucaacauguuagccagaauggucuugaucuccugaccucgugguccacccgccucagccucccaaagugcugggauuacaggcgugagccacugcgcccggccugauuugcauuucucuaaugaccagugaugaugagcuuuuuuucauagguuuguuggccgaauaaaugucuucuuuugagaauugucuguucauauccuuuacccacuuuuugaugggguuguuuuuuucuuguaaauuuguuuaaguuccuuauagauucuggauauuagcccuuugucagauggauggauugcaaaaguuuucucucauuguguagguugcccguucacucugaugauaguuucuuuugcugugcagaagcucuuuaguuuaauuagaucccauugucaauuuuggcuuuuguugccacugcuuuugguguuuuagucaugaagucuuugccccugccuauguccuaaaugguauugccuagguuuucuucuaggguuuuuaugguuuuagaucuuauguuuaagucuuuaauccaccuugaguuaauuuuuguauaagguguaaggaagggguccaguuucaguuuucuacauauggcuagccaguuuucccagcaccguuuauuaaauagggaauccuuuccccauugccuguuucagucuauccaauuucuagauuuauuucucauugucuuuguuguaagauuugcacauuuaucagagauuugggaauuagugugcuccucucucugacuuuugaaacugguaauaguuuacuucuguagaaggggagcaggcuagagacuuuguuuuccuuuaguacgccuucauacugugacuuuuuaaaaaauuauauacuuguaugauuucacaaaagaaaccucaaaauaauacacuccaggaaaaguauuuuaaauagaaaaaguaaccucuaacaucucggcuuguguuuucucccagucguuuccacuuguuccaugugacacagaccagccucaagacaagcccccagacugguucacaagcuaccuggagacggugaguguucugucucgcuuggguuuuaacugcgguguuggcacagguggaauguggaagaaauagaaaacugaacccagguggcugcugccucuaguaccggugaagagugguagcuuauaauuuccaaacuuagaacaguuccagucgagaaagcucuaaccuuugcagugaagugucagaaaaagagggagucuaauucuaagcauguaagggagagggacaacucucugcuugagaaaaaguuagaaauuuacuuaucaaaaggauguuuugauauuuucuucgaaccaguuuagcuguggaaggaauagaccuuuugcuauguuucugucuauucaguagcaguuguuuauuguguuuuuguauuauaccagagacaguuagguuucagaucuauugauaucuucacauuuuuuucugauauuggaacugaguuuuuucccuaccuucugcuccauauucuaguucagagaacaagugguuaacgaaacgguugagaagcuugaacagaaauuacaugaaaagcuuguccuccagaacccauccuuggguucuugucccucagaagucucaaugccuacuucagaagaaacauuguuuuugccagaaaaccaguucagcuggcauauugcuugcaacaacugccaaagaaggauuguugguguccgcuaccaguguagguaagcaguugcuugggaguagcuagcuagugauagaccuuacagcuuuuaccucccuggcuuucuguguagguaaagggaaauuaauuguacccuguuucugagcauuagauguuguagcugugaguuggaagcacaagcuacucuucacccacaugcuuuguauguuguaacuauucagauuguuguguucaaaugugcauuuggauuagcaaagccaggcaaaauuauguuccccugaacggacaaaauuagaucacuaaggguaguuccucgguuguuccaaaugccuuuuuuuuuuuuuuuuuggugacagggucucugucacccaggcuggagugcagggugcaaucaugguucacugcagccucacccucccaggcucagacaauccucccacuucagccugccaaguagcugggaucacagacugccuuuuaauuauuuuuuuggagauggggucucccuauauugcccaggcuagucucaaacuacuggacucaaaugauccucuucuccauggccucccaaagugcugggauuacagacaugagccacugugccuggccccauguacuuucacaucuuaccuuccucccauagauuuucauuuaaaauggauauggguuaaguguuauuauccucauuuuauuaaugaggaaaauugaggcauggcauagucagauggcaugcucagguuaccugcuaguugguacuggagcaaacauagaaguauggucuuauaucucccuaccccagguacuuccuauucugccauuguguauugugccauucuuuccccacagccuaugcccauccuacaauaucugugaagauugugaagcagggccauauggccaugacacuaaccacguccugcugaaguugcggagaccuguugugggcuccucugaaccguucugucacucaaaguacucuacuccucgucuuccugcugcucuggaacaagucagguaaaacccucuacauggagaugcuuauucucugauugacuucuugguucuggugacaggguaugaaucacaaaacuacagauagucuccuuaguucugcucauuuucaauugaugugcaauaaugaagacaguuauccaaaguuagugaaauagaaauaauagcuauaaaaagaaauuaagaaacuaaaguaggcugggcacaauggcccauaacuguuaucucagcaacuugaggggcuaaggugggaggagugcuugaagccaaauauuugagaccagccugggcaacauagcaagaucccgccucuacaaaaaaaauuuaaaaauuagccaggcgugguggugcguaccuauaguuucagcuacuugggagucugaggugagcagauugcuugagcccaggaauaugagguggaagggagccaugauuagaccacuguacuccagccuacaugacagagugagacccuaauucuaaaacaaaaaaagaaauuaaacuggaagcugacacugauggaaauugcaauuggcuccacauagcuucagaauuuauuugugacuuucuuuuaagacuugcuuuuauuaucucacaggcuccagaaacagguugauaagaacuuucuuaaagcagaaaagcaaagguugcgagcugagaagaaacaacguaaagcagaggucaaggaacuuaaaaagcagcuuaaacuccauaggaaaauucaccuguggaauucaauccauggacuccagagccccaagucuccuuuaggccgaccugagagcuugcuccagucuaauacccugauguaagcccaggacuggggugggagccaaaacuuuaggcccagcucucugaaacuggaacuucaaccaauuuccgucuuauuuauugguagcccuuaacaccuaaaucuuuaaaacuuuccauuaucuggucuuaguauuuuuuguuuguuuguuuuuugagacagagucuugcucugucacccaggcgguagugcaguggugcgaucucggcucacugccagcucugcuuucggguucacgccauucuccugccucagccuccugaguagcugggacuacaagcacccgccaccacgccuggcuaauuuuuuguauuuuuaguagagaugggguuucaccguguuagccaggauggucucgaucucuugaccucgugauccgcccgccuuggacucccaaaguguugggauuacaggcaugagccacacagcacccggcuuuuuuuuuuuuuuuuuugagauggagucucgcucugucgcccaggcuggagugcaguggcaugaucuaggcucacugcaaccucugccucccggguucaagugauucuccugccucagccuccugaguagcuaggauuacaggugcaugccaccaugcccggcuaauuuuuguauuuuuucaguagagaugggguuucauccuguuggucaggcuggucucgaacuccugaccucaugaauccgcccgccuuggccucccaaaauggugagauaacaggugugagccacugcgccugccuggcguggucuuaguauuauuaaagggugguuugguaguuuuuuguuuguuuuguuuuugagacggagucuuggagucucgccuguugcccaggcuggagugcaguggcgcgaucucggcucacugcaagcuccaccuccuggguucacgccauucuccugccucagccucccgaguaacugggacuacaggugcccgccaccacacccagcuaauuuuuuguauuuuuuaguagaaacaggguuucaccguguuagccaggauggucucgaucuccugaccucgugaucuaucugccuuggccucccaaagugcugggaugacaggcgugagccaccgcgccuggccaaguuucguaguuauuuuugacacuuguuuuguuuccuucuucagaaagauagaaaccacuaaaguucaaaauggcggggucccucucuucauuggaggcaaucuggaauugaagcaaaaggaacaaauguguuaaaagccugacucucuagguguuguauuuauaggcccuuuuaauuacucuuaccaugacuuuuuuagcucaggagugagaccuauccucuguuuuguuuuauuguuuuaaguuugucagaaaauuuauuguuucuaauaugugguccuauacuaguaauaucaguauuauuuuuaaggcaaauggguuagcacauuuucaagagucacagucagacucucaagcuagugugagguauucagaagccuucacacccaacagcaagugacuaagcaucugaauuucuguucaggcucccuuugcagcccuguaccuccguuaugccaaugcucagugcagcauuuguggaugagaauuugccugaugggacucaccuucagccaggaaccaaguuuaucaaacacuggaggaugaaaaauacaggaaauguaaaguggagugcagacacaaagguaauuuuucccacaaaaugcaaagaugaggugauuugaaguggcagagugcucagcugacaagcuugcuuucucuucuuacuguucuuuucagcucaaguucauguggggaaaccugacuuuggcuuccacagaaaagaaggauguuuugguucccugccucaaggccggccaugugggaguuguaucuguggaguucauugccccagccuuggagggaacguauacuucccauuggcgucuuucucacaaaggccagcaauuugggccucgggucuggugcaguaucauaguagauccuuuccccuccgaagagagcccugauaacauugaaaagggcaugaucagcucaagcaaaacugaugaucucaccugccagcaagaggugagcauugacugacaggcuuuggccuaguauccaaaucuuaguuagagaggagauggcuaaaacuaaaagaacccacucauagcugguuguuuuccagaaaccuugaaagguuagcaucuccccccgccccaacacaucucuaugcugauauuuggccucuuccuuaggguguuuguuuuagcgucuuuagggucuugcugcauacugaauacuuuuguaccucuuugugauguugcauggucagccuguuggcugcacaagggaaaaagggacuccuggccugggcuggccuguggaacugcugaacugauagcuuuacuccuuaacauccaucucuccugaaauacccuguguauguucccuaaauacuaaugaagucuugcccugguugcuacuuagugaacaguuuuuuaaugcaauuucucuguauuaguggggcagaguguuuacugcuuaaaguuauccaauguuaauuuucugguuuugacuauuauaguuaauauaaguuaucgucauuaggggaagcuggggaaugugaauucucucugcuguuuuuacaacuuuuucuauaacuguaaaaauauaucaaaaacauuguuuuuuaaaauauggagguacagcagcguuuuuauuuuugggggcauugucagccugccucuucaguucuguugaaggccuaaaauuugucucaaugguuugucucuauaggaaacuuuucuucuggcuaaagaagaaagacagcuuggugaagugacugagcagacagaagggacagcagccugcaucccacagaaggcaaaaaauguugccagugagagggagcucuacaucccaucuguggaucuucugacugcccagguggaagauucagcacuuugaagggcaagggacagagggagagagcacaggagagaaggugguagagccauaggcaguaaucaggaaaucagagauaugcccacuuugaucuagucagguauauuuaaugggaaggagaucacccauggaagcaaguuuguaaacuagauguuuccucuuugaauugggaacucaauccuguacuuccccacaaacucccuuuaguugccucuucaccuuggccuagcuaauucuccuucauaccugcugcauuuucucuuuccugcuauuggguuauuucaacaucuaauucccauuuaacucuucuuguuuucacuugucuggggacaggcaugaauuugaacagaguugaauacgaaaugauguggaaauggucuacaggucccaucaagacauggcuccagcaugcacuccaaacagccuaacauugucuuuuuuuauaggaccugcuguccuuugagcuguuggauauaaacauuguucaagaguuggagagagugccccacaacaccccuguggguaagaaugucacucauuucaucuuguucgucuuacuaauaggcacaaaaguaccacagccuagacacugguaguguuuuauucugaggaaauggcaaggauuucucccacaguaggauaguaaagcagcaaucauggauccguuuuucuucuuuccuguccuuugucaaaaguaacaacaugcugggcaugguggcucgugucuauaaucccagcucuuugggaggccaaggcaggaggaucacuugaggccaggguuugagaccagccugggcaacauggugaaacccccaucucuacaaaaauuacuuuuaaaaauuagcuggguguggccaggcacgguggcucacgccuguaaucccagcacuuugggaggcugagacgggcagaucaccugaggucgggaguuugagaccagccugaccaacauggagaaaccccuucucuacuaaaaauacaaaauuagcugggcaugguggcacaugccuguaauccgaacuacucgggaggcugaggcgggagaauugcuugaacccagaaggcggagguuguggugagcugagauugcaccauugcacuccagccaggacaacaagagcaaaacuccgucucaaaaaaaaaaaaaaaaaaaauuagcuuggcaugguggccugcaccuguggucccagcuaccagggagacugaagugggagaaucuccugaucccaggaggcagaggcugcagugagccaggauugugccauugcucuccagccuggaugacagagugaaacccaaucucaaaaaacaaacaaaaaaaagaggcugggcacgguagcucacgccuguaaucccagcacuuugggaggccaaggcugguggaucacaaggucagaaguucaagaccagccuggccaagauggugaaaccccaucucuacuaaaaauacaaaaauuagccaggcaugguggcaggugccuguaaucccagcuacucgggaggcugaggcagagaguugcuugaaccugggaggcggagguugcagugagccgagauugugccacugcauucuagccugggugacagagcaagacugcaucucaaaaaaaaaaaaaaaagcaauaaaacaaguucgugcaaggcuuuuccacuauaaaggaauccucuucucuuuuuucccucuagauacuuguguccuuuuguuccuuuauguucaugguuuugugucuuggccacagcuuuccaggcuaaauaacugugauucuuccugcauugauugaucugagauauuuugcuuacuuauuggucuggagaaauuuuuuguaacagaccucaaagcauaucuugguuuauuuuagcccugcgggaggcaagaagccuacaaacugcuacuucuggacacugacuguugaugauaugaugcuuucucuugauugaugguucuccugucuucauucuccagaugugacucccugcaugucuccucugccacaugacaguccuuuaauagagaagccaggcuuggggcagauagaggaagagaaugaaggggcaggauuuaaagcacuuccugguaagggauuaaacauuuguaaaguauuugcauccucccuuuccauaucauacccuauuuuacagcuauccccuacugacccuaccuuagcauguaaaugggcuugcuuucuguagcaucucauguuuugaagucuccucaccuucacauggcacagauagcagcuauuccuugguuuaguuuuagcauggguaaugacuggugaauguucuucagcacuuuaaacaccaagugcagacaaaguuuagauagcagcuauuccuugguuuaguuuuagcauggguaaugacuggugaauguuccucagcacuuuaaacacccagugcagauaagguucgugugucuuucagauucuauggugucaguaaagaggaaggcugagaacauugcuucuguggaggaagcagaagaagaccugagugggacccaguuugugugugagacaguaauccgaucccuuaccuuggaugcugccccagaccacaacccuccuugcagacagaaguccuugcagagugaguguccuugcauuuccccuaccuagcaggguggcaccugaauugugacugccagacuugacuaguuagaugugcucuucuucacugagacugaagggagagugaucuuaguuagaaguucugaucuuggcggggcgugguggcucaagccuguaaucccagcacuuugggaggccaaggcaggcggaucacaaggucaggagaucaaguccauccuggcuaacauggugaaaucccaucucuacuaaaaauacaaaaaauuagccuggcgacguggcgggugccuguagucccagcuacucgggaggcugaggcaggagaauggcaugaacccgggaggcggagcuugcagugagccaagauugcgccacugcacucuagccugggcgacaaagcgagacuccaucucaaaaaaaaaaaaagaaauucugaucuuguuugugucuuuagacucuacguaugcuaccugacuguucuaauuagagcaucaggaguaaagaagccaucauacucauuucuccaucuucucaggggcagaauuacagcugcauuccacaguggaauagcagccaguugugcugccuggauucugcaguaaggaaucuuccuguaauuugacagagcuccuuagcagagaccccuauggguagcugaguugucugcuuucuccaagggcagcagucccagaaacaguggauagaagcaggaguaccaacaaaguuucucaagguuaaauucugcuguaauaaauaccuuuauaggccgggcacaguggcucacccuuguaauccuagcacuuuaugaggcugaggcggguggaucaccugagguugggaguucgagaccagccugaccgacauggagaaaccccaucucuacuaaaaauacuaaaaauuagccaggugugguggcuacaugccaaggauuacaugccuguaaucccagguacuugggaggcugaggcaggagaaucacuuuaacccgggaggcgaaggcugugguuagccgagauggcgccauugcacuccagccuggcaacaagagugaaacuccgucucaaaaaaaaaaaaaggaauaaauaccuuuauaacagaaacuucuagguaucagauagauagaaccaauagcauauauuuuaagaaguauccaaaaauucaaauauacuaugucaaaauaauauuggagaaucucuuuauuauaaucaaauuugaccuauaucuuuaaauauuauuuaucuuacuuuuguuuaaaguauacauguaaggccaggcgcaguggcucacgccuguaaucccagcacuuugugaggccgaggcggacagaucacaagcucaggaguuugagaccagccugaccaacauggagaaaccccauuucuacuaaaaauacaaaaauuagcugggcgugguagcgugugccugugauccagcuacucaagacgcugaggcaggagaacugcuugaacccgggaagccaagguugcagugagcugagaucgcaccacugcacuccagccugggugacagagcgagacuccgucuaaaaaaaaaaaauaauaaaguguacauguggccaggugcgguggcucauaccuguaaucccagcacguugggaggccgaggugggcggaucaugaggucaggagaugaagacuauccuggcuaacacggugaaaccccaucucuacuaaaaauacaaaaaauaagcugggugugguggcgggcgcaccuguaaucccagcuacucgggaggcugaggcaggagaauggcgugaaccugggaggugcagcuugcagugagcugagaucaugcuacugcacuucagccugggcaacagagugagacuccaucucaaaucaaucagucauguauaucuuuauauuuuuuuccacauguguguacaaauacauaacaaaaaggucuggaaagacaguaccaaaauguucacagcuguuauucugauaggauuuauggguaauuuuuuuuuuuuuuuugagauaaggucucacucgcccaggcuaaagugcgaguagcaaguuuauggcucauugcagccacaacauccuggggucccccuaccucuguuucccaagcaacugggaccacagccacaugcuaccacaaugagcuaaauuuuuuuuuuuuuguagagaugggauuucgccacguugcccaggcuggucccaaacuucugagcucaagcagucugccugccuuggccucccaacgugcugggauuuuaggcguaagccaccacaccuggccuggguagcuuuuuuuuuuuuugggacacagucucugucacccaggcuggagugcagcagcgcggucucggcugacugcaaccuccgccuucccagguucacaccauucuccugccucagccucccgaguagcuggcacuacaggcgcccgccaccaugcccggguaauuuuuuuguauuuuuaguagagaugggguuucaccguguuagccaggauggccuugauauccugaccucaugaucugcccacguuggccucccaaagugcugggauuacaagcgugagccaccgugccuggcccuggguagcuuuuuucuauccuuuuuuacccucucaaacaugauuggccaguuuucucccaugacugcaucaucuuuguaaagaagaggaggagauagacauauaauccugcaauacucaucuccuaacuuuuucucuuuuuauagcacuguuaguguaucaguuuugguuuaaacucuacucaguauauuaaccaucacauaaaaaggaaaaaagggauggagcugccuccuuuuaugauucauagagcuucuuggaaaccugaguguuucugccuaccuuguuucugugagcuuugauucuauuuuguuuugcauagucuucaaacuuagaauauggucauaguuccagaaccagcccuucccuuuaguucuucccucuccucuggcuuucauaauucuagcuuaugauccacaaggcuuuaccaaguaaggauaguacuuaggccugcuuuuagcuuccaccuuaaaauugguugcuuucauccuuuagugacauuugccuugccugaaggaccacuuggaaaugagaaggaggagauuauccauaucgcugaggaagaagcugucauggaggaggaggaggaugaggaggaugaggaggaggaggaugagcucaaagaugaaguucaaagucaguccucugcuuccucagaggauuacaucaucauccugccugagugcuuugauaccagccgcccccugggggauucuauguacagcucugcgcucucacagccaggccuggagcgaggugcugaaggcaagccugggguugaggcugggcaggaaccagcugaggcuggggaaagacucccuggaggggagaaccagccacaggagcacagcauaagugacauccucacgaccucacagacucuggaaacagugccccuaaucccagagguaguggagcuuccaccgucacugcccagguaccacucacagcccccucagcugggguguucuucagaggugaaauaaagagaggaaucgaccugaucucaaaaccuguuuuuuccucaguauggaaagagacuauuuuccauagcaaagucugaauuuagaugaauaaaaguuguauuucccaguauuuguggauucuggauuuaaagaaauauuuguuuuaguuggccuuaaauuaucugaguauagucugucugcuuauauuuugauuauugagagcugguuguguuuuuuuuuuuuuuuuuuugagacagggucucagucuguugcccaggcuggagugcaguggcacaaucuuggcucacugccaccucugccucugaggcucaagcaaucuucccaccucagcccccugaguagcugggacuauaggcaugggccaccacaccuagcuaauuuuuguauuuauuguagaagcgggguuuugccacguuguccaggcuggucuugaacugcuggccuuaagcgauccaacugccugggucucccaaaaugcuggaauuacaggugugagccacuaugccuggcugagagccaguuuuuaaacacaaacaucccuggaccuucccuccuuguuuuauugacucuucaguaaaggcagcaaaaacucaacccaaacagucauaauuaggaaguuaaauccauuaugggaaaaaacacuauaaaaccaaacuaauuauuuuuaauucucuggugaaucuaucugaaucauucuugucuccuaauaguagggaaaaugcuggagccuugacuauaauguaaaccauucuccccaaaagcuagacauuuccguuuauugacaccacuugauguagguggggacaugaccagacugaagccaacauuucuagcuugccuguggcuaaagaggaaaaugggguagaauguagcccuuaugauggaacccuaaauccagacaugugaucuggaucagaaaugugaagccucuguagagaauuuggcacugcugugcuguguuuacuauuucuccacuguugccauaagugccuuuucaauuuacuuuccauauugugucuuucugaaaggagcucuccuuguguacaucaucaugguuccccaggaguggauuuaccaguuaccauaccagaaguuucuucagucccugaucagaucagaggagguaaugaucagccuaagcuuuuucucuuuuucucugcuccugucuaauggaaaccagguauaaauagccucucucucuucgugauucuuggugguuuuuugaaacuugcccuucacaggccaggcgugguggcucacaccuguaaucccaacacuuugggaggccaaggcaggcggaucauagggucaggaguucgagaccagccuggccaacauagugaaacccugucucuacuaaaaaauagcaaaaauuaaccaggcaugguggcgggcaccuguaaucccagcuacuugggaggcugaggcaggagaaucacaugaaccugggaggcggagguuggagugagccgagaucgcaccauugcucuccagcccgggcaacagugcgagacuccgucugaaaaaaaaaaaaaaaaaaacuugcccuucacucucuccaugcuccuccugcauacucuaauuucuauucucuggcugaauauauuguuagaccucauagagguaguggaaagaacacaggcuuuggagccaaacaaucuagguuccagcuccaucucccccuuuccugacuagcaguucagcagguuucuaauggcugugagucuguuuucuuacuacaaaauauaucaguguguuaggauuauagaguugauuuuucugauucaauaaacaaucaucuugcauugcauuucuggacaguuucuccuuaucacuuaaacuacccuuaaaacuucccaaauacuuuaaaaaaaaaaaaaaagacuucaaacacugugaucagauugccaccugccucaauaauagccuugcugugaguuaggaaacaguaggugcuuauggaugcugcaucuaaccaacagcucuuuugcuuuuagagcccagaggcucaucaggacuuguaaacagcagacagaagagcuaugaccacucaagguaacaaccuugugcagucucuuuuuucagaagcagguggauauucuuguauuccuucugcuuaaaagagccucucacaguauguacccaucuucagagagcagagaaggggagccuuuguuccgucuuauucuuguuucuucuaaaggcuuugagcaacacugaacaaacggcuaaagcugauguuuaagaguguucuguuugggaggccgaggcggguggaucaugaggucaggaguucaagaucagccuggccaacauagcgaaaccccaugucuacuaaaaauacaaaaauuagccaggcaugguggcgggcaccuguaaucccagcuacucaggaggcugaggugggagaauugcuugaacccaggaggcggagguugcagugagcugagauugcaccauugcacuccagccuggcugacaagugaaacaacaucaaaaaaaaaaaagaguguuuuauguuucagacaaggaaauaguguccacaaauuaccucacucuuagcacuggggaaaagguagaaagguuaagcccaguauacauuuaaauaauuuuuucuuggacauaccugguucucugcuuccacucauauuaggccaguguccagaaaaucacauuuccuuugcaagguguuuucucugagagaauaauugagcagacaaacuguugauauccuuguguguccucgaucacauuaauuuucagcuaggagugagagccaucaugguuaccagagugguguguuuccugcagugccccuaucuugcuugcaccaguagagcugggcccuccaucaaaccaugaucuguagcuauaaagcugauaaugaaagcaauuguguucucuuuuuccaucuaauuuuuucucuuaaggaaaucuuauuccaaggauuagagcccagauuaucuuguaaaaagguaaugauuuguguuuguuuggggagauaauuugguuuuccucugcaggcaccaucaugggagcagcauugcuggaggacuggugaagggggcuuugucuguugcugccucugcauacaaggcccuguuugcugggccaccagucacugcacaggucaguguguguguuuuauuuuccugaaucucaacuccaugucaccagugaaagugauggcaucugucuggguugaagaguaacauggcauuguggaaagggcauaggcuuuagauuuagucuuuaguuaacacacaacacaacucugccacuuuuuuuuuuuuuuuuugagacgaagucucgcucuguugcccaggcuggggugcaguggcgcgaucucggcucacugcaagcuccaccuccuggguucacaccauucuccugacucagccucccgaguagcugggacuacaggcgccugccacuacacccggcuaauuuuuuguauuuuuuaguagagacgauguuucaccguguuagccaggauggucucaaucucgugacuucaugaucuucccgcuucagccucccaaagugcugggauuacaggugugagccaccgcaccuggccaacucugccacuuucuaacuauaugacuuuagccaaguuacuuaagggaagaaaagagaagaauguauuauugaugaucuauuaauauuuucuauagagagaagcuauuccagguguuggcacuauggcaugaauaaaacaccaguucuuggccggguaugguggcucuuaccuguaauccuaguacuuugggaggccaaggugggaggauugcuugagcccaggaguuugagaccagccugggcaacauagugagacccccaucucuacaaaaaaauuuaaaaauuagauaaguauggccgguacaguggcucacaccuguaaucccagcacuuugggaggccgaggcaggccggaucacaaggucaggagaucgagaccauccuggccaacauggugaaacccugucucuacuaaaaauacaaaaauuagcugggcgugguggcaggcaccuguagucccagcuacucgggaggcugaggcaggagaauugcuugauccagggagucagagcuugcagugagccgagauggcaccacagcacuccagccuggcgacagaacaagacuccaucuuaaaaaaaaaaaaaaaaaaaaguaugauggcaugcaccuacagucccaguuacuugggaaacuaaggugggaggaucacuugagcaccggagguugaggcugccguagugagccacaauggagccacugcacuccagcuugggugacugagcgagacccugucucaaaaaacaacaacaaaaaagacacugagucuugcccagaaacuaugggaaacaagugaggugcauggauacuuaaaguacauaguaagauacuaugcuggccgggugugguggcucaugccuguaaucccagcacuuuggaaggcugaggcgggcggaucaugaggucaggaguucgagaccauccuggccaacaugaugaaaccccgucucuacuaaaaauacaaaaauuagccaggcauggugaugugugccuguaaucccagcuacuugggaggcugaggcaggagaaucacuugaaccugggagguggagguugcagugagcugagauugugcuacugcacuccagccugggcaacagagugagacuccaucucaaaaaaaagaaagauacuaugccagugcuaucagacagaugaaacacuucagccuggugugcccaaguaaggcuuucugguagaugaugccugaacugaguccuaaaggacggaguaaauguucaucaggaaagagggagggaaaggguauuguagacaguguagccaguaaaaaagacuuggaaaugugagcauggagugugaauccggucuaagaagaggaguaagacgaaaaaagacuggcugggcuugguggcucacaccuguaaucccaacagguugggaggccaaggcuggucgauuauuugcguccaggaguucaagaccaguuugggcaacagggcaaaacccugucucuacuaaaaacauaaaaaauuagcugggcauggugguauacgccuguggucccagauacucaagaggccgaggugggaagaucacuucagcccgggaggcagagguugcagugagcugagaucacaccacugaacuccaaugugggugacagagugagaccaugucucaaaaaaaaaaaaaaaaaaaaggcugggugugguggcucacgccuguaaucucaacacuuugggaggcugaggcggguggaucaugaggucaggaguucgagaccagccugacccacauggugaaaccccaucucuacuaaaaauacaaaaauuagcuaggcguggugacgugccuguaaucccagcuacucaggaggccgaggcaggagaaucgcuuuaaccugggaggcggauguugcagugagccgagauugcgccacugcacuucagccugggugacagagcgagacucugucucaaaaaaaaaaaaaaagaaaaagaaaaacagaccaaauauguaggcaggaugcuguguuaugagguuuggauuuuauuuuaaggcuaauuaauaggaggagcaauugaaggguuuuaaggaagugauugacaugaugagaucuguuuuuaguaagauuaccggcuacauuguagaggcugguagagccaguaaagaaauccaguugggcgugguggcucaugccuguaaucccagcacuuugggaggccgaggcgggcagaucacgaggucaggaguucaagaccagccuggccaauauggugaaaccacaucucuacuaaaaauacaaaaauugccgggcgugguggcacgugccuguaguccuagcuacucgggagucugaggcagaagaauugcuugaaccugggaagcagagguugcagugagcugaaaucaugccacugcacuccagccugggugacagagcgagacuccgucucaaaaaaaaaaaaaggaaaucccuaagagaauccauguauugguggaaaggaaggguagaaaagauaauuaagagauggaaauggcauaacuuugagaugaugauuaaguggcuaaaaagaaggauaggcugggcacgguggcucacaucuguaauuucagcacuuugggaggccaaggugggcagaucacuugaguucaggaguuugagaccagccugggcaacauagugaaaccuuaucucuacaaaaaauacaaagaaauuagccggacuugguggcgcacaccuguagucccagcuacuuggggggcuuaggugggagaauagcuugagccccagaggcagaggcugcagugagcugaggucaugccacugcacuccagccugggcaacaaagccagacacuaucuugggguggaggggaaaaagucaaggauaaaucccaaguuucuggcuuaguaccauucauuaagagcagaagaagagaacuaggucaguuuugcuggacaguguugaguuuguggcauauccagguaaagguaaagauauccagagugcagcuggauauauaguugucccucaguaucuaugacgguuggcuccaggacccccugugggauacugaaauccauagaugcuuaagucccuuauauaaaauaguguaguauuuauauauaaccuaggcacaucuucuugcuugcuuguuuaguuuuaguuuuuuagauacagggucuugcucugucauccaggcuggagugcaauaacuagauuguagcucacugcagccuagaacucuuggauucaagcaauccucucaccucagccucuugaguagcagggacuacaggugggcaccaccaugccuagcuaguuuuuuaaaaaucuuuuugaagagaugggguuucacuguguugcccagggcaacuaacuccuggccucaaaacaauccucccacuucagccucccaaauugcugggaugagaaacuugagccgcugcacccagcccaucucauauacuucaucucuacauuacuuacaauacccaauacaauguaaaugcuaucugaauaguuguuauacgguauucgggaauaaugacaaaaaaguuuguacguguuccuuuuuuucuccccaaauauuuucaguccuuuggugacugauccauagaugaggaacccacagauaauggcaagccaacgguauccauccagaucacaggggagggauuuggccuggugauacaugcuugagagucacuugccuacagauuauagcagaagccaucugauggaaugagaugauccaggaauaauggggaaagcaagaagcaaccuuuaaggaucagggaaaggaauacucugaaagaaagcugggaacuaggaggaaaaugaagagagagaguucuaugcuggaacuuaaggaaggguguuuuaauaagggggacauggucaacgguguuagaugcuacagagagauaugaacugguggugaggaauuugagaguagaaguaugccacacuuucaaauagacaggcuacaacaggcagaagcuaggauacauaagacaagaggaagcauuuuuaaaguugggugagacuuuagagaugggcaagccagcagugaaagagguuaaugauaaagaugagaagacagauuggagauggagaaagauuucugaaguggugagagguaauaagauacaaugcaagguacauuccauuaaccugcaaaggaggauggauaaucuauucugaaauaagaagguagaauggaacaguggaaucagguuuggagggaaaugcuuaacauguuugcauacuguucucaucuuuacauacuuuuucaacaacccugcaaaguaggagguaugauauaucuucaguucauaaaggaauugauagcacaguugguaaguaaauggaagauuaggguuugagucuaagccuaucugccucccaaguuaauaaucuuucugcugcacaguuucaguauccccagucugugaaauugggauaauaacagaaccagaggccaggcgagguggcucacaucuauaaucccagcauuuugggagaccaaaguucaaggaucacuugggcccagaaguucaagaccagccugggcaacauagggaaaccucaucucuaguaaaaaauuuaaaaauuugccgggcgugguagcgcagaccaguggucccagcuauuuggaaggcugaggcaggaggaucacuugagcccaggagguugaggcugcaaugagcuguguucacaccacugcacaccagccuggggaacagagugacacccugucucaaaaaacaaacaaaacaacaacaacaacaaaacaagcguuuaaggauuuaggaagguaaugcuuccaccacagggcuugaaugaaugaauguuaacuuccucuuaccuauucuuguuuuuuuuuuuuugagauggagucucgcucugucacccaggcuggagugcaauggcgcgaucucggcucacugcaagcuccaccuccuggguucacgccguuguccugccucagccucccgaguagcugggacuacaggcgccugccaccacgccuggcuaauuuuuuguauuuuuaguagagaugggguuucacuguguuagccaggauggucucaaucuccugaccucaugauccgcccgccucagccucccaaagugcugggauuacaggugugagccaccgcacccagccccucuuaccuauucuuuuggaggagaaaaaaucaagaagccuucccagguuguaauuucccaagcuguuuuuuuuguccagcuccucugcauaucugacaaaauuucccauagcaucuuucaguaacacuuuuaucuugcucauacuucccccaucaucacaauuacacuuauguucacagggucucuggggcuugcugucauuccuucaucuggccaaaaaaugcuucuuccugaaagccccgagugaagcauucuccugguucuaaguacaguucauuagcuccccgguuucccuuuucuccuccuucaaguacacagauaacuaaucuaaaauagggccuucccaguccgaaccguugguaucaaguacacaggagugccauagccuugaaucuaauuaccuaguacuuugaauaaaucuggaaagacuaguaugcuugcaagaugauacaaauguauaaaauaaacauuuaaauuauacagaauuuuuuuuuuuuuuuuugcuuugcuugucucuacacagccaauaauuucugaagaucagacagcagcccugauggcccaucucuuugaaaugggauucugugacaggcagcugaaccuacggcugcugaagaaacacaauuacaauauccugcagguugugacagaacuucuucaguuaaacaacaacgacugguacagccaacgcuauugaggagugaccuuguauuaaauaacugccugcugcucagagaugaucuuuauucugucauugggguaugggauagaagcccuugcuuauuuuuaaucugaugaaucuguauagagcccaucguugaguuaccaagacaauaccugcuacaguauuuuggggagcaaacuaaagaccagaacuuaaauuuucacuuuagacauuggaugaauaguaugaagacaguuuuucaguugauuuggauaaaacuauuuuagugcauugacaaguguaacuucaacuucauauagaaccauuuuucuuucugcuuuuauugaaacugaguauuuuucuuuggcuaauguggauuuuuuauggggauaucuguuaauuuucagguuuugaaagacauuaaccucggaaguuguuuuuaagaauuauucucauaauucuuauucucauaauuucuguaauccaccucaagcuucauaguuauuuggcauugaaauaacacccagagcaugauagaaauguuguuacucuuccucucucaaggagaaaguaauuuuccugcaauacuuaauaauuggcaccguugcuuucuaaagacuccauggugcauucaagaguauccaacuucaagggaaucuccgcauuucaaugaaaggaggaagagugugcugauaaaccuaccagcaccuauugagcaaugucuauuauaguaauuuugcauacauuuuuauuuaagggaaaaaauauagguauugugaaauauuuugcuaaucuuauagaaaaggaaaaaaucccguuauuuaaagggaaaaguaaauuuaacaguugccuuuuuucuuaaugucagggcagaucuuauuuuacaguacagugggggaaauagaaacaugugaaaggcaaaaggcaggcuccuaaauuaaugucagugaaguucagggugggcaaaugagugugugugagguauaggaaaugcugaugacuucuuuaaugcuugaaguccguucacagguaucuagcccuagaaugccuagaacaggaagaggcagcugguguucugcaaaacuuggacaggggcaaaguugcugaaaaaguuuugguuuaacccgaagauaaguggaaaagagcuuguccaugaacccagguucucacucuguuuacagaaguguguugaguacaguuggugaaggaagagguaacaaaaaaugcuaaauauuuuauccaugaaaaugacuuccagaaaaggaagaauaugaaccccagaccgaaggggaaaagauaguuaauaguauuaucuaaccugguugguauuuguaaugaauggugauuuuaauuagucauuagccauaaugauguuuauuuacaguauaacuccugaaugcuacuuaaauaaaccaggauucaaacugca

SEQ ID NO: 21497 - RNA, 59965 nt, Homo sapiens
ccuccccuccccucccgcugcgggaaaagcggccgcgggcggcggcgcccacuguggggcgggcggagcgccgcgggaggcggacgagaugcgagcgcggccgcggccccggccgcucugggcgacugugcuggcgcugggggcgcuggcgggcguuggcguaggaggugagugaggcuccggcucggcagcgucgcagcugccccaggaucugcgccccggucaaguugcggacuuggagccggcaaacgcggagggcuggucccgcgcgucugcgcugggaaugcgcguguccuggcuggcgcggucggagccgggagcuggggaccuuccuggcccggcgguggcggggcugagaggugccuggugccugggagcggguccuccgagacgccgaagccaucagccaggcugagcgccuucccggccgccgcggcgcgcacggugcggugggcgcaucucugagccccgcgcucacccggggcugcgcgcgucgcgggugguccuggucgggccaaggacgacuggcccaggagccaaggcgagguggggcuuccggggguuguucccgcgccuuggcagagggaugccgcuguagcuuccugggugagagcgugcgcgcgcgcggguuugccaguuuccccacauuuccaauuucuccuguuacgcuuucuccagaagguuuuuucuuuuccuuuuuucuuucuuucuuucuuuuuuuuaccuucaacuuggcuuccugcgggguuguuuuggagcaggaugagggcuuugccuccuccaguguccccagguggcagcggugccucugcucccagggcagacccugcacccgaaaaaucucuaguguauucggggagccaugaaaaggcucccuugggccggugggauccuuggcuuugucucuggcugcugcgcacaccgucagccgucagggcaauuggcauucggccucuuugguacuggggacacagguggagggauggagcgggcacagcccgggguugcugcccgugguccucucugaguccuuggugauuuugccugggcuggagagaaacccuggcuccuggucugcuggggccgccucugccucagaggaugacacaagagugcauguaaguauuuuuaauaaaaacuguaguacucguaaaacaaucuacacccugcagaagggauuuguuauuuuauuuuauuauuuauuuauuuauuuauuuauuuuugagacggagucuugcucugucgcccaggcuggagugcagugguggguucucggcucacugcaacuucugccuccuggguuuaagcgauucuucuggcucagccucccgaguagcugggauuacaggcgccugccaccacggccggcuaauuuuuguauuuuuaguagagacgcgguuucaccauguuggccaggcuggucuggagcuccuggccucaagugauccgcccaccucagccucccaaagugcugggaauacaggcgugagccaccgcaccuggccaggauuuauuuuaaaaagggaagauuuguugauaaauucacuucaaagauaaacuauucgaaaauacuuuagugauucccgucaagacucuucuguguauguauagacguauaacucauucuggacagggcaaggauaucuuuuuuuguuuguuuguuuguuuugagauggacucucgcugucgccaggcuagagugcaguggcgcgauuucagcucacugcaaccuccgcuucccggguucaagggauucuccugccucagccucccgaguagcugggauuacaggcacgcaccaccacgcccuacuaauuuuuguauuuuuaguagagacgggauuuccccauguuggccaggaugaucucgaucucuugaccccgugaucagccugccuuggccucccaaagugcugggauuacaggcgugagccaccgcacccggccaaggguaucuugaaggagggauuacaguugauauguagaggaauauugcagugguuauugcugcauuuccuaugugacugggacuaaaacagaucagcugauaguguuagcgugcagugagcagucugaugacuaugacacagaaauaagaaucuccagcauucugcccugggacauguggagccuugggucagaugcugcuggcuauugaugccgggaauggagaaauccaccagggcaacucaguaaaaauaaauaaauaaauaaauaaauaaauacauaauuaaaaaaaggguauccuuguccuguccaggaugagaugcuugcuuccaugcacuuacgacaauuuuugcugucauuaaaaaauuuucacauucacagucuucuaaauucacuuuggaguguauuggauuccacugcauugacauacguaaguuugcauuaaaagauccuuuaagauaucuggucaggcacgguggcucacgccuguaaucccagcacuuugggaaguggagguagaaggauugcuugagcccaggaguucgagaccagcuugggcaacauagugagaccuaaucucuacuaaaaauuaaaaaaaaauccuuaggcgaucuguucacagauuaaucuugugauuggggcgauuccagaagugguaauggguugugcugagcuagccccacacucucucugagaagcaguguacaguaguguuuaagggcaggggcucuaaagucagacuuccagaguaauacccccccccccaaccucacaaaucaguuucuacuauauuuauaucugccaucccaguguuggugguagggucuucagaucccuggggaagcagauggugggaugagaguaggagaguuguguugggacuccaaguguugaaggggcacagaaagagcugaguggcacagagagguugucccagaguagcggagucugcuuuggggagaagagagauugacugaggauagcaucaaguuuuucauuuuauguacaaagaugaucuuuuuagcuucacccaggaaguauggguuuugugucuuccucguguuuagguuuuuauucugaccuaauuaggucuaagcugaggugcuuauuucucuucuggaguuuauauccuagaagcucuccaaucgaagcccucugcagguauccucagguccuggagaaacacagcaggaaggcuuguuggcuucggaaagggagggcuaugguuuaaagccaguaagauguggguuugauucuugacuuugucuccuguaggcuguguggccuuaaauaaguuaccuaaucucuugaguccucaguuuccucauuuguaaggcagaggaaacaaugccuaugauuaugcugauuaaaugaaacagaggcacaaaauaaguguuuaaugaaugacaacuacuauugucauuauucuuccuauccaugcuaucugccauguauuggaggcaaaagcuguuacuacuucaugcauaugcgcuaugcaggcuuccagaaugaaacugauggggucccuuucccccacauaugugagagggggucccucuuauuucaacucguuccucauugcugguuuggcauaucucagcuacucuaacccggcaagaauccacagaagaagccaagaaggaaaaaggcuuauacauuugcuuuacccauaagaaaaccucaagcccuguaucugaaaaaagaggaagauaaaaggaucuauaagacuucaaguuccaugagaagagggacaugucuauuuuguucaauacucuaugcccacugccuggcacauaggcagcaaaacaaauaucuguggaaugcuauguaaaggcaucuauagaugaugugccucccuuuaagaaacccaauauuugaauauuugcacucauucauacaagauccucaagugcuccguuuggauaaucuggaggguaugaaaacauagccaagaucaugaauucuuugggcauuugggccgcugcacuguugcaccauuuagaccugugaucugagagugugaaaaacucaagggauccucuguaaagugucugccuuuuuuucccuccugggaggagccguuagaagggcaacauucuccuuucucccccuuggacguguggguguuggggcaagggugaggagugacagaggucuccugggaagaccauaagauggggcaagcacaccacagugaggagggggagucuggcuaugacuuuagaauuuccugaucgaaauuucuccucuaaagcuccccacccuacuugggaucugagguuaucauccccucccagucccaagaacccuucuucccuuguuggcagaaaucuccaggaagcaugcccacaggaaccacaacucaugaaucagaagacagauaauuaaccgagggagugacugagcagcuucagggaugaaccgcuucguuuuacccagcccucucugcugcccacagagugggcugcuccaccccaucgccucugcucccucuuccugaaccuuggcccuuccugagugggaccuucauugugccugauggagcucaggccacuaguggaaaugaaggugggagcagggaaaugacucuguuuaggggaacugccuauuccccgugugggaacugcuggcauuuauugaaacgugagacucuccagcaaaaaagugauagcaucugccuuucuguccacacacacagucucaccaaaaacacucuuuuuuuuuuuuuguuagauaauucagguauaauuuauguacaguaaaauucacccuuuuuagugcauacaguucuaugaauuuugacaaaugcauauagucaaguaaccauugccaucaucaagauacagaauuuuuccaucauccccuaaaauucccccaagcucuuuuuuucccuucuuuuucuuucuagaggcagggucucaccauauugcccaggcuggucucgaacuucugagcucaggcaaucugcccaccucggccucccaaaguguugggauuacaggcgugagcuacugugccaggugcccccccagcucuuuuguaaucgauacccuacccucaacccucgucgguugcaacugcugaucuauuuccugucccugcaguucuauguuuuacaaaaugucauauaaaugaaagcaugcaguguauagacuuucagucuggcuucuuucacuuagcacaauacauuugggguuaaucuaugaugcugcaucuaucaguaacucuaagacauugucugaggccacuccgucauccuccguguuggaacaguuacccugaaagcagugggacuggauccguuaaacuuuggaggugcuccccagcuuucagcuucuaaauuuuauaauuggauagauguauuuagcuauauauaagucauuagauuuuccaugugcuaaguaguuaaagacuucaggauacuagagaggauucuguagcaaccaacacuuauuauucuugcucauaggaguaacagauauuuuguggccaaauauuguaugucaugaugcuuggagucagaaguuguuaaguaaaccugggggcuauucuaccuuuuuacauuuuugguagcaucucugaaaaaacaacccacuugacuuuuuuuuuuuccuuuuuuuugggaggguggguggguggguggcuuuuuggccaaaaccagaaagcuugcuagacaaauucuaacacuagaucuaacacuagaugucuuauuucuguuuuucugucauguucccaugaaaagacuauuuacuuaccccccucucucgguuuuauaguugaguuaguucaauuucuuaguucaguuagugaagauguuuaaauauucaaggagagaaagaaaaagaacaaggugauacacauuuuaaaaaagucaaaauaacaaauauuguuauuucuuggcugggcgcgguggcucaugccuguaaucccagcacuuugggaggccgaggcgggcggaucaccugaggucaggaguucaagaccagccugaccaacauggagaaacccugucucuacuaaaaauacaaaaucagcugggcaugguggcaugcgucuguaaucccagcuacucgggaggcugaggcaggagaaucgcuugaacccaggaggcagagguugcagugagccgagauugugccauugcacuccagccugagcaacaagagcaaaacucugucucaaaaaacagaacaaaacaaaacaaauauuguuauuucucaaauagguucauccacauaggaucauugucagucguuaaaauugcugguucccuucuaauucuauuccccuauaauguucauauuaaucaggugguguguucuguuuagacauuuccccucgcauuuauguuuauuuguguguguguguguauuccuuuacuuaaacccaugauauauaguacuuccuuuuauauagaaaaaagcucaguguggaaagaacaacguaucuggaauuaagaaaccuacauucgauucacaguucugcaggcuuuuucaucagcuugcugggugacuuugaacaagugacuuuaccuuuaggcaucagucucuuggugucccaggggcugcaaagugggacagagaagaugaagggaaauacuucaauuugcuccugccccuuccccaccaccuucaacuggaacuccuuuaacuaauuaacaauuuggaguucauguaaggauuucuuugggaaaaaaagaagauccugcuguuaaaaucaagcuugaaaaacuuugcacuagaagagagcuccagaaguuuggcaaaagacauauucaguagccacuuaaaaagucccuguagucaacccuacaucucuuugcuaauggaaauuuuggauagagaaaccugggucugugagauccacugauggcuccagaccccaacuuuagccaucgcacguguugaacuccagguugagccuuugcuggagccgccugcaaggagcauguuugaccaauccccaguggaggggagggugguguuuccuuucugggacuuccacaaguugagaacagaccaugcugcccugggcaguucuugaaggcugugagagugggccugacaaaguuuauuccuuuuuuuuuuuccauucucuuuuauuauuauuauuguuugaaauugacaaauaaaaauuauguauauuuaugauguacaacaugaugucuugaaauaugugcgcauuguggaaugguuaaaugaaguuaaauaacauaugcauuaccucacauacauacuucugauuuauuuguggugagaacacuuaaaaaucuccucccagcaauuuucagguagaugacauacgguuauuaacuauagucaccauguuguacaguggaucucuugaacuuauuccucuugucuaacugaaaauuuauaucccuugaccagcaucuccucaugcaaaccauaccccaaagcucauuucuguguuccugcugaguuugccauuccaagagguuuugaugcugaaggugcaguuuguggaaagcccagcagacucuggggagccuacauuuaaauaaaugcaaaugucgacagggaggcagaacagaggacauuucaaauuagcuuuaauuuucuuuuagcuuauaaaaguaauuaagcuuauuauuuaaaaaaaggcagcucagaaauauaaugcagaaaguaccaguaccaguuccuuguagucuuguccuuaaagauaaccacuguugauaguuacugcagaguuuuuuucuauguauuugucaacauauauaauuauuuaucauuauuguuauuucucaaauaggauaaucaauaauaggaucauugucuuuuuuuuuuuuuuuuuugagauggagucucacucugucgcccaggcuggagugcaguugugugaucccagcucacugcaaccuccgccuccuggguucaagcaauucuccugccucagauucccgaguagcugggaucacaggcauuugccaccacgcccagcuaauuuuuguguuuuugauagagacaggguuuggccauguuggccaggcugguuuugaacuccuaaccacaggugauccacccgccucggccucccaaagugcugggauuacacgcauaagccaccgcaccuggcccauugucucuuaauaauauacucuaggcaucuuuuuaugucaguuuauggcuuuccauuauuuaucccaagagcuauaauucuagccauaaggcauacucuuuguuauauggauauaucagaauuuacuuaaccaauucccuguuggcagacauugggaucauucccaauuauuugcuacuacaaauaaagcugcaggggauauccuuauucauuuauuaugcaccuuuguucaaguguuucuacagacuuaauuucuugaaugaaaguuggugggucgaagggcaugcguauuuuaaauuuaaauuuuaguagguguugucaauuuguccucccaaacgguugaaccaguuugcuuuccuaccaagacaggcuggcaguaaggacugguguuagcaccgcggccugcuguccacacccauaacacaugagcugggggaggaaggcugcagaacuggacagcaggaugccaaggaggucaccaauagggcaccccugggcugagccucggacagcuugguacagaccugcuucuucuguauacugaaugagguggggucgaugcuaauaaaaauuuccagaacucuugagaugcagcguuugagucaaauaucaggccaucaggaagaaauggccacuugugccuuguuugaggguucucaugccuuggguugcuaggcuuccuaggguaugagucccccuguugauguuuucuggcuggaagaguggauacuuccaggacuggcagcaccuugaagaucaucaaauuugacaccuguuuguuuuacaaaaaagcaaaaagggaguuccugagaagugaagugacuuguccaagaucauacaacuggcucaguggcauugguugggucucucccuggggacucuugucuccugcccagagugauuucuucacuauauccuguuagagacaaagggcccuuucacgucugacccugagguggaggcgaggggauggggauuccugguguaggaagugacuagagugaaaguaagggggaaggaaaugaacauuuauugagcauccacuauagaggguucuuucauacguguuaugucauuuaauccuaacaacucgggagcacuggggaaaggaagcagcuguuuggagucuccggugcuuggccgauguggcugguuagacccguuaaauacuacagagcaguuaucacuucucgacuaugaaugugacauagacucaaagaggcacugggccuuggagagagcaccagagagaugaagggauguacuugaggucauacggccagaggaagggcaaagauggcuuuagacgugagguuuccugcugcuuugcaugcuuuuucugccauauccaucuguuguuuuacugcuccugccuuaccacauuucucaggagcuggguguuaauuuuagaccacaaccuuagagaagacaggacucugucccuggaaugggcuuuaugcagucuucagcacauggcgaccuaauuaaccucauuggagaugauaaccagacauaauguggcuucauuuacaaggacaggaccugcccuagaucuucccauuaacaucaucuugaagugucagcuccacagagagaccuuuccugaccacaugcuuuaaaggagacuccuucccucauugcuugcuauuccccgccccccccacccccacccuuucuuuucccuuugaggcagagucucacuccaucacacaggcuggagugcaguggcacgaucuuggcucacugcaaacuccgccucccauguucaagcaauucuccugccucagccucccaaguagcugggauuacaggugcgugccaccaugcccagcuaauuuuucuaguuuuaguaaagacuggauuucgccauguuggccaggcuggucuugaacuccugaccucaggugaucuacccgccuuggccucccacagugcucagauuacaguguuagccaccaugcccggccuauccugcuuuauuuucuuacagcaugaagggucaaugaaaggauauggccaguggucaagacauuugaacuuuguguacagggaauccccuugcucagacaaaaauccuuccuguuuuucccuugugaacaaaaguucucugaaaaggaauugggaggaaagacuuuauuccaaugaacaguuuggaaacuggggaaacucagcuguuggugucagaauuggggguuuauaaugaaaguuccugccuaggauccugaugagguccacuuaugcaaaugaacaauuccaacuugcuuaguucuguuugguugaaacaacugaggccugauuggucaaggcagcagagcccugacugguuauuuuagguuagcucuggaggucccaaaguugaagagagguguugauuuucagggaacucaaaguggguugugaccucuagucagcaaauggcagcuuugcucuguuuaaaauuuaggcccacuuagccacuccagaucuaucuugaaggacuggcucuuucagguucacauuuguucacacccucaugccccaugagccauccaucagcaagucuuuagauggaacguaucuagagucugaccacaucaguggcuccgcuacuguccaaauccacugccaucuguugccuggauuauuuuaguacauuucuaauugaauaauaagucucuuuccuuuuugcuucccuucuuucugucuugcacucagcagccaggaugaucuuuuuuugcucaccucugcucagauuccuccaguggcuucccacuauguggagaaaaaagccacacucucuaccauggccuauagcuuccuaguguucuggucccuaacugcuccucuaaccuccucugugcuuuucucuuccuccuuucucuccaccugcuauuucuuuaacaggcugauguccauccagaucuugccuuggguucuuucuggaaugucugugccuuggaucgucccaggauucacucuuuaacaucauuuugaaaugucagcuccacagagagaccuuuucugaucacaugcucuaaagagaguccuuccccuuauugcuuguuauuccuuuauccugcuuuauuuucuuacagcauuugccacuguuugaaauugugcauuuuuguuguguauuuuuuguuaccaucuuccucacuaaaauguaagcuucacaagagcaggggcuuuguuuaguuuaucagugugucuccagugccuaggagagugccuggcacagguagaugcucaaugaauauuugucgaguaaaugaaugaaugaaucaaugaaugcugacaccauugauauauauagguagaaaaauguacagcuaaaguaaccauuuuucaaaccuuauccauacguggauuaaaugcaacaaaaauuucauuucaugcuggcuuuuuuucaaucaugcaaaguauuucacggcaguguucuucaaaaucaugccauauacaugauggagaugcaaauccauuuuguauuaguuucuuagggcuguuguaacaaagcaccacaaacuggguggcauaaaacaacagaaauuuauucuuguuggaagcuagaaaucugaaauuaaggugucagcaggcccauggucccucugagacucuggguagaauccuuccuccuuccuaucuucugguguuggcuggcaauccuugguguuccuuaguuucuggcuguaucacuccaaucucugccucauguggcauucucucuauaugucucucucuucgugugguguuuuccucuucucauaaggacaucagucauguuggauuagggccuacccuaacgacaucaauugaucacaucugcaaagaccugauuucucuguaaggucauggucaugggcacugggguaaggacuucaacauaucuuuuuuggggacauaagucaacuuauaacacauuuuaauauugguggaggcaaguuauacacaaauguuuuccaauguuaaauaccguacuuaacuggcucugauauacuuaaaaacaguuuuaaaucucuaaaaucaggacauauacuauauucauaguguuagauuugaugaaauauggugccuggguucucuacugcuuugggugaugcuuacuggagcuuuuugcucagagcacagagguauguguuacccuaaacuccaccucccugucuccuucuccuuccuuggguuacuuagcugaugcuacauuuaaggaaggaccaaaauuaaaauaaacuuucuuagcaacuugcucuagauaaaccacuugugccuauguaggacaguaagcaugagauuuuuuuuuuucaugagucacauggccaggugacuacaaugaggcaucaugugagucacccacuguccccauggaccuaauugggaagugagcagucaaaggucaguggcagggcuggggacccagauuagaacuccuuucuggcagagugauagauguccauaguguuaguggaacauccucccuucucgauaaacaccucuuacugugacuuagcccucuccuguaguccccuguccucauuaggguggccuguuccuacaguccagcauccugucucacuggacaacauguccucaaaauagcccccauugacgcauuaugacuuccacuggauccaauucccucccuuguuuccuuuguucuuccauuuuucccacccuuugucucucuucugcuucugugauucaagcugaugugccaaaccacagccuucuacuucuacuuuccaggcaaacuucuuggcuggucuugauuggauuaaaauuguuauuuucaaaaaacuuuuuugaggcagggucucacuuuguugcccaggcuggagugcaguggcacaaucacagcucacugcagccucaaccucccagguccagcugauuuuccugccucagccuccugaguagcugggacugcuggugcaugcuaccaugcccagcuaauuuuuaaaaaaauuuucauagagaugggggucucacuauguugcccagacuagucgccaacuacugggcucaagcaauccuccugccuuggccuccgagaaugcugggauuacaggcaugagccuggauuuucgaagacuaauauuccuaaccccauuuagaagccagaucugacaaguaaacauuucacccuggugugauacuuucuggcuccacgcucccacgacuccuucugcucagggcauacuuaacgucaugucuaguguccccuagaaugaugucaucaaggaaaaaaaaguauucaccugcccuaaacaauuugagacucaggauaaaaacaacaauaaaaccaauauaaauuacagcagcagcagcagcagcauuuauugaguacuuucuguguuccagcuguugugcucagaguuuuacaggguuugguuuauuucauccuuacaaccacccugugaagacuggggucaauccaccuugucccugguucuggcuaaccugucagaggaaaggggugguaggagguaggaguuguuuguucuguaagugacauuauggugaagauucccacuuuagcaggaaugagucugggccccagagaaugagcaggaacauaggcuuuaugaaugacuggaaacagaggcccaaacuccuuccacacguucaggagggaggggugggcucagaacaacaacucauugaaucagcaugggcucagugcagagacuucugaugagucagucacuuuuaaccacugcauuccagggaaucugccuggguagcaggacuugguuggggguaucaugggggguucauugguucucauaaaaucaaccugugauucauuaaaaagaguggauaaagggacuugguaaccaugacucugcaggcaugauuuccuaaagaacaaaucccagcaccucauuuuauccucuggggucagggaccauuaguucacugggagggaccugcuguuauuuauuuuguaucuugcaaaacuuucuauuguggcuacaagucaaggacucauagggaaaugcuaauuugagaaugaaugggugguuaaaugaauagacugggaaaaguccuaaaaaguaaucugacagugucuguauuaguucauuuucaugcugcuuauaaaaacauauccaagauuugguaguuuauaaaggaaagagguuuaauugacucacaguucaacauggcuugggaggccucaggaaacuuacaaucaugguggaaggggaagcaaacacguccuucuucacaugguggcaggaaagauaagugccaagcaaaagggagaaaagccccuuauaaaaccaucagaucucaugagagcucacuuacuaucaugagaacagcagcauggagguaacugcccccaugauucaauuaccucccaucaggucccucccacaacacauggggauugugggaacuacaauucaagaggagauuugggggguggggcacacugccaaaccauaucauuucaccccaaccccucccaaaucucauguccucacauuucaaaacacaaucaugacuucccaacaguuccuucaaaucuuaacucauucaaggauuaaccugaaaguccaaguccaaagucuuaucugagacaaggcaagucccuucugccuaugagacuguaaaauugaaagcaaauuaguuacuuccuagauacaacgggaguggaggcauuggguaaauacagccauuccaaaugggagaaauuggccaaaacaaacaggcuacuggccccacgcaagucugaaauccagcaggacagucaaaucuuaaagcuccaaaaugaucuccuuugacuccaugucucacaccuaggucauauugaugcaagagguggucucccauggcuuugggcagcuccacccuuguggcuuugcaggguacagccucucucccagccacuuucaugggcuggcauugaaugucuguggcuuuuccaggcacauggugcaggcugucaauggaucuaccauucuggggucuggaggaugguggcccucugcucacagcuccacuaggcagugcccgaguggggggcucuaugugggggccucaacccauauuucccuugugcacuccccuagcagaggcucuccaugagggcccugccuuguagcaaacuucugccuggacauccagguguuuccauacauccucugaaaucuaggcagagguucccaaacgucaguucuugacuucugugcaccuguaggcucaacaccacauggaagcugccaaggcuuggggcuuguauccucugaaaccauggccugagcucuauguuggucacuuuuagccauggcuagaguggcugggaugcaggucaccaaguuccuaggcugcacauagcagggaggcccugggcccagcccaggaaaccauuuuuuccucuuaggccucugugccugugaugagaggggcuaccaugaaggucucugacaugcccuggagacauuuuccccauuuucuugguaauuaacauucagcuccucguuacuuauuucugcagcuggcuugaauuucuccacagaaaauggguuuuucuuuucuaucacaucgucaggcugcaaauuuuccacacguuuaugcucugcuuccugcugcuguaugcuuugcugccuagaaauuucaucugacagauccccuaaaucaucucucucacauucaauauuccacagagcucuagggcaggggcaaaaugcugccagucucuuugcuaaagcauaggaagcaugaccuuuacuccaguucccaauaaguuccucaucuccuucugagaccaccucagccuggacuucauuguccauaucacugucagcauuuuggucaaagucauucaacaagucucuaggaaguuccaaacuuuaccacaucuuccuguauucugagcccuccaaguuucuaggaagcuccaaacuuucccacauuuuccugucuucuucugagcccuccaaacuguugcaauuucugccuguuacucaguuccaaagucacuuccacauuuuugguauccuuauagcagcacuccacucuaccauugccaauuuacuguaauagucuguucucacacugcuaauaaagacauacccaauaccagguaauuuauaaaagaaagagguuuaguugacucacaguuuagcauggcugagaaggccucaggaaacuuacaaucaugguggaaggggaagcaaacacauccuucuucacaugguggcaggauggagaagugcugagcaaagggggaaaagccuuuuauuaaaccaucagaucuugugagaacuuacuauuaggagaacagcaacaugaggauaaucaucccugugauucuauuaccucccacugagucccucucaugaccuguggggauuauggguacuacaguucaagaugaguuuuggguggagacacagccaaaccauagcagugcucauaucucccaugguccucuucccucuucuaacccuucuugaugucuucuugugcuucugucucuugugaauaucaauggcauuuauguccagaauuaccccuuggcaugccaauucccauggaaacuccagaaagggagggagauacuuaaaauaguucaggcugugcuccucucagaagucuucugauaggggaaaaaagagaggcucuguccacaucugccugggaagagagcaauuauaaggcuaagagauggccaggcagcucaugcagggagaagucuuggguugcauuguucguugugaacauucaggaauucugaaacuagcagccacuuuucuuucauuauagacauugcauggcucagggcugccccaucucagaggugaccuugaugcuuuaaggccaggcuuggaaccaaugucaucauucccacucaugggccucacgcuuacauucugaaguuguagucaagucggagaguggagccccagagguuauucaugggcucauaaaggcaucccacuuguagaauuuuaaaguugggcaaggccuuugaaguuagauggacucaaggcucugaggaaaccuggggcuuccaggaggugcuucaaggauuccgcauauaaucuaggguuuuugggagaacaaugaaaguuuaaauugccugaggaauuguuguagcccauuuacauguuuuauauuggaauucuaugcauaauuuugagaaaugagcucaguugcuuaaaaaagcaaagcaaaacuucaucuauuccccuaccuuucauuuugccccagugcauauuuacugagcaucuccacugaguaagaacuggagcugagcugggcagggcagagcaggucucaagggacuuaaaaucuguuggguggcaguguuguuaaggcagacacauaaauuauuaugaugugguaggaauauuagaauugaagaaauggaggcugagaggaguuaaaugauucacccauggccacacuauuagugggugacucgauuaggaugacagucuacucauuguguguacccauucuguuagaccuccugucccccaaguaagguccugaaauggguacuguuaaaguauauauaauuuuaacagaguuaaaaguaugauuucuacacaaauauaaagggaauauguguaaaagauuuuauucaacuuuaguaauuaaagaaccaguaagacguuaggaguaguucaaaaggaauuucaaagaagggagauuuaugguugaucagucaaaggaaugcugaaaugaauuagugaauagauugaaaauugguuaauauucugcaaggcaaugaaccuuaaccugugggggauaaccuuuucuaccagacagaaaucauugguauuguuguuggauaagaauaauauacauuguucucuuaucuaaauaauuuaccuugcacaccacaauaugaucaugauuagauuaaaauguugucuuagccaguucuagcagcuauaacaaaaugccauaaacuggguggcuuaaacagcaaacacuuauuuauuuauuuauuuugagacagagucuugcucuuguugcccagguggagugcaguggcaugauaucggcucacuguaaccucugccuccuggguuuaagugauucuccugccccuccugaguagccucccaaguagcugggaucacaggcgcccaccccaaugcccagcuaauuuuuuguauuuuuaauagagacgggguuucaccauguuggucaggcuggucuugaacuccugaccucaggugaucuaccugccucggccucccaaagugcugggauuacaggcaugagccgccucaccggggcuauuuuuuuuuuuuuuuuuuugagauggagucuugcucuggcucaggcuggagugcagugacacuaucuuggcucaccacaagcuccgccuccugaguucaugccauucuccugccucagccucccaaguagcugggaccacaggggccugccaccacacccggcuaauuuuuuguauuuuaguagagacaggguuucacuguguuagccaggauagucuugaucuccugaccucgugauccgccggucucggccucccaaagugcugggauuacaggugugagccacugcgcuuggccauuuuuuuuuuaaaagaauaauauacauuguucucaucaagaauuauuucccuuuuuuuugagacagagucucgcacuauugcccaggguuggaguguaauggugaucauuuccguuuuuaugguuuucaauaggucaacaucuacucuuacaguauuguaaaauauccugauuaauagaagccaaauaauagguacauacucuuagaaaaucagauaaucccuaagcauggugggucagcuagucaacauucugcauuacauugaaaggacauuuguauuuucuuugccuguuuccaaauuuuauguaaucuuucuuucuuucuuuuuuuuucuuucuuucuuuccuucuuucuuucuuucuuucuuucuuucguucuuucuuuucuuucuuucucucuccuuccuuccuuucuuucuuuccuuuuuuuucuuuucugagauggagucucacugugucacccaggcuggagugcaguggcaugaucucagcuaacugcaaccucugccuccuugguucaagugauucuccugccucagccuccugaguagcugggauuacaggagugcaccaccacgcccggcuaauuuuuguauuuuuuagcagagauggaguuucaccauguuggccaggcuggucucaaacuccugaacucaagugauccgccugccucguccucccaaaguggggagauuacaggcaugagccaccacgccuggccauaauuuuucuuuacaauauuguguguguguauacacccucauuuucugaguguguuuuuguccagguguugggaaggagggaauucagucacacuguaauaaaaugaauggagacagcuaaaugagaaguuuuggggacacugggaaaacaucgcaauggucaggcugauuucuccaaaauagguucgcuggucuuaccagcuggggucaaagaggucccuuuggaaaacugcaugaaggagcugucaggguaacugggucauggagaggaacagaucccucacauucugcuccuuauauuggaaaaaaccuccuuaaggcacugcaggaagaaggguucaccuggcuggagcaggaaugcugagcuaggcaauuagagaggacaguggcuucugucuaagcagaugccuggguuuggcuuccuggcugagcuucucaaggugauuuugguucuccugguuguuucugcuccuccucguagccuuugcucuguccuuugacaguaugaggacuguucacauuugaauagcaccuuauaguguaccaagugcuuccccuuaccucacugaauucuuguacaaauccugagagacagauauugucaucccauagaggcuaguugaguugcccaaggucaugaaguaguuagcaggaagaacauucagaauucaagcacaaaccuuccaacucuaaaauuccauguucuuuuaguguauaucagucagccuuuucuaacauuucugcacuuccuccuagagcauuuugugguuggauuccaagauauaugcauugagaagcuugagaagauuucagauuugcuuuucuuuugccagucagugggacacugccaccaaagucaccucacccuccacgcccccacuguauuuaggcuauguguuaauguuagugcaucugggccuuggauccccuguguaguggcugugaauaucacuagaaugacugaagaggggauacauugccauuuuucugggccccggagauauuuucauuugcacaauguaggugucaaaccaguuguuaauuaaagccuuuccaucaguuacgaucugagacuugcguccauggcucagccuugcccugucacuuguuaccacuguggccucaucaguugagagcggugaugaguuucuccugauuuuccuccuccuccuucuuccuaaccaauaaccuguauuugguagacgucugugguaugguuaggguguguuugugugcaccugagagcuguaaaccuggacauugggaaaguugggaaggaugaggcaggcaaguaccuucacugagccaaaucuggugcuaaugccuuugucugucuguugcagggcccaacaucuguaccacgcgaggugugagcuccugccagcagugccuggcugugagccccaugugugccuggugcucugaugagguaaggagcagauaccagaccuuguuucuucuccagacuaagcugcuuuugugcagaaacagacccaugaaguuaucaccucccucuugaauacacaugccccuuaucccuucuaagcaaaacuuugaugaauuuuucccauugaugcauggugaggagcugucauggggauguugcugggaauacuaacccaagucuaccauauagccccuggcccuugccaguuuggcucgaccuccuguccucucuguaaccacugcugcccuuucucacacuuugcuugcuuuuuuuccuaagaaaaacaguuuauuuuaaauuuuuugguagagacagggucucacuauguugcccaggcuggucuugaacuagacauaagagauccuccuaccuuggccucccaaugugcugggauuucaugugugacccaccaugcccagcccuuugcuugcauuucuugggguggaauaucccagggaagcagggcgucaggucucaaaaggagaggcagcaagggguauagguacggaugggguugggagggguugcuggcuuacuucuuuuuccuagagguuaaaaaaggcaaauagaagagaaaucuugugcuuguguguggugauguuuagucagaaaaucuuuucucuucccuucucuuugaugauugggccccgcggcuuuacauuuuucuuucucuucuucuuuccuuccuuccuucucacagguguugaagaaaggagcugggcccacuuggugaggauggaagggggacaggaaaggguuaguugugucuaggcagaggguuuguugugucuggggcccuagggaaugagugugucugagggaauggcuauguuuguggcugggauggaaauuuggagcuggcaagagcugaugggguggggguggaagaugaaugugguugaagagauucggugauuauagagucucaggcugagucacuggccuggccagcaggugguuaccugaguuccuggccuggcugcggcucagcuaccugaggcuuccucugucccacaacaagucccagcccucuccaguuuuaugaccgcuccaauccagcccucagucucucugucugcuucuuuuucagaucugcugaguuuccuaaaaaggcaaccucccuggccgccuggggggaggggcgggagcugggaggcuguguuuaucaccggccaggagggcugccagagcagcagaggccagcuccgcacguugcuuuggccucuuugccguucagcacgggaacugcuuccagaggcagcugcccaacaucugggccacauuaacuucauuuagcaaaugaaacauucccuggggcuagggaagggguguaaggggggcauggaugagaccuucucccccacccccgcagguucuccuccccucugggcugagcgggcugcucagugugauguagccuccucccuccuuauucacuauguccuccuuccucccaucgugauauuacuaaagcuucuuuuaccaggaaguugcaauucugcaacugaaugcuggaagaagagagagcugaauggggaggggggccuuggguagccgaaagccuucaggagcagaggaaggucaggacagaagcccuagugucacucaaagggugcuucccccuuuuccuccuucccuccuuuccaacccaaagcaagagaaaaugcagguaucucuggcccagagaaucuggggaaaaagaaaaccuucuuggagggucuguccugcucccuaucccccauuuuucaucccucuugaucuguauagggacuagccaugcagcugaggugggcuggggccugaccagacaaagcccuuaggucacauaaccagauuucaaagaugcaaauguagaauauuuaugggugacuguugugcuccuuguccccuggggcaggccuggggagggcagagggaaaggugcaggguagaucagagcaugacauaggaccagccuaggaauuaggggugcagucagugaggaaaugggcgcagcuaggaccaaagaaaacaaauggaaggagguagaaaguccaguaagauauucccugggagaauggcauauaaacaugaaaggaggcggggccaagguuagugaaggacuacaacuaucccucagcaagagggaggagggagagaaggaaggguggaggaccccaguaugggacagaauguggugaccggggagggaugggaggugggaauccuggacuguaaccugaacauaaaugcuauuuuguucuugagaggagcagggcuuccccuggauaggccaaguuuaacugcugaaaaugccuuggacauugacuucaaaaaaccaaaggugaacuggcugguccauuuuuuagguaauuuuuugaauaaucaaaccuuggagagcccucuguucuucuuccuccccugaguuggcuguuccaggcaagcuggcagugccuggaaaaacaacugguugggcucggcuuuccccuugguccuagaggaccggagcucuuggguguguauagugagagcuuggcuggguaagaggaaaacagccaacguggaugagcacggaguuuugggcccaucugcauaggguguguucuuggaggguuggauaccgacgcggguuggguugcugugcucucucugguccauaaaucuagcaaagaggcgggcuuuauacagagacucaacgcguagucuuagucucaacagugacaugcuggagucuagaaccucccaaacucauuugguguugagaauugccugaggugcuuguuaaaaauaaagcuucccgggauggauccugggucuguuacaucagaauggauauuuaugauagcaaguuuggcaaacauugcuaauugaagggccacugggguugggucaagguggauggagguggaguuaagguugccagauaaauacagaacauccagccuggugccuguagucccagcuacucaggaggcuggagugggagaauccucugagcccaggaguuugaggcaauagugcaccaugaucaugucugcuaauagccacugcacuccagccuggguaacacagggagauccugucucuaaaaaauaaaucuagauuacagaacauccacuuaaauuugaauuaaaaaauaauuuuuaguauaaguuugucccaaauauuugcuaaauuuggcaacccuacaguggagggaaauacuaggaauucuuauauaagccugaguacacccuggaaggugggccagcuucccacuuagccugacaaccaagggugacagaggaagaaggaguuugagucuagcaaaguagaggaagacucuaauaggauuuccuucucauuuucuucucugcaacugcaggagcaagauauaggccaugauuuacauuucuuuauaaucacaaacauaauuuuauucugacuugucuucuuucuauuuauuuuuaaucuggaggacaaauguucaucuugagaguuuugcuccaauuuauuauuguaaaaggaaguauaauauuaagagugcuccucuucuuguaaacaaugaaaugugaauaccaacaacuauaaacaaaaaugcuucauguuccuccccuccuccuuucugcccucuucauucuuuucucuuugcauguucaagugauuucuuguccucaccagaugaguuaaucaagacagcaauggaugggagauguuuugguggugcucugggguaaaaaaaguacuggggcauauugacucucgcucuccaagaagaguaugaaauaauaguaguuauugugguaacuguaaaaaagagucaccugccaggugugguggcucacuccuguaaucccagcagggccaaagugggcagaucacuugaggucaggaguuugaaaccagccugaccaacauggcaaaaccccgucucuacuaaaaauacaaaauuagcugggcgugguggcgcaggccuguaaccccagcuacuagggaggcugaggcaggagaauugcuugaauccgggagguggagguugcagugagccaagaucgugccauugcacuacucuagccugggcaacaagagcgaaacuccaucuaaaaaaaaaaaaagagucacuuauauuugcauuuauuugcuuauacuguguccuaaagcaggggcuccaauuccuaguccauggccuguuaggaacugggccgcacagcaggaggucagcagcaggugagugagcauuaccgccugagcuccaccuucugucagauccgugguggcauuagauucucacaggagcucaaacccuacugugaacugggcaugggagggauccagguuguucacuccuuaugaggaucaaacuaaugccugaugaucugggguggaacaguuucauucugaaaccauccccaccucccuguccauggaaaaauugucuucccugaaaccagucccuggugccuaaaagguugggaaccucuguccuaauggauuucaguauaguuaacuuauguugagauuuuuauauuuugaaagcauuucacauucacagucuucuuuuacuuccugaccaacccugugaaauaggcaggauaaugacaacuauucauguuguacuuucccaauuuccaaaaugggauuaauggagaaugguaccaagagcgugugucacccucccaggagagggagguaauucagccagcucgcagggcgcuggcuggaaccucccaccucugugcucaggcccuuccccugggucuuggcuauuuuugcccuuuuuguguaacauccgguuucccugggaacugaaacuuuaauauccaccccucccccuucuagcuuucuuccugcauaaccuggagacauucuuucuaccuucucagccuggguuaccaagaaagggaauguugcccaaguauguugaggucacugccuuggugcucuucuggaacagagggcucucguggagagcuuggcugacgagcaggccuguuauauuccugaccucugaugucagcaaccacaaagggagggagggaggcaguuuuguuuuucaguguuuaauuuuucuaaggaaacucauaacaaaccauuaggacugucagcacaucuuagcgcuucaaacccucuucucauuaggacugccacauuagaaaauaggagucaggaaacucccgucuaaugcauucucucccucugcugauggagccugaagaugcaugaaggccuugcugcucucauccaguuugcugggcuccggucccugcugucuucuucagcaucugucuugguccuggaaaggauccgcuccucacugcauucugauuuauccacugccuuuuugggaagguuuucucccuggggcuuugugggcagcuagaaucagagauaggauuggggcuuuuuugagcaagagaaagacugcuuccagaggaggaagggguaggagaggugggcagggacaacaggaggagucugggcacaaaaccugaagugcccaaguucuccccaggucauuccguccucagccagagcugggugcacgggagacuuucaucuuccucagaguuguggaaggucugugaugucccuguuggaguauuugccaccaggaagguuaagucuuauucauugauuuccaucgccgaggcugguucccugccugcauaccugugaagaugagagagaaagagagaagcugcuggcuuccagaaacucuacuuacuucuugccugggccaggguaguccucaugcuguugauguugcucguguccccauccacguggggaaggcuucagcccaugaaagggggaucggacuggagagggagagagacuuuaagcauugggaaggguuuuggguuacaggguuuuuuuguuuuuguuuuuguuuugagguggggucucacucugucacccagacuggggugcaguggugugaucuuggcucacugcaaccuccgccucccuggcucaagugauccucccacuucagccuccugaguagcugagauuccaggugugcacuaccaugcccagauaauuuuuguauuuuuaguggagacgggguuuugcccuguggcccagggugguccggaacuccugagcucaaguuauccacccgugucggccucccacagugcugggauuacaggcaugagucaucgcacccggccgguuacagggcuuuugaguaugaauggcuccuuguggcccagucccucuucuggcauuauggcugccagguugcuugagggggcugaggaggcagaugucauccauccuucuccaucccucgcacaugcccaccuugcauccuguucccuaccuggggcauucucuguuguggcuccucccuaggaccauuccuuccacacuuuuccuuuuccgugccuugacucucacucuauacggaauguaguaaagcuuauuuuaugaugauaauuacagucagacaaucuagcuggccucucaguucugccacuuccuagcucugcaacuuugagcaaauuccuuaauuuauccaagccucagauuccuuaccuguaagauuggguuccuuauuugugaagccuccaaaccuuagguuucucccuuguaaaauuauaauaguuccagcauuauggaacugucaggcauauugcaauaauccauguaaagugcucaccacagugccugacauacaguaaguguucaauaaaugucaacacuaguuguucugggauauugguguggguuauccagcagacauuuggaagugcugguuggggauguggguaggggugggguugaggagagcccgaaggccuagacauugugaaauaggucccgggagggguuuuccagcuuccuggcugguccccucaacuugguaaggagcccucauagacaugcacccacacaguguuggcuaaauuggcugaaugucagagccggaagggacugaaaacacugugucaucuaaaggccuuguugaacaggugaggacacaaaaugacguaucugaggucacaugacuagucaguggcaggccuaggauugaucuucuuuccugauuuucaguguucuuuccaggguggcgugguccccuucaauacucagguuuaagcacccagagccccagggggccguggguuuuuggaaggguacucaauuuguucuuuguucagggugaaggaggacacugaagugauaggaugggcucugguuaggugccuggcccauguucccaaguuuguggaguuuauucauaauuagcuuauccaggaaguacuugucaagcaucucauaguaauagcuuacauuugcugaggacuuccucugugccaggugcuguccaaugcauuuuauguggauugucuuauuuagccugugugacaucccugugagggagguaccauaauuacuauuauuuuaaguaacuuuuauugugggaaaauauacauaacauagaauuuaccaucuuaaccauuuuguuuuguuuugugagaucaagucuugcucugucacccaggcuggaguggaguggcacgaucuuggcuugcugcaaccuccaccucccagguuuaagcgauucuccugccuccgucucccaaguagcugggacuacaggugcacgccaccacaccuggcuaauuuuuguauuuucaguagagacgggguuucacuagguuggccaggcugguaucgaacuccugaccucaggugaucugcccaccucagccucccaaagugcuaggauuacaggcauaagcaacugugccuggcccaucuuaaccauuuuuaagcauacaguucaguggcaugaaguacauucauaaugucaugaaaccccucaccaccaucuaucuccuuaacucuuuucaucuuguaaaacuaaaacucuguacccaucaaaacaguaauucucuauuccucccagucccuggaaacuacuauucuacuuuuugacucuaugauuuugauugcuguuaaguacugaaggagggacuguuauuauguucguguuacagcugaggaaacuaggcuuggaggaauuaggugacuugccuuaguaagcaguuguaagugcaaugcugagauuuacuccugugcucuuagcccugacucucuccugccuccuuacacugccuuucccuaucacauuugugguaaguccuaggucggaugcugggaaaugagaggggccaagacacacacagucccugacuacauggaucucacagucuagcccgugucaaauacaguagcuuccaaacuguuuugacucugaccuacagaaagaaacacacuguacuggguauaguuauuuauuauauguguuauucuccacucuccuccaacaauauaagaauuucacaaaacaacccuuugacuauuuguacacuuucauauuuucuauucuauucuauuguauuuuauuuaacaaaaugaugguugacaccugcuaaauugauuuugggacccacaaaugugugguauuccacaguuaaaaaaugcuggucuaccaggcaucuuacuguacaggcucuccuucuagcuacaacuccaugaauaggccuucuugauaucucaauuucucuuuucuuuuuccuuuuuuuuuuuuugguagagacggggucuagcuauguugccuaggcuggucuugaacucuuggccucaagcaguccucaugccuuggccucccaaaguaucaauuuccccuuucuguacaacgguccuaagggauuaucccaggaaagaccacaacaauuuguuuaugcuccaauguacgggguaaacucuuagcuauugggaagugguagggccugcaggagguagagagucgccauagcucugauugcuggacuucucuuugggcuccugucuuacaggcccugccucugggcucaccucgcugugaccugaaggagaaucugcugaaggauaacugugccccagaauccaucgaguucccagugagugaggcccgaguacuagaggacaggccccucagcgacaagggcucuggagacagcucccaggucacucaagucaguccccagaggauugcacuccggcuccggccagguagggcugggacucuuugcggggagagaccugaagcaggugggcauagagcacaagguggaggucugaggaggaagucuuggggaaguagcucagaauggaaauggggugggaagacaaggaugaggggggaggugugggcaagagaauggaagaaaauaagagacguuaggacuugagucagaagaucugaggugaaucuuuacuguaucauauauuagcuauuugaccuuggacaaguuacuuaacccuucagacauaguaggugcucaaaaaauauuuguuucuucuuuacccaagugccuguuuuaccuagcuuagagcuuuguguugaggugcaaaugagauauagaacaagaaagcgacuuguaagccccccuuucauggggaauugggacaggggaaugggggcagacacaauagguacacaagaccuuuagagggaggaaggguuagacuaaagacagaaauuuugaagcauugauuuugacuuuccaacuaagucaagaaggauuuaccuacuaucaaggcauguguuggaugcaaugggauucagagaaggguagggugcaguuucugucuuuuacagagucugaaguguaguaacuaucaaaaucucugugacucacagugauagacccguggaacucacaggauuagaaauccccugggauuuagagaaaguggaaaauuuuagaauggaaaagaagagguuaaaaauaggagggucaagagauuagaagaguaauagaauugcaaaggaagaggaaaagggaccagggcuuucugguuugcuuugaucaugcaauuucuuagucccaacuguauccaaaucugcuuauucaaucuuggugggagaagaagauaaaaacuaacaucuuucugccuuccagaugauucgaagaauuucuccauccaagugcggcagguggaggauuacccuguggacaucuacuacuugauggaccugucuuacuccaugaaggaugaucuguggagcauccagaaccuggguaccaagcuggccacccagaugcgaaagcucaccaguaaccugcggauuggcuucggggcauuuguggacaagccugugucaccauacauguauaucuccccaccagaggcccucgaaaaccccugcuaugaguaagucccuccuccagacgccaggacagcauccuuugccccaggaagguccaaguccugguuccuauuucuagcucuaggaucacuuuguuggcugucuucuugccaaacuauagcuccuuucuaccuuggucucccuguuuggcaaaugggcuagcuuguggaucuggaguguugugucaauggagccuaaggcuguuuggagaaccuagaaagaaaauucaucagcuucucagucuugguaacaaauaaauagaaggcaagagagaaugggagggaaaugacgucaaaaguagaaagaaauuuauggauaaggaaaccgagaaauuacgauuacagaaggaucgauuccauuguuggcauuauugucuucaucaaggccgugcauccugcagggugaaaacagaagaaaugaagugcuaaggaauauaaaagaguggaaaugacauuuguuggacacuuuuauagucuguaaauggauaacuugugccucuguuugacacuuuggcuuaaaacugaauggcuuauuuauuuaaucgguggagacugugcaaauccauguauuagaauaacuuacaaugcugguugcugagccugaaaaggugugaauuuacuuuuuaguuuucaaaguuacggccagguggggugacucacuucuguaaucccagcacuuugggaggccaagaugggaggaucacuugagccuaggaguuugaguucagccuaggcaacauagugagacccccaucucuacaaaaauuacaaaaaaauuagcuaugugugauggcgcaugccugcaguccccaggacuacagggaggcugaggugggaggauugauugagccugggagguugaggcugcagugagccaugauugugccacugcacuccaaccuggacaauggagcacaacugucucuaaaaaaaaaagaaaaaguuuugaaguuauaugauguggcauucaaccuucuaucuggguuguaagguucccaggcaagacaucagcuauuaauuaaacacacuauuuugacugggggcagaaaugcuccugucuugcaugaucuaucaauuuauugaugguucagggaccuuaacuuacugauggacuuuugcuuuauuguuacuuuaggaaaguguuaaguauaaggugauaguaauagcaacucgagccucgcucuggucuaagugcuuuguguguaugaacuuacuuaagucucacaacucuuaugggauaugugcuauccuggccccucuuucauagguuggauugagaggcuugccaaaggucccaugacuaguacagagggcaccugggaucuaagcucagggagucuuguuuccagcucaaucucuuaucuucuagguuagcuggauggggguaauguugauggggagcuucagauaauuugaggauuuuggagucugaacugucuggguaacugugguuguauggaacuggccuuggcauaccacuaucuauauuuguccccucucuuuccucccaauucccaugcugccuuuuccaugaaggugucugcuuaaauuaucucccaucccuccccaguaugaagaccaccugcuugcccauguuuggcuacaaacacgugcugacgcuaacugaccaggugacccgcuucaaugaggaagugaagaagcagagugugucacggaaccgagaugccccagaggguggcuuugaugccaucaugcaggcuacagucugugaugugaguuuggaggacuuggagugccagguguggcuggcauagaucaaaaugggaaaggaagugacugaacucuggggauuucugguguaaaaugagaugagaacuaagcagggcuuccugcaguuaugaguaguaaguugcuccugauauucagccuuggcuuagauccacucccuggccugagcugacauuucuuugaaccucaguggucucagauguucccaggggagagcaucuucccaucuucagaguuacuucagaguuaaggcugaguuaacuuaaccucagcaaaguaggcagauguucagaugagauuucuucuagcccagaucagcucuguggaugcacgucaguuucuagaugagcaaugugacugucauuagaagaguuaaguuuggaguuuaagaagaucucauucagcugcuugaacuaaucagcuaugagacuguuuucugaagagaaugaaacuccugaacuggaaagcuucagcuucgguuccaaggacugggacugagacccuuguuuugaagaaaaauaagcuguccagcccuuuagccagggagcaccuugggucucuguucucuaccagugacauggcugaauuuguuuugucuccucugccuuuguuuuuuguuuucuuuuaacaggaaaagauuggcuggaggaaugaugcaucccacuugcugguguuuaccacugaugccaagacucauauagcauuggacggaaggcuggcaggcauuguccagccuaaugacgggcagugucauguugguagugacaaucauuacucugccuccacuaccauggugagaucucuggcaccaccuaugguuucuauucaugauugugaggguugcccuaaucuaggcagagucugugugaauaugaaaauggcagccccuccuucugggcagggugcagggcucgguuccagcuugccccuaucccuuaccaacuggacaccgucauccagcauacaaccuauauaaccauuagagaugucccugauugugguguuaucacugccuucacugucaccagcauagcagcagcaucaugggauccagaauggacccaaaggauuuuuacaacccagcuggaaagcaggucuuccucuccacucugauuagcccuuucuuggaauaccauacuaacuugugguuauuggaagaagacagaggaaaaaaaagagaaagauuggccaggcauaugauggcucaugccuguaaucucagcacuuugggaggcugaggugggaggaucacgugaguccaggaguuugaaaccagcuugggaaauauagugagacccugccucuacaagaaaaugcaaaaauucguugaguguugugguuugugccuauggucccagcuacuuguggggcugaggcagaaagaucucuugagcccaguagucugaggcugcagugagcugugaucuugccacuacacuccagccugagugacagagcaagaaccaccccugcuuuuuuuuuuuuuuuuuuuuuuuuuuuuuuuugauacagagucuugcuuuguugcccagcuggagugcaguagugcaaucuuggcucacaagcuucaccaccucagucuccugaauagcugggaccacaggcaugcacuaccaugcccagcuaauuuuugaaaacagggucuuucuauguugcccaggcuggucucaaacuccuuggcuuaagcaaucugcccucuuaagccucccaaagugcugggauuacaggugugagccauugcuccuaguggagaccccuucucuuagaaagagagagagagagagagagagagagagagagagaaagaggggaaagaacauaaaaggcauggugaacagguccuacgaggaaagauuaaagggccagagucauuuagcuugaaagaaagaaggcuaaaggaugauuuagcuuauacaugagaaaacuucuuauaaguuguuuuauauggccauagaagguuaaacaagaggaaaauauuuaaauugaaucaggagaaauuacuauaagccauaagagaaaugugcuguaaugcucuagguaucuggggcaggugugaacucuucgucuccuaaggacaauauagcaacuuccucaucuaggugacuuaaagguguaccuguguaaaggcaggagacugagcugaggaucuaaugagcucccugcaaggucuaggaucccauggacauguucacgauucaccaccgcccccgcacaguguccuugaguuccuuggugucagccauauccaagucaagcacuaccagacaaugagucagcaacauuugaccccuaaucuaugcaaggcacugggccaggggcugagggagguaacaagacuauguaugguucuauccuuggggaguuuuuggucuacuugaggagaaaggauauauauauuuacaauaacacaagaugcaugauuagugccaaauggguguggcacagccaauguggcuauacguauccaagggaggaaaggucaucaugagcugggauggccaaggaagucuccugaagaaggugggggcuaagcuaggcccuaagaaaggaggaggauuaccaacaagaaggccacuccaggugggagacagugggccagaucacugcugaguggaagagggagagaggugagcaauauuuggaaagaaagacugagaccacacgguggaggaucacgagggccaggccaaggcauuugucaguaguuccaaaacagaggccuaacccagucccuugugcacggaagcagcuccauaguauuagugcauuaaauucaagcaggaagaaagaggugcuuaguuuugacaccacuggccuguaccucuucgucuaucccuggaguucacaaguagacuucugugcuacuuacccuucuuaucucacugucaccccccuuuuuuuuuuagagacagagucuugcucugcugcccaggcuggagugcaguggugcaaucauagcucacuguaaccuccaacuccugggcugaagugauccugccucagccuccccaguagcuaggacuauaggcacuuaccaccacaucuggcaaauaaaaaaaauuuuuuuguagagauggggucuugcuauguugcccaggcucuugucucacuuucagcaugaagugaaaugguuuaagcaccaccacacucugagccacagcccaagcaagauaaguucuaagcuuuagacccuagagauguacaugagacgucauuaaccucuacauccuucauuuuccuaggauuaucccucuuuggggcugaugacugagaagcuaucccagaaaaacaucaauuugaucuuugcagugacugaaaauguagucaaucucuaucaggugacugugccuucgggcuuccuggagugggcccugugauggugggugccccagguagccagccugugcuagcauuggauacaguccccaaucaggaaagagucuccccuaauccacuccccaggagcuaaagauugcacucugggccuuuuuccugcaaucuugaacuuacuagguauguguugguguuuguggugguggaggggagguggugaggggugugagagguuuccucuacuuuugcucagggcugaaaaacugcuagauauauuccuggcagugacaauugaaauaucccguaccuuccuccaaucuucaucucaggacucucagugggauuuggggagggcuuuuggagaccaccagcuuccuuugguaagcucuggacaucuuuguuuuccuuucuagaacuauagugagcucaucccagggaccacaguugggguucuguccauggauuccagcaauguccuccagcucauuguugaugcuuaugggguaagugucuugugcugggaauagucccgcggagaguccaccucauuuggcuuacacagcagggcucagauuugugagucccaguugccagucuaccacacggucuuacugccuucuccgugugcucccagagcccaggcaauggcccgcucuagaagggaugcagccuucugagaaggaaggaaggaaggaaggaagagagaaagaaggaaagaagauggggauggggauggugauuagauggagaaggagcagagcccuggaauugugggggcagagugagggaaaacugggcuccaauaacagggaaaagagagagcugagacauggggaaggugagguugaugaaacauuagguagaaaaugccacuuuccaaggugaccaguauuggcacuccccuuuugcaacaucugugaggccugcaggaggguguagcugguacauuuuacccagacucaccuagacgcaaguggagauggaaagagggagcagguuccugcgcaggaaacagaguccuaggggugcuccggcagcuuccaggucaaaccuuggccucuggcacugcuggggugaguccagagcuacuugccagauuuggcuugggauggaacuggcucuugccauuucccguuuccuuucaguucaauuucuugucuucuugugccccuuucugcucagaaaauccguucuaaaguagagcuggaagugcgugaccucccugaagaguugucucuauccuucaaugccaccugccucaacaaugaggucaucccuggccucaagucuuguaugggacucaagauuggagacacggugaggugggcugggcagggccuuuguccuggagcaucugugggcacccaacccccuuucuuccuuuuguagugacuaaaaauggcccccuuccaccagaaaaaaaauaugggcaagaaaaauacguuuccugaaagucauucuaaguuagauguaauggauccaccaaucuuuuccucugaggcuucuguugcguaagccauuucuguuacgugaacuucacucucaggaauuugaaaaacuuacaauuugguuaccuuuguuuguguaugcacaguugauugcaaaggaaaauauuucuuuaccuucagucccucaccagucgccagccuuuccaagguaauuaauaccuuucuuuuguaaaacgacacaagaaaguaaaaucuaaaauguaaaacacuccagucucuccacgacuuuccuuauuggucguuucuccuccgcuucugccuaaggggagagggguuggugggaggggaggaaggaggggaagaaaauagaucuuuggauacgcugauccuuucuauugaccuaucugucucucaggcacuugugcaaacaucccauguuagaaauauuguccugaaacaugcuuuauugcauaagcuaugaaaugugugggaacugaaguagauccugagcuuaugauugaccaccaugugggauuguguggugcaaaauagugcuuugugcaucuugcugauaauuauaaucaggccaaagcaggguguuuauaugaucacagguucuguucaguuugagcuggucuauuucauauguggagugaaaaaacagccuuuuauuauuuauugacuguaaaccaugucucugcauccagcuagauaugucacaacgauacuauucccgugcuuguguuuuugcuuugcagaccuucauauagggaaggcugaggaacuccagauugcaaaagcauaagacacccaauuuggguauuccuuggcagggcagggaacaacuuuuuuuuuccuccagagcuggaguguuaacugggcccaacugugucuaaauacaaucuuucuuuccauccaggugagcuucagcauugaggccaaggugcgaggcuguccccaggagaaggagaaguccuuuaccauaaagcccgugggcuucaaggacagccugaucguccaggucaccuuugauugugacugugccugccaggcccaagcugaaccuaauagccaucgcugcaacaauggcaaugggaccuuugagugugggguaugccguugugggccuggcuggcugggaucccagugugagugcucagaggaggacuaucgcccuucccagcaggacgaaugcagcccccgggagggucagcccgucugcagccagcggggcgagugccucuguggucaaugugucugccacagcagugacuuuggcaagaucacgggcaaguacugcgagugugacgacuucuccuguguccgcuacaagggggagaugugcucaggugaggagaacugcagggcccccuguccuggaacccacacccccucauauaccugcaaccacuggaaacauaggugaaggccugagaugggucuuugcaggcagagguguaagucagugguuccuaaucuuuuugaguauaaggaccaauccccuuuucacguuaaaaaaaaaaguuacugauagauggcaauuaaauuuuuagcauuuauagacuuagaaaacacaugucagaauauguaguaagguuaguaauaauuuuacaugaguuuaucuuuguaucacaagagaccgggaaaagaguaguauauaugcaagacauuggagugugcuugaacaaugucuggaaaaugguguaaugcucuuguuaauguuagcacuauuuuguuaaucacuguuacuacuauuggugcuacuguuauuuuuuggauucuagaucuuugcuauccaauaugguaggcuuuagccacauguggcuauuuaaauuaaccaaaauugaaaaauuaaaaauucaguucuucagcucaucaguggccacauguagcuaguggcugcuauauuggacagaucuagaacauuucaacgugauagaaaguucucuuggauagcacugccacagagagucccugcugacagauuggggauuauaauuuuaaguccuucuacucagcaggguacugaguuguccuucucauugcaaaauucaguaaaaucuugaggcccacugauaaucucaaacuaguuucuccuugccccaagaaccacuccugggguacuuucccagcuagaaguugaacuaauguuaauguagucuuuauccgcagacauguuggcaacacucucagagggcaaauagucuugaguuguuccuggggcacugaggauggguuuuuacugggccauaaucacuguggcuuaaucccucuugcgacagacacaaguugguugggacuggguuacggguguauuguguggccaaacagagagauuauaauuguuuucuggggaugacccuugacucagauuggcuucauuggcauugggguucuuuuuuuuuuuugagacggagucuugcucuaucgccaggcuggagugcaguggugcgauauuggcucacugcaaccucugccucccaguucaagcaauucuccugccucagccucccgaguaguugggacuauaggcaugcgccacgaugcccagcuaauuuugguauuuuuaguagagauggaguuucaccacauuggccaggauggucucgaucucuugaccucgugauccucccaccucggccucccaaagugcugggauuacaggcaugagccacugcgcccagccagcauuggggcucuaaucaguugagcuaauccaugcagauacucacuucgauacugauauuaaccuuuaaaaaagcucacuuagaaaggucgaucugugucuuucuaaagcaugucaguaacauaaaaaugacugcuuuuuuuauuaucuacgacauuguuuccuuuacucaugcugucaaaauuuuagagagaguuuggaaggaaguguuaucagaaugauuaggggagagcaagagaucagauacacacagaugaaagcacaaacagcaaccauuugaauuagggggugaggcaggaguuucacuucauuuuacuauuuaaaguauuuauaucuaauucaaaguaccaaaggaaauggguaaauuugaagugggagaccccugggaagaagguuggggacugagggagagaggguggucccaggagaggaguacggcuggaccacgggggcacccccaguccuccuccauggccugaugguuccuggucuggugugaggcacugcggcaggaucccagccagagcauguuucuuuuggcugcugccccacuaaagccacaaaacaaagcugacugggucagaagccccaguuccugccucucaccagugcaagaacagcuccuccucagugcauuccagucuaauccaugagggaaccagggcagccauugccgccucccucuaccaugucuugcuagggugucaggugcccacccagccucaggucuagacccuguggugccaucaucacauccuccagugacagauacucaggggcgcacaucauugagcacuugcucugugccaucauuugguccauaugagugaacaaggggucaugcaugaucccugaccucuccaagcuuaaagccccacucaccauugccccuugccagagcugcuggcucuaugcuucauucuuugcuauaagcaggggcucaggaggcagguguucugugacucggccauuucccuagcccauggccuguaagcauggcggcugguucccuggccauccccguuguccccucccuacuuugggccuggucuucaugguugcucaugaucaacauuccugccucaaacaucaagaagugcaucauccucaagggaguuuuccacuugccacagccacagaucagucaggcagcuucugugagccagauucugugcuguuguggaguaggauagagaggcgugaauaagacaguuaaccaaggauaauucccaacaugagguugaaucugacagauccaggaaguguggagugcucagggaauguuauaggaguccacuggagcgagacuugacuggggacaggguaggccuggguggcuucauggaggaggugggaugucugacagaucucagaggaggggcaggcucaggacagacaggaguggagcgagcaucagcccagaaggucuagcuguggggcucguguucccaaugaccuuaagcacccguuccucccucccuuuucuggcuccccucccuuucuccucuuccacucuucauuucuuacuuuacuccucugacuuuccgaugaacccggacucagccucccuuuugcuggaagggugccaguccugugacauuaccacacuguggcuaccuuuuaagggcuaacccuaccaaggcuuggggucagccugcuggcucugaccugucacuuccacucccaaccucacucccuggcuggcccaucuugucaaagaucacuuuguuuagccucacaaaggaaacacuaugggacaagaguuucugaggaggcggaggccucugagugcugccaggccccuguggugucggucuuucccauccaggagccguggccaaaugcaggguguagugaaaggccggggggcgggugggggggcagcucugcuggcuggcgcacuccucccccagcugcugugagguuggccgauagcagcucacagcugccccuucugugaagaacugcccucggcugacaggagcugucuugccccuagauguuggccaaugacugauggagaagggguuacucaaggcuagacucuucgccucagggugggccuggcuuuguggugccauucacguaggaucaggcuggagggcaucuggcugagaccacauuccugccagcucugccucuugccauguccuguuucccucccuccucucuacauccucagcgagucccuuaaauaagauccucauccaagcuguacuucuagggaaccuagccucgggacacagccuuucugcuuuccccacccuucuggcagcccaacaucucuacuuuccagauauacuuggcagcuggggcagcuuggguuauguccgccauccuuccugggaagcagacauuucuuuccaugcccagcccauagugcaguggcaugaucauggcucacugcagccuugaacuccugggcucaagugauccuucugccuuagucuccgaaguagcuaggacuacaggcucuugccaucaugcccggauaauuuuuuaaaaauuuguagagacgggaucucgcuauguugcccaggcuagucuugaacuccugggcucaagugaucaaucugccucggccucccagaguguugagguuacaggcaugagccaccaugcuuggccuuugaagguuuuuaagcaggugaguuacaugaucaaguugacucauacuuuaaaacggugguucucaacugggaggaaggagcuauuuugucucccagggcacauuuggcaaugucuggugauauuuuugauuguuauaacuggaaaggugcuacugaugucuagaggguggagcucaaggaugcugcuaaacauccuaauguacaggacaguccuccccaacaaaaaauuaucuggccccaaauauugaaaaguaccaagguugagaaaucacauuuuacaaagagaauccuggccacagaggaauugacaaucaccuggagaaggggagaugacuuacuuaucuagagacaggaccaggcugaggacagggcauggaaauaucuacagugaggcccauccacccuucgcuuaaauaguucagaacauuugacuccuaaaauguuccuuccuugaaauuucucauugagaucaagccuaguuacuggacuuuccauaacuucuuucuuacuacuuuggucucuuuucuuccuccacuggucaauuugaagaauauuccauuaaaacuggcuccaucuucuguugguuaaggccauuuucucuguaaguuagagacaucuucuggaaagaccauauuaguauaaauagggaaaagcauugcuuaugacacugcauagaggcuaagcacuugggaucugaagucacagugacuucaguuugaguccugacccugccauuuacaaggcauauggccuugggaaaguuacuuaaccucucugaccucaaaggguuguuauaacaaaugaaaaggauaacauacuaaagaacuugcggcugggcaugguggaccagcuggccgggccuguagucacagcucuuucggagggcaaggcacauggaucaccugaggucaggaguucaaggucaggcuggccaacauggugagaccccaucucuacuaaaaauacaaacauuagccgggcaugguggugcaugccuguaguccuggcuacuugggaggcugaggcaggagaaucgcuugaacacgggagguggggguuuacagugagucaagauggcaccacugcacuccagccugggugacagugagacucucaaaaaaaaaagaaagaacuuggcacaagcccacaagccuaggcaauauaacaagacucccaucuguacaaaaacaaaaauaauuagccagcugcaguggcacaugccuguagucccagcuacucaggaggcuaaggugggaagaucacuugagcccaggaguuugaaguuacagugagcaaugauugcaccacugcacuguagccugggugauagggugagacucugucucaaaaaaaaaaaaaaaagcaaauaaauaaaaagaaaaagaacuuggcacaguacuugacacauauuaaaugccuccuugguugguuuggaaaguagauacacauucucuucucuaaaugcuuuccaagucuguuccacugcacucccagauaugauaugaugaggucagauugagaagggaaccaggucaagaaagacagguuguguuggugaacuugaacugcgccuguaacuuuaaauaauuaauuaauuaaaaaaauguugaauuguggcaaacauuucuccaccuguugagugcagaggcaggaaccaggaugagucaacaggggcaugggggaggccaucgggcuacgugaggucauuacuagugauugucucuacugcuguucaccuuaggaaaaucucucuuuuuuucauuuaauuucucuuauuuucugacuucuuuucucuauggcauucaugggauuuguuuaacugcacuggcccucggcagucugggagguaggggauauuuguucucucugcuuacuuggcuccguuggccaacuccauggguucucagugccgucccucugccccuuggaugccccaccccaucuacccauacauucagggugcucugugugcacuuucccucucugcauuuggaauaaccccaugcccuggaucucuccuuuccuucuuucccuaugcuacaauuuuccugucuugugcaugugcccucagagcccugcuucucauccugcaagguaacaccuagcugauuugagaaauggaagugguggcugcuuuguuagugggacgggaccagcucuuccaaacuggacccuauguuguugucuaacccaacuggguggccacgaugacgacaaugguaguaggccucucaggucagguaggagaggcgagcagcgcugugucaggucaaagggagagaguuuuggggccugugaggccuuuugccaucaucaagucacaccgucaaggcuacugagugcccuguguagguucagggcuguggcuuugugcugugucagccaaacuagaagggcuaaagagcuugcuucuaguucuuagacuagaaggaacuaagucuucuaagccuccuacccuuucucuugccuuucucagaaggcagagguauucagaaaagggcaagagagagggcaagaggcccaggagacuuaguuccugagaaucuuuugcucuacaguggcuccgagcaaguccugccauaccuugggaccccuagaaaacugaguuugucccugcuggguaggacuccccuggguggugagccaauucccugccaaccuggaggaucauuaucugugugguugggagagcaggauggucguguguagccugcugccaugggaguggagcucucgccagcggguccaccuuccugggcuguguguuuucaggccauggccagugcagcuguggggacugccugugugacuccgacuggaccggcuacuacugcaacuguaccacgcguacugacaccugcauguccagcaaugggcugcugugcagcggccgcggcaagugugaauguggcagcugugucuguauccagccgggcuccuauggggacaccugugagaagugccccaccugcccagaugccugcaccuuuaagaagugaguguggagucuggagagagccgggaggcugggagguaggagaggauccccugacuagaauccccagcucuccagguguguuucuugcucaccagagccuuagggagaggaguccacuccagccagauggcugucucuccuuuugccaaaggcuuugggcaaguuggaauagagccaacugugaaggagccaaaguugaacgagcuggacuucgauugagaauguccucuccuagggugacauccugacucccucugagcugggaggaaggcuaaaccagucugaggaacaauccagugcuaauguucugauucagugggagaugugagggcuggaauuauggaggacacucugugaaacuacuacaaaccucccacuuuaggggccagaggaagccccaucagccugaguccauggcacugccauucugcuuaccacuuuaagcagggccagauuuacgagugugcaaccuaugcagcuguauagggcccugugccuacaagggccucaugcuuguuuuaaugcucugccaucacugucuugacauucuuaguaaucuuugaacaagggagcugacauuuucauuuugcacugggcccccaaaugacaugacugguucugacuuuauaguucucagaaauggcauaggguucaccauccuggcacagcccuggaugggacgggaaguuuaaugaaggaccugggaggcuucuggcugccaggugcugccuacaggugagggggacacucccaccccugaacuccacacuugccauucagguccccaggauugucuuacaggcgcgcgcgcgcguguguguguguguguguguguuuuaauggagguggagcagcuuucugaaugcauggagaucagagcuggacugggauacgcuuaggcuugcuccuucuuugccuuaaucacuguguccucucuccuucagagaauguguggaguguaagaaguuugaccggggagcccuacaugacgaaaauaccugcaaccguuacugccgugacgagauugagucagugaaagagcuuaguaaguucagcacaucuuagaguugcacacacccagguucuaaauguuucuaauucaaucccagaaccuauccaacucccaccuguaaaauggaagcgugacuucuaccucagggaauguugugcaggcuugaggaacaauggacacuugaugugagcuggugucucugagaguuguccuccucucuuacuagugugugcagccauccaccacuucugcuucccagagcccacagacucagcaagagccugcaaagcaaagggagcaagugccucccuaaggaagggaagagaauguaucccauuuuacagaugaaaaaacugaggcacagagcugggaagugguugccugugauagucaucaucuuagcucaguaggcuaguaagcguuuaccaaguuuacuuaacuaaaaguguuaugcagugcccaagauuuugcuuaaagcuuugcaguuuggagggaaaccuucaaccuuauggauaggcaaccaaaagcuuuaucugaaguccuucugccucucuggggccccuuuugaaauaagacagacagaaauacaaacaauagggagaaaaaaaaucuugccugcaauuauucuugaaguauucucuguccuucaucuuaacuuaaaaggagaugaucuuugcugcugucaucacaucugauauaguuaugugggccagcgaggcauugagaugguacucuaguacuagagagauggcaaucucuccauagauagcaaucucccaugaaggcagaaacacauuucagagagagccacaguaagacacagccagccagucagcuuccuggugggcguguuauagaaaagagucagcucucugggccuuuuggcuaauaucagaaguagggcuggggugagguuagcgauuuggggauugaguuugaagaaacaguuuuuccucuggaggagauuaggcuugcuaugauuaguucagagaggagaggcugcugagauauuauuuuuaccaucuacacuagguggguauuacaggcuaauugauaagcaguucuguaccuccaccuccccucuaccugugguauuauaguacagggaaaagaguguggaaauaagcauauuaaaauaaaugcuuauuuauagggaauuuuauagcuuguaaaaguuauaaaguaucuuucauauacauuaucuuauuuuucugucaauagccuagugaaguagaacuacaguacuauucucaucuucauuuugagucucaggaaaguuaaguaacuggcccaagcaagggaauggcaaauuaagauaagaacuagguccugaaauccguacucuuuucccuguauuauaauaccacugguuuucugaaggguuguugaguucaagucugcaagaugugcuuugagacuccuguucuuguucugcuucaucacucauuugcugugugaccuggguacauuugcuuaauuucaucaugugucaguuuuacucaucugguuucaucaguauggggcacagugcagcuaguggaggguaaccccuaguaucuuugcagaauaacaaacuuuagaauuagaagagaugaagucuacaaaacacggugggagucagagaagagaggauagcucuggggagguauacuggaucagaaacagaaauggaagaaauagaacagcugcauaagcaaacuauuaagaaucacuaagcaagcagagaaaggaaagagagggaagaguacaccuacuauauguuaggcacuguucacuuuaugcuguuuaguucaccgaccuugugagguggggguaucauuuucuuuuuauagaugaagaaagacuugaugaggucagguaacuuacccaagaucacacaacggguagguagugaagccaggauuugaauuaaauuguguaauacuguuauaucaugucccuuucagaggaaggauuaggaaccaaaaagggccuaugcaguacaaaauacaucagugagugucagugaguggcaacugccagacacaacagccaccuugaaucuaggcaucgugcacaugaggcacaggguuuccugucacauacuucccuggaaguccugugauagggguuuggaguggucccaucuuccaguaguugucucacuuuuuauuccuccauuuucccuacucccagaggacacuggcaaggaugcagugaauuguaccuauaagaaugaggaugacugugucgucagauuccaguacuaugaagauucuaguggaaaguccauccuguaugugguagaagagccaggugagugaacccugacggcucccggcccugccccaggagggagagggagaaccauguuaggcaggaaucucuacucaucgaagcuguuaagcaaaacagguuaagccugcaagugauaaguuaggggccagguguggugguuaacaccuguaaucccagcaguuuggaaggccaugguggguggaucgucuggggucaggaguucaauaccagccuggccaacauggugaaacccugucucuacuaaaaauacaaaaacauuagccgggcaugguggugcaugccuguaauuccagcuccuugggaggcugaggcaggagacucacuugaacccgggaggcacagguugcagugagcugagaucgcgccacugcacuccagcuugggcaacagagugagacucugucucaaaaaaacaaacaaacaacaacaacaacaaaaaaaaacgauaaguuagggaccgucaucugggugaagggcauuuauaaauacaaauauuaucaagaaagugacuuguuaauugaggagacaggaaaaucagaaagcagguaaggagaagaagauagauauggaucucauuaauggacaaaauauaucacgcauuuuuuugaggcaaugaugucaagaaauaaagaauuuaaauuuuaggacuuuacagcacauggcaucugcacuauuaaaauugagaugguugccaagagcaacuugacugugcuucagaggaaggccugaugguuagagguguuaccuuuccaaguuuacugcaggauguagggauagguuugaggcacuaaggcaaggcugcccugaacacugaaaguacagugccuucugggagcaggaggaauccaucccaucauacacagaccagccacagguuugucaccaaccaaugcugucgaucgcuugcuucccuuuaacaccuucauggccuuuguucuccuuaaacaacagguuaagaugaauuauuagaaaacauuuuugaguauucacugccaguagaccccuucccccacauuaggagaacagaccccagauccauagacccacguuuccuaucuuuuuuuuugagauagggucucauuuuguugcccagguuggggugcaguggugcgaccuuggcucacugcagucucaaccucuucggcucacacaauccucccaucccagccucccugggacuacaggcguacacuaccacaccuggcuacuuuuuaauuuuuauuuuuuuguagagaugaagucucacuauguugcccuggcuagucucaaaacucugggacucaagugauccccccgccucagccccccgcaaaguguugggauuacaggugugagccaacacacagggccaacauuuccuauguuguugcucuggaauucuaggcuccgccucccugcucaucucccagcuccaaucauuuccuggcuuugaguagaauguugcagcuggggccucagacagugggggagaugauucucuuucucuuccccaacucaugcucuugcagaugcucucuuugaagggcuaagccacuauagggcaguaaagacaacacugccaaaaguuuuggcauuggccaaauggaauuuaaccacauggaaugggcucuugagcugggcucuuaucacucccagaugggguuaccaaauaaaauacacuaggucccaugcaguauuugguacacaaugauaguaaaaaauaaucauuuaucugaaauucagauuugucuuggcuuccugcuuuuuuuguuuuguuuuuguuuuuguuuuuguuuuuguuuugagacagagucuugcucuguugcccaggguggaguacagcggcgugaucuuggcucacugcaaucucugccucccagguucaagcaauucuccugccucagccuccugaguagcugggauuacaggcgcccaccaccacaccugacuaacuuuuguauuuuuaguagagacaggguuucaccauguuggccaggcuggucuugaacuccugacuucaagugaucuggcugccuuggccuccugaagugcugggauuccaggugugagccacugcaccuggccaagcauccuguguuuuuguuugcugaaucugccaacccuacccagacuucucugaccuugggucauuugccauugguccaccgcuguggcuggaagggcccuccagaggucaccugaucuugccuucugcuuccaggaaacccaccccaaacuccuuucaggacacaugguuaacagauuguuuuccccuaaagaccuccuggcacccuaccugcccugcccauacuaaugugcagaauuaaagagauuuuacuuugauaauugagggucagcccuacccaaaucuuccagagaauccauaauuguuuuucccagaacuggggcccuucacucuugggaacuugaacacuggaaccucacagccucucuccaggcacucauuuaauuauagacagguuguaauuuggcggguugggagauagccagcuugaguuaugguggugguuguuuuugugguguguguggugagcauuggguauauguuuggcgaagaaggugggagacaguguggaaagugggugugacuuccucuccaggcucauuagcacccucauauauaaacaccugguuucauaacacuugagguuacuggaauaagaucaccuauuagauaccugacauuugugggaagcagagcucugcagaguauacucagccugacccccagaggggugacaugccucuguuuuaguuguugacugggguugaacaggaaggcagcuuucaauaggguuaugauuuuagaugacuaaguauuuugggaaagaacccaaaauauugucuuggcuggcagguccuggucucuaagaaugcaaaaaaugucauuagguucacagcccucaggaauguaaauaucugaaccaggauaacagacacaaauacuuacaguggcuaaggaagcaaauaaguuagugaaaacagcuggguguaagaagauccguuacaacgguagcugauauuuacugagcacuuacucugugccaggcauuguucugaguuuuuaagauauauuuaauuuaaucauuccucauaacaaguuucuuuuaaagucagugcuauuacuaucuucauuuuaaagauggagaaacaggaaacagacauucagaaagguuaaguaauuuuccaaagaucauguauaaaaguuaagugauaagucaggauucaaacccagggagucuggcuguaacauccacaggagcgcagacacaccaacaagucacacugccuuccucuaggagagagaagggagagugguggggauucugguaaacuagaaaacaugaguuccaacuaaaaggagcagcuccuccucagcucuagcuaacugcugcucugcaggaauauaagaaucucucucuuucuguauuucucucuuucuuucuuuugagauagucucucccucugucauccaggcuggagagcaguggcacgaucauggcucacuaugaccuugaccucccaggcucaaacgauccucccaccucagcauccugaguagcugggacuacaggcauaugccacaaugccuggcuaauuaaaaaagacaauuuuguagaggcagagccucacuauguugcccaggcuggucuugaacuucuggacucaagcuguccuccugccucggccucccaagugcuggcauuauaggcaugagccacugggccuggccuggauuuucuuuuuaaagagacuaauaugaaauuuuagggggagaaucuccugauuauucaauauugccaauaaagucaauuuuuuauuucuuauucauuuauuuauuuauuuauuuauuuugagauggaguuuugcucuguuacccaggcuggaguguaauggugugaucucgguucacugcaaccucuaccucccagguucaagugauucugugcuucagccucccaaguagcugggauuacaggugcucgccaccaugcuaggcuaauuuuuguaguuuuaguagagaugggguuucaccauguuggccaggcuggucucaaacuccugaccucaggugcucugcccaccuuggccucccaaagugcugggauuacaggugugagccaccacacucggcuuuuuauuuuuaauuuuuuaaaaaacuuuuauuuuugcuuuagggguacauguguggguuuguuccguagauaaacugugagucaugggggucugguguaccuauuauuucaucacccagguaauaagcauagugacucauagguaguuuuucgauccccaccuccuccccgucuccacccucaaguaggucccagugucugguguucucuucuuuguguuuaauuuuuaaaauaaacacuugggugaacccccacacaaagguguggcuggguucugucuagggguuaccaggucuagacuucugauuugagccacucagugcagauuauugcuguccuaaugauugucuccuuaaaaaaauuaauuuuugaaaacuguccuauuuccuucaaggaccuuaguuacuuugucaagaacaccuuuuucauagccaguucaagugacuccugcuucauucacaaccgcccugcucugugcuucuuccucacagagugucccaagggcccugacauccuggugguccugcucucagugaugggggccauucugcucauuggccuugccgcccugcucaucuggaaacuccucaucaccauccacgaccgaaaagaauucgcuaaauuugaggaagaacgcgccagagcaaaaugggacacaguaagagacggggcugggcguuuucuaaagucauuggucugagacucuuaaguggaagcagcagaugcuuuggguggucauguucagccaguaccaucgucuuuccauuauccucuguucuggaaacugggagagauggucucacuauccccuuguccuucagcuuccuucagccucuuagaaauaguggcaggaugucauuccaucucauucucuucuuucuccucaaauaaaugguuacuuccaggcugggccugguggcgcgugccuguaaucccagcacuuugagaggccaaggugggcagaucacuugagcucaagaguucgagaccagccugggcaacauggugaaaccccgucucuauuaauaauauaaaaauuagccgggugugguggugcaugccuguaaucccagcuauucgggaggcugaagcaggaggauugcuugaacccaguagguagagguuguagugagcugagauugcacccugcucugggugacagagcaggacucggucucaaaaauaauaauaauaauaauaauaauaauaaaauaaaauaaaagguuacuuccaaaucagacucuacucuuuuauccugauuuauuccaauuaaauaagcauuuacugagaacuuucuauauacuuaaucuuacucuauucucuuuuggcucuucuuucacauuucaacuuuuuuccucgacccuccaaauggcuauuugacuccccaaauguccagaguuaggcugcaaguuuguucccauuugauguugaccccagagcuuuauacucaagggucccaagaaacugagauguuucuguuagaacaguguggaacauccuguaccuaugaggcccacaggaauguguuucuuucucuuuuuuuuuggagacagagucuugcucugucacccaggcuugaguguagcgaucuuggcucacugcaaccuuggccucucagguucaagugauucuccugccucagccucccaaguaacuggauuacaggcgccagccacugugcccagcuauuuuuuguauuuuuaguagcgacgggguuucaccauguuggccaggcuggucucgaacuccugaccucgugaucacccgccucggccucccaaagugcuaggauuccaggcgugagccacugcgccuggcuaagaauguguuucuugaagcuaccauuauaggauuuguuacuuucuguuggaaaauaguuugggaaaccuagugagggucuuacuuuuuccugauaacaugacaguuuguggauagugcuuucucuuucucuccccuccucucccauucccuccccuccccuccccucuccuccccuccccuuccuuuuacgcuuccuccccuccccuucccuuccuccccuccucuccuuuucuuucccuucccuucccuccuuccuucuuuuuuugagacagggucucgcucugucacccaugcuggagugcaguggugccaucauggcucaaugcagccuccaucuccugggcucaagugauccucccaccucacccucccaaguagccaggacuacaggcacacaucaccgagccagcuaauuuuuguauuuuuuucccuuguagagacagggucucacucuguuacccaggcuggucuagaacuccugggcucaagugaucuuccuaccuuggccccuaaaagugcugggauuauaggcauaaaccaccaugccuggccaugguuagugcuuggccagauuagaugaaaacaaauuaauaauuauuugagcaaaagcuuuccucuguguucugaauugcaccugauacauuucugucccuuguccacaucuccuaucacugucacagggaauggaaaauaggagaagggcaaaagagacggggacacaggggugaaauaggagagguucuauccccgaaugcuguggaaucacugaagagugauaggcugaauauagcuccuuagaaauaguggcagggaacaggugugguggcucaugccuguaauuccagcacuuugggaggcugaggcagguggaucgcuugagcucaggaguuugagaccagccugggcaacaugaagaaaccccaucucuacaaaaaaaugcaaaaauuagccagacaugguggugugugccuguagucccagcuacuugggaggcugaggugggaggaugucuugagucaggggagguggagguuucaguaagccgagauugugccacugcacuccagccugggcaacaaaaugagacccugucugaaaaaaaaaaaaaaaaaaagaaacgguggcaggauggcauucuaccucaucuccuccuguuauuuccuaucaauucccaugccaagaacuaaagugugagcaaaaugaacauuauucuguuucauugaugauguauuccagagaacggugccuugggaaaacuucugagaugaauuuuaaacauucaggguagggaaggacuuaaggaagucacuguaagaugcuauucuguuuccuccacaggccaacaacccacuguauaaagaggccacgucuaccuucaccaauaucacguaccggggcacuuaaugauaagcagucauccucagaucauuaucagccugugccacgauugcaggagucccugccaucauguuuacagaggacaguauuuguggggagggauuuggggcucagagugggguagguugggagaaugucaguauguggaagugugggucuguguguguguaugugggggucuguguguuuauguguguguguugugugugggaguguguaauuuaaaauugugauguguccugauaagcugagcuccuuagccuuugucccagaaugccuccugcagggauucuuccugcuuagcuugagggugacuauggagcugagcagguguucuucauuaccucagugagaagccagcuuuccucaucaggccauugucccugaagagaagggcagggcugaggccucucauuccagaggaagggacaccaagccuuggcucuacccugaguucauaaauuuaugguucucaggccugacucucagcagcuaugguaggaacugcugggcuuggcagcccgggucaucuguaccucugccuccuuuccccucccucaggccgaaggaggagucagggagagcugaacuauuagagcugccugugccuuuugccauccccucaacccagcuaugguucucucgcaagggaaguccuugcaagcuaauucuuugaccuguugggagugaggaugucugggccacucaggggucauucauggccugggggauguaccagcaucucccaguucauaaucacaacccuucagauuugccuuauuggcagcucuacucuggagguuuguuuagaagaagugugucacccuuaggccagcaccaucucuuuaccuccuaauuccacacccucacugcuguagacauuugcuaugagcuggggaugucucucaugaccaaaugcuuuuccucaaagggagagagugcuauuguagagccagaggucuggcccuaugcuuccggccuccugucccucauccauagcaccuccacauaccuggcccugugccuuggugugcuguauccauccauggggcugauuguauuuaccuucuaccucuuggcugccuugugaaggaauuauucccaugaguuggcugggaauaagugccaggauggaaugaugggucaguuguaucagcacguguggccuguucuucuauggguuggacaaccucauuuuaacucagucuuuaaucugagaggccacagugcaauuuuauuuuauuuuucucaugaugagguuuucuuaacuuaaaagaacauguauauaaacaugcuugcauuauauuuguaaauuuaugugauggcaaagaaggagagcauaggaaaccacacagacuugggcaggguacagacacucccacuuggcaucauucacagcaagucacuggccaguggcuggaucugugaggggcucucucaugauagaaggcuauggggauagauguguggacacauuggaccuuuccugaggaagagggacuguucuuuugucccagaaaagcaguggcuccauugguguugacauacauccaacauuaaaagccacccccaaaugcccaagaaaaaaagaaagacuuaucaacauuuguuccaugagcagaaaacuggagcucuggccucaguguuacagcuaaauaaucuuuaauuaaggcaagucacuuucuucuucuuaaagcuguuuucuaguuugagaaaugaugggauuuuagcagccagucuugaaggucucuuucaguaucaacauucuaagaugcugggacuuacugugucaucaaaugugcgguuaagauucucugggauauugauacuguuuguguuuuuaguugggagaucugagagaccuggcuuuggcaagagcagaugucauuccauaucaccuuucucaaugaaagucucauucuauccucucuccaaacccguuuuccaacauuuguuaauaguuacgucucuccugauguagcacuuaagcuucauuuaguuauuauuucuuucuucacuuugcacacauuugcauccacauauuagggaagaggaauccauaaguagcugaaauaucuauucuguauuauuguguuaacauugagaauaagccuuggaauuagauauggggcaaugacugagcccugucucacccauggauuacuccuuacuguagggaauggcaguaugguagagggauaaauagggggcggggagggauagucauggauccaagaaguccuuagaaauaguggcagggaacagguguggaagcucaugccuguaauuauaaccuucagcuacuaagacaggugugguggcucacgccugugauuauaaucuucaguuacuaagacagaguccaugagaguguuaaugggacauuuucuuuagauaagauguuuuauaugaagaaacuguaucaaagggggaagaaaauguauuuaacaggugaaucaaaucaggaaucuugucugagcuacuggaaugaaguucacaggucuugaagaccaauauuauuugucaauauguggggauaaccuguagcugcauucaugagguagcaaauagcaguuuuggccuguggggugaacagcuaaacaguguucuggcaucagauaacacggcacaaagggauugugucuagcucuuuuggagaaaauuuauguccagucucaggaucuguggacaauaacggaaaacuuugaauauuccugacaaguugccauauuaggagucaguucuuuacuucucugagauucccaggucauccaugauuuuuuuuuuaauuugagacaaagccucacucuuguugcccaagcuggaaugcaauggcaagaucucaguucacugcaaucucugccucucagguucaagccauucuccugccucagccuccccaguagccgggauuacaggcacccgccaccacacccggcuaauuuuuguauuuuuaguagagacgggguuucaccauguuggccaggcuggucucgaacuccugaccuuaggcgauccaccuuccucggccucccacagugcugggauuacaagugugaagcacugugcccggccagucauccaugauuuuaaugggguccaaaggccucuuuuucuuuguuaaguauuccugguugaaauuucuuuucuuuuuuuuuuuuuuuuugagacagagucuugcucuaucacccaggcuggagugcaguggcacgaucucugcucacugcaagcuucgccucccggguucacgccauucuccugccucagccucccgaguagcugggauuacaggcaccugccaccacgcccggcuaauuucuuuuuguauuuuuaguagagacgggguuucacgguguuagccaggaaggucucgaucuccugaccucgugauccucccgccucggccucccaaagugcugggauuacaggcgugagccacugcccccggcugugguugaaauuucuuaagugccuuccucacuuccuaaccaccuucucuguuuggguuugugcaacaguaaauuaaauguacuuuccaaa

SEQ ID NO: 21498 - RNA, 8036 nt, Homo sapiens
accucauucauuucuaccggucucuaguagugcagcuucggcuggugucaucgguguccuuccuccgcugccgcccccgcaaggcuucgccgucaucgaggccauuuccagcgacuugucgcacgcuuuucuauauacuucguuccccgccaaccgcaaccauugacgccaugucggguuauucgagugaccgagaccgcggccgggaccgagggugaguuugggagccgagcugucaggccuggcggguggggggaugggagggcgggucaggguggcggccggcgggggcuuugcggcuuggacuuggccuuuccgggcuaucuugggacuuccuuucccgaaggcuugcgccauuuugauauucacgucacagugauuggaagagauuugacgguguagugucuucaagcuugcuuuuuguguggggauuggggagcugucggggcggcugccauuugguagcuguugagggaguugagagggagcguauugugcggaugaaagcgggacgcuucgaggcagacgaaggaacaucuguuaggugcggcguuucgggagguguuuuugggguggccgggcauucugugggagcgaggggaccacuuccaaagcccuggugcuguugggguaggagggcggccggcaucagccauguggcugagucgcgaguacaaaaugccggccucggacauggcggcggcgccuuuguuaccccgcccggcggaggagcucaaaauggcagcgucgagaaaauguggcgcagagagaaaugcgagacaaagggggaagcgccgccccagcgggaacgccgcccggccgacuccgcccgggccgggacuccucccccgguagucgccggcuccuccuuuucuuuuuuccugcguuauauaauuuugauucguugauccggagcucuaccgcggcguucccccagcuggguuugcuagcagaaguguuucugagaaaacccuuguucuguuaucgcugacuguacuguuuagguucuuaccacuaaagcuguuugguuccaaaacggccauaugaguaacaucgucgugaugcucuucgguucauguagccuuguuauugcugauagugaauugcuaggcugguggggaagauuacaguaaccacaagaaguggugugugccagaaucccaaauucuggcaugugggugacaaguuuccgacaugauaaauccccggcuuccgacaugauaaaucccaggcuguuuacaugaccuaaguaauguguacuugggacuacgggaaauguuaacuguggcuguugagagagagagagauuuucacgaaggacagugcuagguuuaccucucgaagucuguuuucagugguuuuuagcuugugccaauggaugacaaaucuauacagaaaccuggguauagccauuugaaaaugugaauaacguuuuuuuucauuccagguuuggugcaccucgauuuggaggaaguagggcagggcccuuaucuggaaagaaguuuggaaacccuggggagaaauuaguuaaaaagaaguggaaucuugaugagcugccuaaauuugagaagaauuuuuaucaagagcacccugauuuggcuaggcgcacagcagugaguaaauucauguggcuucaucaggcuguaacucgaucguggauucuaguaaaugaaauucugacagguguuuugcaaauaacucaauuuugguagaguuacauguucugacuucauaauugggaaaggugugacucacuuuuggauauagguggcuuugggauuuuuacuuaaauuagguugaguauaacaauaaauuuuuuuuuucauaauaggguguucauagguggguccagauuaaaaugaaggcuacuuuaaacuaguuacuaaauuaugaaguuaggggcuuaucaauuacguauuuagcuaggggugguugucaugaauuuuaagacuguuauaauuuguuuugcagcaagagguggaaacauacagaagaagcaaggaaauuacaguuagaggucacaacugcccgaagccaguucuaaauuuuuaugaagccaauuucccugguaagugcuacuuuucaguucuaccuacccguguuuuuguuuccaccuacccccucuuuuucuuggcaucacuaauuuuuacuaaauaucuguuacuaauuauagcaaaugucauggauguuauugcaagacagaauuucacugaacccacugcuauucaagcucagggauggccaguugcucuaaguggauuggauaugguuggaguggcacagacuggaucugggaaaacauugucuguaaguuugggagaacucuugaguugaucugauauaugcaagaaaauguaaugguaauuuaaaaacgaguauuuuaaugugauuucuguuuguccccacuuucacccuaaauaguauuugcuuccugccauuguccacaucaaucaucagccauuccuagagagaggcgaugggccuauuguaaguauauauuuuuaacuuuuuauuagaagcauaauguguagauuuuagacuacauagcuaaagauguaaucauuuguggugguuuuauauagagguuagcucacccuauucagcuggagcuguuuuggguauuggacaacacaugaagaaaggaucugcuaguauaauaaguuagcaguuuaaaacuaguauccagguuugugcugaaagcuguuucucuuuccuuaguguuuggugcuggcaccaacucgggaacuggcccaacaggugcagcaaguagcugcugaauauuguagagcaugucgcuugaagucuacuuguaucuacgguggugcuccuaagggaccacaaauacgugauuuggagagagguauguaaugaaaaggguuuuauuugucauuggugcuaaauauccuagguauuguaguuacacuuacguauuuaauuaaagguguggaaaucuguauugcaacaccuggaagacugauugacuuuuuagaguguggaaaaaccaaucugagaagaacaaccuaccuuguccuugaugaagcagauagaaugcuugauaugggcuuugaaccccaaauaaggaagauuguggaucaaauaagaguaaguguccuuugaaauaugugaucaaacugaauuguguuuucacucuuaagagucugauacuaauuuuuccccccaaaauccauuagccugauaggcaaacucuaauguggagugcgacuuggccaaaagaaguaagacagcuugcugaagauuuccugaaagacuauauucauauaaacauuggugcacuugaacugagugcaaaccacaacauucuucagauuguggaugugugucaugacguagaaaaggaugaaaaguaaguuuuauuaacucuguuauauuugcuuccuaacaacuuugcuguaaaauugagggaucauuguuuggugaguuguuuuagguuauuucaguuggugugauuucauuuaguuagccuacuaauccugaaaauuucuugaauccuucaaauaauggcugucaccauuuauagcuuuccuauagaaggaauucauguguccccugguugacuuaaggaccaagggucgaacugcucgauaaguggauuagcaggcguuuccucuuugacuuccagccauguaaauugaacuuaauguuuugcugaccauaaauguguggcccuagcaauggucuuuuaaaacucaggauuuuuccuuucucucuccuauuauuagacuuauucgucuaauggaagagaucaugagugagaaggagaauaaaaccauuguuuuuguggaaaccaaaagaagaugugaugagcuuaccagaaaaaugaggagagauggguaugugugagcuccuccauugaagcagauugauuaaaacagcuuaggaaagggcaaacuuggaucacgagcaguggauuuuuuucauaucugauagugaauuuaacuuuuucauuucuggcgaaauuaaagagaucugugaccaaaaguggucaagcacuggagucugagguuuucaaugugaguuuaauaacacaacuugucuuuuaacuuagguggccugccauggguauccauggugacaagagucaacaagagcgugacuggguucuaaaugguaaauauuucaaaugaaguauuuuucccccuuacuuaaccuagcuagaauucugcucagauaauugaucauguauaugccuuccuuuguagaauucaaacauggaaaagcuccuauucugauugcuacagauguggccuccagagggcuagguuaguacaaacucgcauucauggcuugguuucccagaagaucuccauuuaacuuuuuuaaagaaaguuuauugcuuucuuuaaccugcauuuuuucuaaguuuuuuuucacauaaaggugcugucuuuguggcaaggccuaggcaugacaaucggaggacucgagggggauggaggacuagugaucggcuggcugcuuccagucgauuagagaggugaaaaagcugaacgugugccaguaaucuucaaaaggcagaacauaucaccucugccccguaaacuguucucuccgagggaaaaaauggaaguuauccucacaguucacugccgugguauuucuucugucccaugcuuugcaugacugccaugguacagccuuguuucaaacuguucacugugaucugugggucuuugaguuucagugaguuugcugaaaugucgaagaaguaguuccaaacuucaauguucaaugaaauuuuuguucaaguuugaaauggagagagcagcuuuaaaagguacuaagccuuuuacaaauuggugaguacuggcacaugagaucuagagcaggagcaacuucucacacauaguaagugggaaaagaaagugcuuugaaaguuccucccucaccuacacaguagucgucaugucgagaccugccagagagagacacauucucaagugaauccuggcuucuuggaagcgcuugccuagacgagacacagugcauaaaaacaacuuuugggggacagguauguuuucuugcagcugcgguuguaaggucuuggcaagacaagcaguguggccagaauuuugaacuucugaugaauguguaaugcaaaggaccuuguacauuuuuuuguuucaagguccucaaaaugagcacaugaagagguugcugugaaacuuuaaguggcccuacugcgcagaagcauucagaugucacuugaugaucuguaagggaacuugcugauuugggaaugugcuuagggaacacacauuccuuuugacagggucugucacugggugggugaugaauuauacagaugacaugugcuuuuuuuucuuuuuucaaccucaaugguauuccuacaggaaauggauaaccauuuuaacuguauuuuuugcagcccguaccuucuugggaauacaauugucuaacuuuuuauuuuuggucuggcuguuguggugugcaaaacuccguacauugcuauuuugccacacugcaacaccuuacagauguggaagaugugaaauuugucaucaauuaugacuacccuaacuccucagaggauuauauucaucgaauuggaagaacugcucgcaguaccaaaacaggcacagcauacacuuucuuuacaccuaauaacauaaagcaagugagcgaccuuaucucugugcuucgugaagcuaaucaagcaauuaaucccaaguugcuucaguuggucgaagacagagguucagguaaggaugacugauaggaaauguugguaguuacgagucacaucguugucuacaaauccauuuaaaugguauuggagggugaguaaaaccuugaaugugaaaacuuaagcugaaaaauuguaaaaacauuucacgccuaccaugaauagaucuguuucuuucuguccacaaugauuugugucauagacauaauugaucaauuugcaauuguuuucuugacaggucguuccagggguagaggaggcaugaaggaugaccgucgggacagauacucugcgggcaaaagggguggauuuaauaccuuuagagacagggaaaauuaugacagagguuacucuagccugcuuaaaagagauuuuggggcaaaaacucagaaugguguuuacagugcugcaaauuacaccaaugggagcuuuggaaguaauuuugugucugcugguauacagaccaguuuuaggacugguaauccaacagggacuuaccagaaugguuaugauagcacucagcaauacggaaguaauguuccaaauaugcacaaugguaugaaccaacaggcauaugcauauccugcuacugcagcugcaccuaugauugguuauccaaugccaacaggauauucccaauaagacuuuagaaguauauguaaaugucuguuuuucauaauugcucuuuauauuguguguuaucugacaagauaguuauuuaagaaacaugggaauugcagaaaugacugcagugcagcaguaauuauggugcacuuuuucgcuauuuaaguuggauauuucucuacauuccugaaacaauuuuuagguuuuuuuuguacuagaaaaugcaggcaguguuuucacaaaaguaaauguacagugauuugaaauacaauaaaugaaggcaaugcauggccuuccaauaaaaaauauuugaagacugaauuaaguggaaauuguacuuuauuuuauauaaugucauguaaaacuuugcuuaagauggucugguuuuuuuuuuguuuuuguuugguuuuuuuuuuccaugaaaacaaaugacuguuccuuuuuauuuaauuugggaggcagggggaaucagaaggcccuucuuuauaaugagcuauucauauugcaggagucagaaugaauugauacaggugaauuuuuaguuacaggcuaaauugcauaaaagcuuugucagcuuccagcaucaggggagucauuuaauagccuuuuuccuuauuugcuaguaugguuaaaugagaaaauaguaaaauagauacaaagucaucuauauagugugagaacgugggugacuuuuucaaaguuuauaauuuaaaaagcuccaaauaacuggcuuuuucaagagacuuauacucaugcucuuggcuauacugugaauuacugaaauguugaacaaaccugugaaagacauacauuagcccuuuaagauggccaggagcuaagcuugagucuccuuuacugaauuucguucuuagugcagguuacuuguagauucuagucuucacaggcucccuggggcucuuaacuagucacacugggagucaugaaugucuuuccaauaauucagggaauucuagagauccucaaacuguaaggucuauucauacucaacacaaggaaaaaaccucauuaaaauuaaugacuaaucaggaggcaacguaaccaaaagcacagugaaugaaaguuuucaugguagguucaacauggguuuauugcuagaaagauccaggggauagcuuuagguuuaacuucggcucaccaacguaacuuucuaaucauuuauuucaguaauagcuagaagugggucugaauguuuucccagagucugauacguguuuuuuuuugccagaagagaggucuucaggagacuucauuuaaauucugauuauuaaacugaggcuuuaauugauguuaaugccuuaugucaaauguaaaguuagaauuugcuagggcugggauagggagugauauuucuaggacuuagacauugaaaacuaauucagccuguaguaaccuggaugguuuucaauggcaugguuagucaaauucaugguuuuaaacuuagaagcagcuuucgggggagaggguagguuggagcauuuauuacauauuuuacuguuuaaugucuuaaccgugggccuuuuaauuuguaaacacugaaaugauuguugggcuguggaaaacauuuaccuauuuaccuuggaaguuuuaaaagacaguccacuuuuuagcauguguguuguguccagccuguggucgucuuaacuaauaaaugugauuuuucucccca

SEQ ID NO: 21499 - RNA, 3281 nt, Homo sapiens
uuucauuaaaaaauagugcucuuuauuauaaauuacugaaauguuucuuuucugaauauaaauauaaauaugugcaaaguuugacuuggauugggauuuuguugaguucuucaagcaucuccuaauagccucaagggccugaguaggggggaggagagaggacuggagguggaaucuuuauaaaagacagagugauugaggcagauuguaaacauuauuaaaaaacaagaaacaaacaaaaaaauagagaaaaaaaccaccccaacacacaacugcccuguccagcccaauaccugacacagaauacuuuguguuuguuuaguugcccccccccacaaaaacaaaaacaaaaacaaaaacaaaaaacuguuccagguaauuccaucgcugcuacauuccuguaaauugucacugaucagugcuauggcagagcgggagcacccgggguggcagcaguccagccucuccaaugaccuccagccucccccacccaggcaggagggagggcugugcagggcucggggcagugggaccugguggcucugcucugaccacgaggcgccugacuggccaauacuuacugggcugacauucccagugcucagcugggaggcauggguuuccgcccccccuccccacuucccuggcugugggcuggcuuggugcccuccagugagucccucagccucuccacccauccaggcugaguauguggcuuuccuaugcugggucccucuccaugggacagggagcauuuaaggcgaaucucuuagccagacauagucaggaggcacagaguagaauccccugucuucucuaccaggagccugaggugaaagaugucccgucuccuccauccucccgcuccauccacccagguacaggaagguauaguaugaguaggaaaaggagaccagcugaccagcccauccauccccuccaaauguugcuucccccuuaaaacggaggaagggcccugggcucucaggcaccagguagacuuuggaaccuguguuuucggugacugucccggaggagaggaugugggguaccaggaugguucccuucaggucaccccaagcccuucuccccggagccagggagaggagcaugucaccaggauccucgccuggggugggcggggggugugaccauuuccuucgccagcccgcagcccuggggcccucaggaccucucucucuuccaccuuucccaggcuccacaaccagcucagguuuaaaccaaaucaaagagcaaacaaguuccguuggaaaguuugaagauucccuggcaguucucauuaguucagcauucccgaaguguccccuguuuggaggcagaggggaagcugaggaauugaaggagaauccacuugugguugcuaucgucccaccaggacagcuggcuccuccggagaagcuggagacucaggugguacucccccuucccuccaacacauuccagguccgccugccacauucugcagggagagggcagagggaggggccuguccgcccucuuuccccccagagcuacaggacucucuccugguuggcuucuugugcuugugccaugugccacggaggagaggggccugcguccccucucccgacccaugcccuuugcgcccuuuaccccuuaaagcggggcaucguacugguccaggaacucccgaaugggccccggcagcugggugacuuucucauaggaguccagguggccguugacggucuuccgacagagaugcugaagaguggccacguuggaggagaggggccggcucaacaccagggggaucuucucgcccccggaguagauguaauaggcucuucuggggggacucccagggaguggcugggcagacggcugcucgggcaccucggaggaggguucaguagguggcgaggggaaggagggggcuccagggggcggcauguaguggugcaccagcuugagcacgcagucgaagcggggcacgggcugcgugcuccggggaucgcucugcagagagaagcugccccccucacacuggaugcgcagguucuuggucccagacugggucuugacgcugagcgugaagaaguggcgcugguccgagcugucgcggaucagaaaggugccggcgggcucggcacugagcagcagguucgccucgccgccggucacugcgcuccaguagaagccgcucuccugcagcuugcgcacugcguucaccaccagcugguacucgcucuuggagcugaaggucuugaggcgcaggcugguguccagggggcggcucaucccggcggcgggaaacuugcugugggugaccauggcgcacggagccagcguggaucugcgcggcggcggcugcagcugcuucgcggccuccgcacagcggccgcuaccgcaucccggggggcugcggagaggaaggcgcgagcgcguugagugcccggaacccuccagcgcgcccggcccgccccggcuccccugccuucgccgagcgacuggggcacccacugccccgggggcccucuccugggcccgcgcuccgauccaggcgccucacggagcccgcacggcucccgccccugccggcaggguggccccgggcagccccuucccaggcgcgcacugcaagggcgcagcgugggaaacucgcgcgcggaaguuaggucuccaggaguguggccggguggggagcaggagaagggcccccgggacugccugggcgccgcucaguccaguagccccgggcgguguggacggagggagaaacccgaggcacggggguagggaggggacaggagaagcccgaaggccccagccggaguauuccgggaaccugggaucuccggcuuccauccgcucugccccuaccucgucaccucccugccgggaaugacccgggaaggggaggggaaaccgggaaaagcucccgggacugagcgagaccccuccccacgccgcgcuccuccuuccuaccuggucccgaaucgaagucuccguccuuggggcugagcccccucggguccccaaggcgacgcggcggcgagacggccagcgguggcccgcgcugcgcccagauguuggcggccgugaaguccacaaaggagccuucgcgcgcgcgucccucgagcuuccccugggcgcccgcccugcccccugcgcacccccggaccaaccgggaggggaccaggagagggaccgcggcaaggggccgcggcgggagcugggccgggcgggcggcuggcggcuggcugcgugcggggccgaagcggcagcagcggagcagg

SEQ ID NO: 21500 - RNA, 3281 nt, Homo sapiens
ccugcuccgcugcugccgcuucggccccgcacgcagccagccgccagccgcccgcccggcccagcucccgccgcggccccuugccgcggucccucuccugguccccucccgguugguccgggggugcgcagggggcagggcgggcgcccaggggaagcucgagggacgcgcgcgcgaaggcuccuuuguggacuucacggccgccaacaucugggcgcagcgcgggccaccgcuggccgucucgccgccgcgucgccuuggggacccgagggggcucagccccaaggacggagacuucgauucgggaccagguaggaaggaggagcgcggcguggggaggggucucgcucagucccgggagcuuuucccgguuuccccuccccuucccgggucauucccggcagggaggugacgagguaggggcagagcggauggaagccggagaucccagguucccggaauacuccggcuggggccuucgggcuucuccuguccccucccuacccccgugccucggguuucucccuccguccacaccgcccggggcuacuggacugagcggcgcccaggcagucccgggggcccuucuccugcuccccacccggccacacuccuggagaccuaacuuccgcgcgcgaguuucccacgcugcgcccuugcagugcgcgccugggaaggggcugcccggggccacccugccggcaggggcgggagccgugcgggcuccgugaggcgccuggaucggagcgcgggcccaggagagggcccccggggcagugggugccccagucgcucggcgaaggcaggggagccggggcgggccgggcgcgcuggaggguuccgggcacucaacgcgcucgcgccuuccucuccgcagccccccgggaugcgguagcggccgcugugcggaggccgcgaagcagcugcagccgccgccgcgcagauccacgcuggcuccgugcgccauggucacccacagcaaguuucccgccgccgggaugagccgcccccuggacaccagccugcgccucaagaccuucagcuccaagagcgaguaccagcugguggugaacgcagugcgcaagcugcaggagagcggcuucuacuggagcgcagugaccggcggcgaggcgaaccugcugcucagugccgagcccgccggcaccuuucugauccgcgacagcucggaccagcgccacuucuucacgcucagcgucaagacccagucugggaccaagaaccugcgcauccagugugaggggggcagcuucucucugcagagcgauccccggagcacgcagcccgugccccgcuucgacugcgugcucaagcuggugcaccacuacaugccgcccccuggagcccccuccuuccccucgccaccuacugaacccuccuccgaggugcccgagcagccgucugcccagccacucccugggaguccccccagaagagccuauuacaucuacuccgggggcgagaagaucccccugguguugagccggccccucuccuccaacguggccacucuucagcaucucugucggaagaccgucaacggccaccuggacuccuaugagaaagucacccagcugccggggcccauucgggaguuccuggaccaguacgaugccccgcuuuaagggguaaagggcgcaaagggcaugggucgggagaggggacgcaggccccucuccuccguggcacauggcacaagcacaagaagccaaccaggagagaguccuguagcucuggggggaaagagggcggacaggccccucccucugcccucucccugcagaauguggcaggcggaccuggaauguguuggagggaagggggaguaccaccugagucuccagcuucuccggaggagccagcuguccuggugggacgauagcaaccacaaguggauucuccuucaauuccucagcuuccccucugccuccaaacaggggacacuucgggaaugcugaacuaaugagaacugccagggaaucuucaaacuuuccaacggaacuuguuugcucuuugauuugguuuaaaccugagcugguuguggagccugggaaagguggaagagagagagguccugagggccccagggcugcgggcuggcgaaggaaauggucacaccccccgcccaccccaggcgaggauccuggugacaugcuccucucccuggcuccggggagaagggcuuggggugaccugaagggaaccauccugguaccccacauccucuccuccgggacagucaccgaaaacacagguuccaaagucuaccuggugccugagagcccagggcccuuccuccguuuuaagggggaagcaacauuuggaggggauggaugggcuggucagcuggucuccuuuuccuacucauacuauaccuuccuguaccuggguggauggagcgggaggauggaggagacgggacaucuuucaccucaggcuccugguagagaagacaggggauucuacucugugccuccugacuaugucuggcuaagagauucgccuuaaaugcucccugucccauggagagggacccagcauaggaaagccacauacucagccuggauggguggagaggcugagggacucacuggagggcaccaagccagcccacagccagggaaguggggagggggggcggaaacccaugccucccagcugagcacugggaaugucagcccaguaaguauuggccagucaggcgccucguggucagagcagagccaccaggucccacugccccgagcccugcacagcccucccuccugccugggugggggaggcuggaggucauuggagaggcuggacugcugccaccccgggugcucccgcucugccauagcacugaucagugacaauuuacaggaauguagcagcgauggaauuaccuggaacaguuuuuuguuuuuguuuuuguuuuuguuuuugugggggggggcaacuaaacaaacacaaaguauucugugucagguauugggcuggacagggcaguuguguguuggggugguuuuuuucucuauuuuuuuguuuguuucuuguuuuuuaauaauguuuacaaucugccucaaucacucugucuuuuauaaagauuccaccuccaguccucucuccuccccccuacucaggcccuugaggcuauuaggagaugcuugaagaacucaacaaaaucccaauccaagucaaacuuugcacauauuuauauuuauauucagaaaagaaacauuucaguaauuuauaauaaagagcacuauuuuuuaaugaaa

SEQ ID NO: 21501 - RNA, 33500 nt, Homo sapiens
uuugaaauaauauacaagaauauagugugcaaaauuuaggggcaacaucaugaagaagugugaugaacugaaaucaauuuuacagcugugauuccuaaccagaaacaccacuugguaaguaacaugaaaagccaugauuguagcucagagcaaaagcagcuguauugccaauguauuugcucuaauuuuagacaguuggaggaaaauuaaagugcaaguguugcacugcaguaagugcaaagucugcccccaccauaaagauuaugaugacaaaauauauuuaagauacauggcugaggagauacagaacacgaaguuaaaaaauacaaugguguugacuguuuguuaauagcaccauuacagugacuauaucccaaugcuauuaacuaacuuuaccuuggccugggcuaggucuccauuggaaauaauaacggauggcugcugccaccuggugcaucaacucagcaugccaugguaacugcagcagguggcucuuaggcugggacaccaacaccagccaccugccccauguucugguagccucuuggcacugaccagacuaggagcgccuauguuuggcacagaugcugagccauguggugguuacuagaggaaaggccgacucccagcuucugcuucauuucaucauguguacaauacagauuaauaagcaguaaggagccaauguauaaacagcaguuacauauuuuuuaaauuccccuuucguacaauuuaaaauaaaacauguauacacuucuccucucuuucuacuguacuuuagcaccacaggauaucaauuuucaagccuauuauuaccugauagacauauaugaaguuuggaagaaaaauaaggcaauuugguuuaaaauguugauaguuuuagcuuaaugcucuaauggagaaagcaaauccucacucauauuauuaaaucauuucaagacucaaugcuaucaguaucuuauggucacacgaauugaggacaaauggugagaccuugaucuucuuaagucuuuccaucaagagucaauguauaugcaaauauagacuuaagaacauaagcauccugguuuaauguuguugugagcccuguggaaauaaaauuaaacucagugaauguuuacaaaucaauacauaguaauccuauauaugaaagcuaagauguauaagauguuuauaaauuuacuauuagaaaauacugcuuucuuaaaggugauuuuaaaaagcuagcugauaucugauggcucaagcauccagaaaauguaugcaaugauaagacauugacuaggaugaacagaaaagggauacaggaaaaguccgaacacaugaaauucuaaauuaaccaagaacugccaaaauucaguucagccacccucucaucugacuacugacugaccacuauuuuuaaagaaauugugaaaaauuuaaacagauaugaccugcauuuuacuaagaaacaggcacauguacacaaugaauuuaaaacaucuuuggccagcccuccuacuauaaaaauauugauaucuucccuucaucuuucaaugauacuucaaauugaccccacuauaucacauguaauuuuuuugcaauuaaucuaaaaacgcugaaccuaaaagaugcuaguuuaguaauggaaaaguuauaagaaacaagucuauccaagauagcuuaucauauagacuuguuugccaccauuccugggccuauuucuucuccuccuugaaauuuuucaaucuagaaauucugugccaauggcacaaguccccaugaaugacagcuaacauaccccaacaccuccagccuuauuggucccucaccaauuaaggaaaaaaagcuguugagacaaucccaaaauuauuagagaaauuuucuacugugauauuaauggauuaauaaugcuuaucuuucaacccaacuagaaacacugcauuccaaaauuauuuuuccaacucaauguuuagaacaaacauucuuuugaaguuugccugagauuucgacuugccaugcuaugagaguaaaugacccuugaggaaaggcagucuuuauaugaugaugugauaacauuauuagguuuugaaguauaaaaaugcuagagacagcaucaacacaaccucuuaaagguuguaacaacugcuccaacaugccaguacaccugcacggauaaggcaagauaauuuuaaacacuauuuauugaaacauacugaauugguucuuuuccucuuccaacagucaggauuuaaacguuucuguucuucagccaaagccuuugcuucuaauguguacauucuucucucuucauucuucauuuucuuccaccugucaccaaggaucacacuuauggcucuguaaaauaaauauuuacacaaugcugaaagcacacauuuuucauaaaucucaugucaagugcugcuacuucaggagaaaaaugugaaguuaaaaaagaugaaaaucuugucuaucacagagaugggaaaaggucaaggccauaaugcucauuuccaguaaaaucccgaaucaaauaauccauuguuccguaucagcagcaugaaguauucaacuuguacuaaaagcuaaucuauuugugcccguaaccuaucaaauaguuuugauaaaggucuuuucucauucaaucauaguggaaguguagaauuaacuaugcauaucuuacuauuucucucucaagagaaaaccaaauaaaccuuuagacaguauuuuuuauuacuugagaaaacuggauaaacucaaaaugcuaagaaguuaaacugauaagacuacaucaugacaaauauuagaagcuguuuucuccuguuuguuacucugcuaugaaaccuacuaaaacagucucaccuaggcacacagauguaaaccaccuuccuucuaugaagagcuuucagccauucacuucaugacacccauauaaaacauaagguccuggaaauuuugcacaaagcacaucaagugauuuuuauacugacugauauggaagccaaagcaacaggcauuugugccuucgaacaguaaaccacagaagcucuccuacaaguguauuugucuuuuuauccaauaacuuaaugcaguuaaacauugugcugcauuuuccuuaauuauaaaccaauuuuugggcuggacguugugacucaugccuguaaucccagcacuuuuggaggccaaggcgggcagaucacuugaggccacgaguucaagaccagccuggccgacauggugaaaccccgucaccccaucucuacuauuugccaggugugauggcacacgccuguaaucacagcuacuggggaggcugaggcacuagaaucgccugaacccgggaggcagagguugcagugagccgauaucccgccacugcacuccagccuggggaacagaaugagacucugucucaaaaauaaauaauaaaaugauaaccaauuuuuauauuccauuugcagaacccauuaaaaaaaaaacuuuuagucuuggguuacagguaccauauaaugguugacacauuuaaacaaaucaauaaauauucacaccaucucagucauccacaguaggaaagaacaugagauguuuuugaaggggguggcacuugcgaaacauuuauuauuuuaagcuaaaagaugacagguaaugaaauguacacaaugcuguagacuauacucuguguucccuaacaaauguaaaauauacacaucuaaagauuauuucugcagugaauguuacauccagauggacauuuauagcaacuuaaaaugagcuacaugucucugaccuguucuagucuccauucccucagaauuugccuccaaaugagaauuuauucauugaauuaaggcagcuuuauuagagacagugaagaauccaauuucaaaauuaugauuuaucccauucaguuuagagauaggugauaucugauggcccucaauguuagaugauugauuaccaguauaucacaugggagcaaugcuaaaaugcaaagaaaauaccagauuuggcugggcacgguggcucacauauguaaucccagcacuuugggaggcagaggugggcagaucaccugagaucaggaguucgagaccagccuagccaacaaggugaaaccccaucucuacuaaaacuacaaaaaauuagccaggugugguggugcaugccuauaguucaagcugcucagaggcugaggcaggagaaucacuucaaccuaggaggcagcaguugcaaugagccgagaucacaccacuggcacuacagccugcgugacagagcaagauuccaucucauaaaaaaaaaaaagauuuuugagcaauaaaggguauaaccugauuuagagauccuauaaaaagaucagaaaacaaaacaucuaaagauaaaaugagauuuacaccccuuauaaucaggauaguccaguuccccagaauuggaaauaaauacagaaugcaucccagcugacauucucaacuacuggcggggaagagacuuacagggacgugaauccuguuucuagaugucaaaggauauguuuaauaauuaaauaccagaaguguacaaaaagagaaaugcagcauguaccugucacuaaaucuaaggccagucauuuucucaggaaaaacaaauugagcaaggggaaagguacaaauuacucuuaaaaugucuuuaaagccuaaaagucagucacagaaguagacuuccaaacuaacuuuuuuuaaaaaacacacuuaaacccacucuuuuuacugaagaaauggauuacaacuuaaagauuaauugccaaaagucacacaaaugacugacagauccaagaguuaaaacauuucaauaguauuaaaaagccucuuagcgcugggcccguggcucaugccuguaaucccagcauuuugggaggccaaggugagcggaucacuugagcucaggaguuugagaccagccuggccaacauagugaaaccccaugucuacuaaauaugcaaaaaauuagcuggguguaguggcgcaugcccguaaucccagcuacucggguggcugaggcaggagaaucgcuugaacccacaaggcagaaguugcagugagccaagauccugccacuacacuccagccuggaugacagugagacuccgccucaaacaaacaaaaaaagacucuuagaauucuugacucacuaauuacacacuuaugugucuaaaggaacuaggacaaagcuauucauuacugugguaacacaguaaugacuuuucucaugauaucaagauaaagcaaaugguaguuuugauccucaggguacaaagacuggaagaagacagcguuauuaauauauggagaacuugacugguuugagagggauucagcaguagaggacucggagaugaguaaggguacaggcaacagaguaggaaggacuugaguugauuuuuauuuccagcuucuacugaggacagcucuuaaguucaccguuuugacaacucuggcagcuugcuacaaauugccaguuccccguacaauccauaguugacucaggugaaaagcuguuccauaaagauagaacuguuaauuguuagaaccguguccuccaacagauaaauaacaugauuuuaaaagguagaucuugcacuuugggaggcaggcagauggcuugaacccaggaguuugagaccagccugggcaacauggcacaacccuaucucuacaaaaaauacaaaaauuaacugggugugguggcaugugccuguaaucccagccauucaggaagcugaggugggaggauugagccugggagauacaggcuacagugaguugcgccgcuguacugcagccugggcuauggcacaaauaauaaaagguagauccuuacuacuaagguagauaaccuaauugucuauguauuauaaaauaauuacauauaacccuaaaaauuccacuuaaacuuuuuacuuuaaagucaaccuggccgggcacaguggcucacgccuguaaucacggcacuuuaggaggccaagguggguggaucacgaggucaggaguucgagaucagccuggccaacauggugaaacccugucucuacuaaaaauacaaaaaauuagccagguaugguggugggcgccuguagucucagcuacuugagaggcugaggcaggauaaucacuugaaccuggaaggcggagguugcagugagcugagaucguaccacuggacuccagcuugggugacacagcgagacuccgucucaaaaacaaacaaaaaagucaaccuaagaguugaauaaaagcuauuaaagaauaaguuuacuuaacuauuccaguuaccaugaaccguauugaaguguuacucauuuauuguaaucagaauuaucacuauuuuuaccuguuaucuuucccuggauacaucugaguauauucaacucuguauuuuuuggcaaaaagcaugaaggcauucauuggucuuuugcacuuauuaggagaaguggcacucacagucccugagcugugguuuuugacagcuuuagcauacaaagaauuggaagagagcugugaugauccaggugagccacaguuuuuacugaauccagaucuugcaaagucuugaccaccagguccuccacaagacaaagaugcacgacgcuggcgagccauacuacuuaacacauaaacugcagaagaauccauaggugugaagucauagcuauaaaauuaaaaaaaauaauaauauuuuaauucaauuuugaauucucugauuucuaaaaagcagguuaaaaaaaaaaaaaagaaaacaucugauuggaaauuucagugcauuucccccuauaucauguuaccaacacuaacaacuuuugccacugauaguugcuuauaaaaugaaaucuguauaugugcuaacugaaauuaauuuuuuuaaaaaaccucugcagauaauacaaaagcuuaaaaaagacuuugaaccccccaaaggaauguuauaaucagcauacuuuauucauagcaaguaacuccuccaaauccuacacaacccacuuauucuuacuuuaaauucauuucuggacaaaugugacaauaugguuucuuggccuauaggcacccagaccuagaaaauuaaaauggaguggcaggcaacauaccaggccuaaggacuacuauagaaaacaaaugguugggaaaggcagugaaaagcuguuaaauguggcuaaaggaacuuaaggacaggccugguggcucacgccuguaaucccaacaguuugggaggccgagguggguggaucaccugaggucaggaguuuaagaccagccugggcaacauggugaaaccccaucucuaccaaaaauacaaaaaucagcuaggcguggcagcacaugccuguaaucccagcuauucgggugacugaggcaggagaaucgcuugaaccagggaggcagaucacagcacugcacuccaacugggcaacagagugagacuccgucucaaaaaaaauaaaaaacaaauaaaggaacuuaaaaugcccaguaaucugggucauuuguuuagguaaagagagccauacauacaucagucucccgaaaggccauccaugaccuauaacauagccuaauaacauaaaguucauuguaaaaaccugccuuugucaggaaaggccacauuuuguucuguauguucaguuuacauagacauggaaauaagcuaaagaauucucuuuuguuccagcauuaacucucuuucugccuauaguacuuuucuaucuucuuggcaggaaaccuuuuauucagcuucuaaucugaaccuagcuccuacuuccuucccugaaacagaaauuccgguaauacaucaaaauaguuuaauauuagcuacaggaauaccaucuaccuaaagguaaaacaugagauuacaaaauucuaaagauagauggaaacagccaaaggaaugagggcgguccaugccacugacuacacacaguaaaugacuucuaccacuuaucaagcacacaaugucuuuuuucugaaaguauugcaugaaauaaauguacuuaaacuaugacuccaaaauuaccucaugaaugcuuagcaaucaguauuacgucaggaaaacaaugucugcuuucuagguuugcaguuuuuguaagauaucuucagccccucccauacauaauuuagaaaaauagcaaacuucagcacugacacaaaauuacccaucucuacugauggaaaaugauuacaauuuaaaauacuaaaagauacuggguaagcuaauuacuaaaauuugaaaacuccaccaucuaguggcacaaauauaacuuaucaucuacuuccauuauggauacaacuuaaaucaguuuuaaauauucagucacaaaauucaaugacuaacauuacugcagcaguaaugacauagaguaucuuuaaaaacagcuucaucuuuugcuauacuaccuuagguaagcauucauucucuucacuaaagcaccuguacccaaaugugccuuucacagcucuacuuuguguacaugccauuccuuaagcuuagaaugcccauucucacuucacugucuaaucauuagucuuaauggcaaacuccacaauaauguagugccuauuaaccaugucacauauauuaacuuauuuaauccuuccaauauuauccccauucuacagauuuuuuuaaaggagccacagaaauauuaauuuacucaagcuuccauagcaaaucaauugcagagccaggauuugaauccaggcaguccagaucgagcucauguuccuaucaggcuacacugccucucaaucagcguguacaucuacuguauacauuuacuaauccauuuccuucucuagauuggaagcaaagagguauggccauucuuaacucauuuuuuaaucaauucugaauaacauaauaauggaaaauuuuaacugagugcaaauuccagcuaguaauaugaccuugggcaaguuaaauaaacccuguagccucaguuuacuuaucuguaaaauaaaucuaugcuaugcaguggugccaaaaagaacaauaaacauaagacacagggcagaggcuggcacaguguauuuugccauuaggaguaucuauuauuguagaaguaucuuaggugaguagcuagagaacucaaaauuuggaaucuuuacaagauaugggcuugaauccuaauucugauacuaacugccuuuguuuugggcauguuccuuaaccucucucaacuuuacuucucucuguaaaaugaggauauaaucuacaaauaggguaauuaauauuaaauaaauuaacauuauauauauaguaggcacucaaguuuguuaaaucauauuaccugaacagaaaugucaacuucaaagagucaaaacugacuguuuuaaacccgccugaggccuagaagguuggccucaauucucaauguuucagaaugggcuacuuacaacagaaccuugaauuauguaugagagcucaucaacugauugcugacuucugauucuuccugagcuagaaacuacucacauguccucuguaaaccaugacccgagaauuugcuuggagcaguccaacuuggacuuuuuccucuucuuaccucuuucucuucuugcccucccccuaggccaggcaucaucucccuuaaccagucuaauccacaaugaaaauaaagucacuuucagcuucucaauuuuuuccugguuucuccaugaugauaccacccauuuccacuccuuugcagggugggugcuccugcuguuauauugaagucacucaacaguaaaaugagaccaaugacuaacaucaucuugggagugauuauuauucagugagaucaaaugguaagaauuugcuaucucagaaaagcaggaauuaggcaggcaaguuuucccuuuuacuuuaaaaaaguuuggugcuauguaauaauauguaaacuuuacauauauuuguaaguuaugaagcauacaaauaaaugagugaacccacaauccaaauuaagaauaauauuuccaguaucacuaaguuccauauuugccaccccagaaauaaccacucuccugaauguuaaucauucuuuuucaauaauuuuauuaugaaaauauuacucauaaauacaacauauaaauacuacaguagcauuaguuuuauuaauaucuuucuuaauauauaagauacaguguuucauuaugcagaaaugacugcuauccuuucaaaagucuacuuacaagguugacccuugacuaauuucuagaacuuggauuuugaggggucccaucauucccacaacugagaagaguaguuuacugugccuagacuggauauacaaacaacacaguuuacucugaaugccugcuuuccuuuuggaaguuuggauuuuguuaugugccaagcagaagaaaccuacgugacugcucucaauaaaaacccuaggugccaagugcgccuaacaagcuucccugggagacgacauuucauauauguugucacagcccacugcuggggaauaaaacaugcccuuaauuccacugggagaggaucccuggaagccuggcuucccucagacuucaccccacaucuuuucccuuucccaauuuugcuuuguauuaguauuuuuuugccauaauaagucacagccaugagcacaacuaugugcagagucuugugaauucucugagcaaaucaucaaaccugggggcuagucuuuagggaccccugacauaauuauauaauguguauuacaaaccauauauaaggguuauuuuauuuauuucuaaggaacaugauuccauaaaauagacucauacuguauauuuccaagacuuauuuuuacuuaacauuguuuuaaaaauugauccauguuuuaaaguuuguagcuaagguucauucauuuuccacuaauuccacuauaugauuauaucacacuucauggauucacucuccaguuaauaaguauugauacuguuuccacauuuuugcuaucaugaguaauacagcuacaaacuuacuugcaccaucuccuugagcaugacuacaagaauuuacuucucuagaauauauauaaaagaggaaugaaacugcuaauacucaccuuuacaagauaaagccaaauuaucuuccaaaauuuuucuaucagguuacagucucaccaaaacauaggaguuaucauuaaucuauauauccuaaguaucaguccuuaaaauuuugacucauuuuucuaguuuuucaaaaaagaguguauaugagggauguaaucaaacagcauuaagagcauaagcuuguagacauuuaucgagcauguggcuugugucaggcccuaugcaauuugcuuuuuuaauaauaguuucacucauccucaugauauauaaaacauacuaauuaaacugaaugaaauaaaaucuacaggccagcagggacucuugagaauucucuacuuagugccaguacaugccuauggauuugauaauuaucuuaaagaaagaaugagucuuuaaaucccagauaccuacacacagacuuucucuggguuccuucuaggagcaagguggccaauuguuccaguuugucuaggacugagggguuuccugaaagcuagacuuucagugcaaaaaccaggaaagucccauauaaaugaagauagcuggccaaccuucuggagucaggacacauggguucuuguccuuuucugccacuuacuagcaacgugaucucaggaauaaccacuucccucucuaagccuuucuagaugugaaguuuaggcuauuuucuacuauuuguuaaaccaugcaacuaaugcccuuggucaaaaugaguaugaaacaaagauacaguuaacuauuauaucaagaaaaauacaguuaacuacaaaaaacacaagagauuuauaagcuguuuaagaacaacuggccagauaucacaacuuuuuaaauguaacuaucaaagcugaaccauuaaacucuuggucauguaacaugugauauucuuccuaaucuaauccuaaauguuuuauaaacucaauuuuccuauaugacaacuacacgcaaaacucucugguaacuauuauacuuuaauuaccuaauauguuuucaugucauacuuuccucuuaauaauucuuuuauaauucucaaaucuuuaaagacugaacuuccuaaauaucugacuuaaccaucauuagggaaaugaagggcaaacuuuaagaggaaaauaaaacaaagaauuaauccaauauuaccuuuuaaauguaucaaaaacaccugaaucaucaaaauuaauggcaucgggguguccaggagguagacauacaucgccaauaugaacuucacaacauggaaugccaugcuguaccacagucaagcuuggauaaaaugaugaccaaccuaaaguuaaacaauguugcauaaaggaugaggacucacagaaagcacccuacuuuagaacagacauaucauuucuauaucuuaaaaauaaaauguuauugcuaagucucaagagauucucuaacacaagucauguaucuuuacaauaaaguacuagauaaguauuuccuuucagcaauguaaaagcccuccaaaacuagcuuauuguucagcauuuuauuauauauagagcuccucuaucaaucagcacuuccauccgucuacaaugacaaugagcacuuccaucagucuacaaugacaauaagugauaaaugacugagaccaugaaauagucucugaauuauaaaaucaucuuuaacaugguguuacuguaauaaggcucugaagagugacucagguuuauaucauauuugguaacucuuaaugaaaaugugauuacuagaucacuacauuacccaaacuauaccaagauaauagaaagcuuauuauacuaugcuacaugaaucuaaaaauuucucauacaggaaauaaaguuccaccugacugcuaagauacuuacgcaccauuagguauuauuauaagcauucccuaugguaguuuuuuauuuaguuugaaagacguuuuccccucaaauuuuuucuuaaucaucaaagcuacagacauaauuacagauuuaagaagcuuuguuuaaaaaaaguuacuacaaaugcaauucaagcccuaccuuuauuuuuaacauagaaagggugguccagcuuacacucuacgguaaguaaaccaucuucuacuguaccaggaucaaaagucaacuucaguacagacucgccaaaugauacacuuucuucaugugauaacaacuuuagaccaucagaaccauagcccugaaaauauaugcauagcgugaaugaauuggaaauguucaauucaaaacacugugaaguucccauuacauguaagacuuuguggaaaagguaaaaauaaccaagacaggaucccugccauuaaagagcuuucaaacccgguagugaagaaagacacauauauaaauaacuagacuggaauaagcacuuacacucaaguauaaauaauggugaugcaguuuaauaaagaguuauuaauaccaaaagagagauuaaggaggauuuucaauuccaacuggaacugagauuuaaaagaagaaugcaauuuagaaagaugccuugcaccaagaaauuuguaauuaacaauaacuuuggggagugcugaguauuugcuaaaaauacaaggugaguucagauuuggggcaaauaaagcuaauaaggagaggccaguuaguaaaggccucuuaaagacaggcaaaguacugacaauuuuugcuuagaagguauugggaaaucaaucaaaguguuuuuaucagcaugacugucaauuuuuaagaugaugguaaauaagaaaagacucuacagaagaaaagaucucauauucaauuaccugaggauauaaugagagacaccuauuauagaccugaauugacaagugcaauaguaauagaaccagaaaaauuuaaauucaaugaauauugagcauuuaacacaugccacaugguaggaucugaaaauacaaacacuaacaaacaugauccuuacccuuacauucacagaaaaacaaaggagacaaacacgccaaaagcuugcuauaguauccaaucauaauuacgcuaacgcaugaacaaggucaugaauaagagaggaugacuuaaaaaucuuuacagaauuagaaucaaaugaauauaaauaaagggaagaaauagaauaguaaaagacaacuucaugguuuugaaucugguaaucaagaaggaugauaauaacaacuuugaaagaauaggaggaaaguaagccaagaagaggaagaaaaagguaagggcaguuuuggucacacuaagcuuaguucaaagaacugacugauauucaugcagagaugucuaacaugcagcuggaaaugugcaggugaaggcuauagacauagauuggcaaauaacgaaauuacaaaaucuucccauucucagggcugcaggagaccuuaaaacuaauccaaucccauuuuucagaucaggaagccaauacucagagggguuaacaaucugccuaagaucaguaacacagauaauugcuggagaagcuauaaagagagcccagguuuccugacuccaaguccagagugcauuccacaggacaugauggaggugcugcugacauuaucaggagagaggaacuggugaagaaagugaagggggcaaaaucuugucuaauauucagcacugcgggcagucaaguaccaggccuaaaagacugagaaucaggaugcugccaugcuacacaaaucaagggaagacaaugucaggaacuaacccaaugugucaaauguuguacagaugucaaacagaacaaacgacgucucucuuccuagaaaucagaauaaagcuaguaaccuuugagacaauuuuuguagaguaguagaggccaaaguuagacuauugugaacuucacuaaagugaagaguaaagcaaggggacgaaacugaaggcagccaagacaggacaauuuuucucaagagacuuaauagugagacauagcaggaucaaaacaagaauuuguacaagcacacuucacaugcccauuuucuugccuacaggagagauggagaaauuaaaaauuucaaagugaaaggugucaacuuuauccuaauauugcucgcuacugcuuuugcucaucgacuuagaaaaugcuaguuuuaguaacuuaauaugaaacaacuuauauaaaguaacuuaauauaauuggcuuucaauaaucuacaggggaauuaaucacuuuguagauuaccuaaggcaaggcuuugguuaguuuauuuauucauuacauauaaauauauauauauuuuuugagacagagucucacuguguugccaggcuagagugcaguggcgcaaucuuggcucacugcaagcucugccuccuggguucacaccauucuccugccucagccucccaaguaguugggacuacaggcgcccaccaccacgcccagcuaauuuuuuuguauuuuuaguagaggugggguuucaccgcguuagccaggauggucgcgaucuccugaccucgugauccacccgccucagccucccaaagugcugggauuacaggcaugagccacugcgcccgaccucauuacauauuuuuaauaccaguuuuccccauuguaaaguguauaaaacacgaagaagcaccaagaaauauacuauuucccauccaagaaagcauguuagaaaggcaaaccuaaaaucauugcuccuccccaucagacuaagcaaugaguggucauaaaaaugcucuaccuaaaauguacgaugucauuuaaauaucaaagugaauggaggauauuucuguagauuaacaauaaaucuuguuucauuuggaaagauuuugaaaaauuuuuuaagaauuuuaaaucaaccuugugaaugcccauuugaagaucuuccucauuaucacagccuucagcucuagcaaaaucuucaacaucuugccauuccuuauugcuucccuuaugaaagcacagucgugugccuaagguuuagguagaaaacacguauuagacacgugacuguacuagacaaguaagcuguggaaaauucaagguuuuuguuuguuuguuuguuuuaccuuucaaaaaacagugccagacaguugaaggccaggaauugcaccaucccaaaucaucaucaucugacagggaggacaugcagaaaaugccagauucugacucacuauuugccuauggagaaaaauauuaucaacuuuuuuauuuguuuuuaaaauauaccuuuuaauaucuguuuucaucccacgucuuuaggcccaugcuuauagguggauaacuuaguaauucuaaccuuagggaaaauauaaugccuucaaaaacugaggguugucaggcugugggagaauuugcuaaaaaaaaaaaaaaaagaaaaaaaaagaaaaaaaagacacacacaaaacaaaguuuuuggaagcuuuaguuauacgcacauucccauuaauaauaagcuuuccuaacacauagcagagcuguauauaaaaucaaauccagaucacuaacagaacagugagacuacuuccuaugaggaauguuaauguacuucaacuguuguacaaacuuuguaaaaguuuaaccucauaaauaaacuuacccuuucgugucuuacugguguuuccuccuuccaauggugaugagggaaggcugguucacucuucgaagaagaggacacugguggagggcgugcauaggaauguaaacuuuugcuaguggcuaugauguguacaggagaugaucuaaaauaaagcaacaguuucaaccauaagcauagguccuuaaaguagaucuuuccuauuaaugaaagaacuucauauuuaaaacgccaauguuauuacauugaacacauuuaugguaaacacuaguaaagacagcaagauuucauuuuauaauuauauuccuuaacuccuuauccaaacccuccucacacauuuuagacaucguuuuuuucagauuugacaauauauuuuaaacuacgacuaugguuucauuuauuuaucccauucauuuuucuaucaauacauauacauguguauauuucguuugugaaugauaauacccccucuaaugcagggcguccuauccauuucuuucuucuacuuugauguacucaguaagucucaguaugaagacagcauuuaagcuuaguguaaccaacucugaacucuuuaucuaccaaccacauaucacugggcagauacaagaacuaccuuaagcaaaaaugcuuacacuuuuuauagcagagagcagccuauccacccuccuuguaacuggacacuauuucuuguuuucuaauacaaacuugcugaaaagcaacuacauauaaggucuaguuauuuuuucuccucaaagaucaccuuaaaaaaaaaacuuuaucccuugcccucuuuucuuccccucaaaagucucuuuuaccagacaaugcucccuuuagaguauauggagcucccaggagcauacccagauccuucccucacaaacagaccagauauucaugggugggguaacagaaagaaacaagccuauagaggaugaugaaugauguguauggacucagcagucuggaaaggaagcagagaggaagacagccagguggaggagggaaaaccaucugaagguaaggucccaaaucaggauaauugucugagaugccaaauagagaucugguccuuaacagaaaaaguuuaugcaugucuguacuaauacucuuuaaaaaggagaggaagggccgggugcaguggcucaugccuguaaucccacccagcacuuugggaggccaaggcaagcggaucacgaggucaggagauggagaccauccuggcuaacacagugaaaccccaucucuacuuaaaauacaaaaaaccagccaggcaugguggugggugccugcagucccagcuacucgggaggcugaggcaggagaauggcgugaacccggaaggcggagcuugcagugagccgagauugcaccacugcacucgagccugggcgacagagcaagacuccgucucaaaaaaacaaaaacaaaaaagagagaaaggacaucuuuccaauuuuucccuuauucccugagaauuuguauuagcccuucaauuucuaccuuauccucauuaacauuuuucauuuuaccuuuccagaaauuacuuuuacauaaggaucuauacuuucauguucacaucacuccuuaaaucgaaaggcccucagauuuccaugcauuguagcauacucuccaauuuuugauuucaaauuauaugcugaauguuucaucuuuugcccaaaaacugcccauccuguuauuacacauuuagauauauaugaaguaucagagaauggccaaacugcuaaauauuccuuuuguucauuccugacucccuaauuuuaaaaagugaguuuuaucaguucuucuguuuaaccauuuaaaacagaaguaacaaaaaguaaaaauaaauaaaaaugaagggaacaaugugauauucuaaaauguauauggccuaaauacucugugaaaauuaacaugcuaaacacguccaaacacuaacagcauugauuucuucaucucucucucuauucagggguaauauaaauuuuuaccuguccucaacuccuuaacuauagacuucagauaucaaagcucaguaacacaguuuaacacucaacaauaagcugcaugagcagacaguguuaggagguaggccagacaacagagcauuacucaaaaugcuggacagaauaauacauccucagggagauacuccuuuccuuaugucuuauguuuuuauuuacacugauuuucuucugaaggguuuacucacuuuccauaaacuguuauuauuaauccuaugacucugcuguaaaaagugaaaaaaaaguaucucuagagaaagaaaaaaaaaauccaauaguuaaaucagguuuuuuuuuaaaaauaaauaaauaaaagaauuuuuagcuuuuugacuauuaagauuacaaugaaaacuaggacuauaaaggaaauaacaacucugaaaggaaguuuucuuuccuguggaaaugaacacggaauuaaacugaaguuaauuaaauucaauuugcucuagucaagaucaauauccugcuaaauguaagaaaagcagcacaacuuaauggguuacaagaaaagugagauuucauaccuaauaaguuuauucuuuagcaaugcauuacacucaagagcacuaacaaaauuuacaguuauuccuacauuaccuaguauaaaacucuggucuaucguuuuccacucacaggugugcaaauaugggcauuucucucccuuauaaacugucauauuuauccauuucuuuucagggauaaauaaugaaguguuuuccacuuaggucucccuaggcauauuagcuggaagcuuccguaauuucauagcacaaccacucauuuucuuaaacucugucuggauauaugaaacagugauuuuuaccaaugggaacccacuuuuguaaguuuaagauuuuaauauuagcaaauuuuagaauuagcaaacaggcaaauaauguaaggccacauaaacuauggaagaaauaaaccuagaccaaaaggaacccaacuaaagguugauaaaauuuaaaauauaaucuugauuacaacucugcuuccuuagagaaauacaauuuucauuucuauauguagaaauguauaguaaaaguauuucauggucuaauuuauuuuaaacauuuacaaauuuuuuuacucuaugguucucuuuaucaccuuuaucuaauucucaaaauaugaaaucaugguagugagugaaauaagucuuugaucauuagauaaggagcuuaauucuaaugacuuaaauucuaauaauuuaaaguauuacuacuuuuaaacuagaaaaauuuuuaaauaaaaccuuuguguaaugauagaauguuucaauaaaaauauaauaaaugcuccuaccuauuguaaaaugagcacugcaucaguggacuuuguggacuggucgcgauauuugccaauucuguuagccaguccaccucauuuucacgguaaguaguuucugguaugucugagguauuuugguuccaagaugaucuuggguauucuugaugugaaacaucugaacucagcugguacaugccagauuggguaggaucacuuugaacugccugaaguucaggaaggucaucugcaaauaagcacacucaaaaucauaaaaaggaaauuacuaauacaaggaacaauauuauaacugcaguuaaaagagaaguccucaauuuuagcuaauuaauuuugagagaggaaaaucauaaauuuaacauucuguucacagacuggaaaaacaugguuugguuuguguuuucugcuucuuauucccccuaguguuuuguaccucaccuaggagugauccauaugccacugagauauuuuuacauuaacaaguuaaugaagaaaaaggcauuuuaugugugcaauauggacuuauuacucacauacuuuaauaaccuguuauacagacuauaaacaauaauuuccauaaugauaauauagaucacauaaauauuuagcuacuacuuacacaacucuguguuaaaguauuucuuuuuacuaauaaauucugaacuuguuaauauuuacugguuauuuaucgguuauuuuuuccuauaagugcauuccuaaaaggcaauucaugauacccuuucagcuccccauaagaugacuggaacuauuacccagcuaccacucaugcacacaccaagcacuauaaggaacaugaauuccaaaauacugaauucuuaaaaaaaauuauauauauauucuuuuaaaaaaucauauauaugucuguauguauguguguauguaguagggaagaaaaagcaucuugaaggcuuaaaaaaaaaaacucuccacgaaacacauaccuacaaacuccacaaaccuauugggucccuuaaauauacaagucaagaaaauuucuagucuccuaaaugucacuauaaaaguauguauaacuccuauucaggcaaauauuccagaauagucuacuaaaaccgaaauguccuaucuuaaaaaaaaaaaaauuuuuuuuugagauagggucuuacucuguugcccaggcuggagugcagugguacaauuauagcucacugcagccuuggaccccugggcucaaaugauccucacgccucugccucucaaguagcuaggacuacaggcauguacccaccaugcccagcuaauuuuuaaagaaaauuuuuguagagaugauaucucacuacguugaccaggcugguccugaacuccucccaccuuguccucccaaagugcugcgauuacuagcgugaaccaucaugccaagccaaacugaaauguuuuaauuagaagcacugacucgggauauccauuuguaaaaacugacuucuuucauggagucaugaaggagccaaggaguucuagaacaucacacuaauuuaaaauaauucuacccuacaauuuucaugcugauauagcuauuuccuuucccucacugccuuugaccaacauuuauuuacugcaaaggguucauuucuguuucugaaguucaggaaauuacuuuuuaaacgaagucauagguggaaggggcauguuauuuauacuccccucggcccuaaguuucugaguuccuccuuaaaccaaaaacugaggaagaucaacuaccugauuaaaauggcacuccuugcucaaaaguaaccaguacucaauaaauacuaggguccagaaaauccuuggcauucaagcagguuaugugucccaagagcuuaagaucucuaaauuuccaaacauuaccauaguacauaaucuccuccauuucaucauuuguaaaauuaagacagcuguaucuucuccccaggguuuuuauaaacaugaaggaaacccccauauauuaaaugggggcaaagccaagcugaaaagcugggcagcaagccaaggugacucauuagcuccauacuccugaacaccagccuugaagcaauacaauucaaaaacacaccucaacaaacuuacacauuucuaaaggucacauaucuccaggaguaguuuagcaauaguaacaaccauaaaugucagauccucaaguuucaaggguccacuguaauuuccacaucauaccagcaaaucugccacgaagaguggcuaagcauauuuuacugagcucucucaaguauauuucaaaaguagcaucuuucgaaaagccacgagugggguccaaucuuuacacacaaaguaaaguaguuuaauuuaacaaucuguaaaugagugucuacaauaaccauaaauagcccaacucauguugguuuuaaguaguauuuuaaaagcaauaaaagaaugcugaaaauuccuaauauacaaauacuucauaucccuuucuagccagucaagguugguggagaagcgggcuaaguagaaaaauuuaucugaaucuuagugagauuucuauauaacuuuuaauuuugcuuaccaagcuccauguguucaucacaggaguuauauccaggugaagauggcaaauucucauuacacugcagcaacuccaaugagucauucauuccugaggcucucuuguccaucaccaacaggaguuucuguacugcauuaggcaucugauuugucuucacuucccacaccauguuauggugcucugacuuaaaauaaaaacgacauuaagaaaugaugucaagccaugcaauuugggcaguacacaaaccuaaaauaaaucagagacaugacaauguuguuuuguuuuuuuuuugagacauagucacacucugucacccagacugcagugcaguggcgugaucucggcucacugcaaacuccaccuccuggguucaagcgauucucccgccucagccaccuaaguaggggggauuacaggcacaugccaccacgccgagcuaauuuuuguauuuuuaguagagaugggguuucgucauguuggccaggcuggucuugaacuccugaccucaagauauccgcccaccugggccucccagagugcugggauuacaggcgugagccaccacgcccggccacaguguuagauuuuaacuuaaucauacacugccauuuauagcucccucaaauccuuuagacccggaugacuccuuaacaucuuggccuacaacugaauacucagcacuaaaucacauuucaaucccaaaagauuaauaucuugaauuauaaaaaaaagucuuuucugcugaggaaaaauggcauuguauauacuuuuauuuaaccuaguaaccguccuuucagaugcaaaaacugagacuaauaggacucuuuuuuucacuuguaccuucaaauucaaaaggaaauuuaaaaacuuuccuuaauaaaaguuaaaaaaaacuggaagaauauucuauuuuguccuuuuuuaaagauucuauuuuaaugucucuauuuacuguguuuuuuauuuuguuucuucauucugaaagugaacuacuucagcacacuuaaaaaaauacauuuucuuuuuuuugagacggagucucgcucugucacccaggcuggagugcaguggcacaaucucggcucacugcaaccucugccuccuggguucaagcgauucuccugccuaacccucccuaguagcugggauuacaggcgcgugccaccacacccagcuaauuuuuuguauuuuuaguaaagacaggguuucaccauguuggccaggcuggucucaaacuccugaucucaggugauccacccgccucggccucccaaagugcugggauuacaggcaugagccaccgcaccuggccaaaaaaaguacauuuucuaaauaacauuucagaguuucuuaaaauggucauauauuacaauucucauaaaaauaaaaauguucuuagguuuucuuaaugaaaauuugggaccuagccauaauaaaagauaccugucauucugaauaggauauuauguauagaaagaugaauaaucaucaugggaaauuuaaacaacuaguaaaucuaccugcaagccuacaaaauuaucacaaggaagagaauauggguuaauaaauuuaaauaauuucucagcaaaauccaacaacuaaauauuauuaugaaaggaaaaugugguugucucuuuuauuucacccuuuggacaacgaucgaauuaguucuuuauuuaacauaagcaacaaugguaagauuuuucugauuucucaggcucuagucuaaauuccauuuuuuaaaaaaguucuagccugaugcaguagcucaugccuauaguuccagcuacuuaggguagacugaagggggacgacaacuucagccuaugcguuggaauccagccugggcaauguagcaagacccccccucuuaaagaaaaaguucuaaugagugaauaugaaauacacaaaaaaauccugacuuuugcaacaacauauuuuuccucaaaauaaagcaauaaaauauauugcuguuaaaagucacugaaagucaagcacccagugcaggcugaucaaaacugcacugaaaaaauguuaaucacuuaauauuuauaagcuuucuaagucaugauguuaauuaccaauaaacaccgaugacacugauaaauuucuuucuacgaagacuuuuucaugaucuuuuugguuuugaaauguauuccugacuagaaaauacaaucacugugaaaaaaaaugggaaaaaaaauuuuuuuggaaaaaaaggaauaugauuacuucuaaccccaccaaccagacuuagauauuuuuacauuuugauguauuacaauccaauuucuucuucauguacacauauacucaaucauguuuuucuucauauuucauauuauaguuugauaccuuuuggccuaauauaaguucauaagcauuuuccuauguuauuuuuucaaagcucuaaaugguuaaauauacaucagaaggauguaccgaaauucacuuauccccucuacuacugaauaugcuauucccaguuucuucacucuucuaaacacugaauuuauauucuuauuuuuuaaaaguauuugcuuacaucugauuauuuuagauugcuagauacagcguucuugacacauagcccaacugcaugcauauugccuuacuguaugucuaauauucuauuuuggaugcuaucugccuauaucccucaaaaauaacccuuagccugggcacugcuuuagagccuugcucaauacugacuauacaauuugcuacuauuaugguguagcaaaaagggcacuggguuagauguaaggaaacggguuuugauuccaacuugaucacuuaccaaauauaugaccuaagugacugaguuucucuucaucuguaaaauagagcuaaugauaccugcccuacucuccucugauaguaguugugaagaugaaaugaaauagugaaaaaaguguaaaaugacgucuuuugaaauuuuuuuauccccagacauagggcaauauuaaacauacuuugggucuguaauguccuaaauagaacagcuacugaaaauacauaauuaacagguggaaaccagauagcuauucaguuucaacagucuccucccuaggagauauuaugacaagucauccagcacaucuccauaaaaaucauguaucaugccauuacuucaagccccuaaaagaugaaauuuggaagaaauuaacgcuucuccaguuuaguacaauguacugaucacaaucagucuuagcauauaguuacagcaaauaugcuaggauauaacaauuucccccacagaacuagcgacuagagaaaauguguaacacaaaucuauuucucaaguaugaaaucacgauuuuaagccuccacucucucccugaaaaaaaaaaaaaaaaaaauggagcaaauuuaauuucaucagugauucucuacucuguggcacacgaaaucauacauaugcuuaaaaaaauguuguccaggccccauccccagaggaucugaucuguuuggugugggguauggcuuugugcacuaguuuuuguuuccaggugcagaauacugagauacacugggcuaaaaaugguugcuaaauuccuacuuauuaaaaaaaucauuuauuuaauaaauacuauguacagggcauuguauuaguugcaaugcuggaucucacuaaugaacaauucaucaugagucugacuuuaguggaaagauauaagcaaaugaccauaguucuacagagcaggacuuggcuaugaauggguuaaaagaaaagaaggggcuagaucagugguucacgccuguaaucccagcacuuugggaagccgaggagggcggaucacgaggucaggaguuccagaccagccugaccaacauggugaaacucagucucuacuaaaaauacaagaauuagccagguaugguggcacgcgccuguaauccaaccuacucagcaaccugaggcaggagaaucgcuugaacccgggagacagagguugcagugagccgagaucgcaccacugcacuacagcuugggcaacagagcgagacuccauuuccgaaaaaaaaaaaugaaaaaagaaaaaaagccgggugcgguggcucacgccuguaaucccagcacuuuggaaggcugaggcgggcagaucacgaggucuggggauagagaccauccuggcuaacauggugaaacccugucucuacuaaaaauacaaaaaauuagccaggcaugguggcgggcgccuguagucccagcuacucgggaggcugaggcaggagaauggcgugaaccugggaggcagagcuugcagugagcugggauugcgccacugcauuccagccugggcgacagagcaagacuccgucucaaaaaaaaaaaaaaaaaagaagagagggaggucucccaaugagagaaacucacaugaguaaacucauauagcuggcaaaguccuagugagaucagaauauagaaucuaguuuuaccacaaaguaggauggccuugugugucaugugaucaugaacacugaggcuauacuacuacuacuacuacuauauggaaagguagucuaggaucagagucuucaauuguaguuuaggaaaacuauuuauuuauuuagagacaagaauaggggcucugaaaucaggcugccugaguuuaaauaccagauuugccacuuacuagcuauguacccuaaauaauuuacuuaaaaucuucaugccuuguuuauaaaauggcaauaaaaguaccuaccucacaggcugcuacaaaaacucagugagaucauguaaaaugcucagaauagagccuaacacaaagcaaaccuucaauguacaguggcuaguguuaugauuagcaauuaucagacaaugaagaaccacugaugauuuuuuuuuuuaaaagaggucugacaugaucagaacuauacuuuaaaacagucucuuugagucuauggacaaaaucauacugaaauacuguaugaguaugcaggaacaccuauaauauuuuaaggaggguauuuuuuuuuuuaaagagagcacucacauucccagucucuaugaaagccacccgucuccagcuuccuuugcaaugguucucagugcagauuccuuauuuauuaacucuuaagagagaaacuagucauacuaugugaguucuuuaaacaccuaauauuaacaguuuagauaggagauuuuaacucuuuccauagaaguauuucuggcaucuuaaguauacagaauauaauuuaaccuauuuugauaacuaaaaauccuuaugaauauccguacuaugcuucacauacagaugugagcugcacagucaaccuuaucugaacugaaaacauuucccauuuuuaccuuuauuaugaaauuuagaagcugcacuacacagguaucucucuucagagcuauccucuguguaugaacagugcuguucuugggguccacagaagcacagcugcagucugucuugucuucccccucccucugcagagcucuuugguuuccucauucuuuccagcuagaacuuuuuucuucccuacagcagguccugcaguuuccaacauucaccaaguauaguacacuaacgucucuuugcaacuucuaucauuucuucagcacuuugucuuaguuaucaaccaccaucccaaaacuccuuaaaugaaguuggaaaaagacauuauuuuaauuucaaaacagagcuaccuauaaauaaccaaaagaaccaaauaaauauuuacugaauauaaguucuauguguucacaccucucauugcucaaggcuaucagaaguuugguccugagaaaacugaaguucugcuacuguaaagcuaccauacaguaagagaagcuacacuucaagacaacagacuucaguuucacucuuacuagcuguguaaccggggacaggucacucacucaaucucagacucacggucggucccucuacuuaccucacagggcuauucugagaauucaauauaugaaaacaaaauucaaaacuacauacaaauggaaauuuucugucucuucugucuauucucaacuauucugaagaaagaaagcaaggucuccaauacaauaaaggaauaccagggaagcccuuacauuucuuacuccccuacauauauuauaccaauuacauacucauuuugauaaacaagcuccucuuucaaauaucuccugguagagcuaacccuauuguucauucaugcuuuuguauacugcuuugguaucagauucaacacagcuugccuuguauuuuaguuaacucugcacaugucaucucuucacgagaucagugauucucaguaucuauuuuccagaaguuguacucugaaaugucauguucaguguuacaaauuuuacuuucuuagaaugccccauugcuuuugguaugcaaacuuccagaagcaaauauccacaaaaucuuaagacaggagagaaagagagaacuagaaaaaccuaagucucaaugaaugaagaaggaaacaguuuuacaaaaugcuuaccuacacagcacuuccauguacuucaucuaauuuuauuuuaaacucagaacaacucugugaauaaaguauuauuauggaugaggaaaacaggacuaugaugacuaaaugggaucauuuucuuuuugaaggcgagagcugagagggaaaaaagacaaaagguauaagccagcauggguuacuuccugcuuucaagugccuauuauucccugaauccuuacuuuuccaucaucaucauggaauccacagcaggaucuucuauaugcucuccccuaauccugaaggauuuccauaaccaguccagacuacacgcucaaauuguuuucaaagaguaggugaagaaaagguaauuugcaauuaauuucuaucucugaaacugagguauuuuaaauggauuacauaauuacaugcuaaaacaagccuccauaacaaaguauauuaaaugcaacuuucuauaccaaaagcaucucugaggcuguaaugcuguucuuuuagaguauuuucaacaaaacuucaaaagauuucacagguauuugucuacaacucuaguuugccaccgggcuacaagaaaagacaaaacaacaacaaaaacccuuaguggauucguuuuggucacuuaccacuuucauggcccugaacaauuaaaucucuaggccuguuuucuuauuuggaccuguuuuuuuuauuuguaaauaagacuaguggccaggcccagucacucaggccugcaaugccagcacuuugggagaccaagacaggaagaucgcuugagccaggaguucaagaccaaccagggcaacauagcaagaucccaucucuaaaaaauuuuuaaaaauaaguaaaaaaaaaugggacuaguaccuaucuaccuaucagaauuguuguagguauaaaagauauuacaucccacagacacugcccaauccacaucuauacaaguucuuaguaauuucaugcucauucaacaugaaauacuauauugaucaagacaauagaaaacccauuaauagcagaagcagucauccacaaacuguuuuaggaguacugucaauucaaauaaguauuuaagaugagucauauaagauaagucacauauuaaaacgacaucaucuaaaaauucuuaugaaacuuguuuuccuaaacuuuggugcuucauaauuucuauuaucauuuucuauggagaaacuagaaacauaauuuucuccauaaugugguucacugaguuuacaaaacuaagaugaaacuagaaagugaaaucaaaacuucauucuauaauuuaucagucgaguaagcacaaacaauauuuugcuuuaaagugguuaaauggcuccucaaaaguauaagauaaacuccuaaacauuuuuacauuaucuauaaaaacuugugggaaaagcuuuuuuuuaaagcuaugaucaauaacuuuuaaaaacucaaccacaauuauggagaaaauuauguuucuaguuucucuauagaaaaugauaguagaaauuaugaagcaccaaaguaaaugcugauaaguauaugaaaaaugugaauguuacugauaucaggcaauuaauaagaauauuagaguaugccauuuuucccugaauuuugugauaugcagguaucuggcagcuuuaauuuuuuuuuaauucauugugauuuauuuuuccauucuaaguaaauacucacuuucauacuuaacagacauaaaauuccuggcauugacucuuuuuuuuuuuuuuuuuuggagaggaagucucguucugaugcccaggcuggaguacaguggccugaucuugucucacugcaaucucugccucccggguucaagcgauucccuugccucagccucccaagcagcugggacuacaggugugcgccaccaugcccagcuaacuguuguauuuuuaauagacaauuucacgacguuggcgaggcuggucuugaaccccugaccucaggugauccacccgccucagccucucaaagcgcugggacaggcgugagacaccgugcugggacaguaguaacuucuaauggauaauguaugcgugggguggaaaggggaguaccaguauuuuuauuucaaacacauauacaaaacaccagcuugcaauucacccugaagaacccucagcacagagcaguuucauaaguccaugccaucgugccauaugccuucuucacuggccacuucgauuagugaggaaagaauccaaagaaguuaaaauauagugggccgggcacgguggcucacaccuguaaucccagcacuuugggaggccgaggcgggcagaucacgaggucaggagauugagaccauccugcucaaaauggugaaaccccguuucuauuaaaaauacaaaaaaauuaguugagagugguggcgcucaccuguagucccagcuacucaggaggcugaggcaagagaaucgcuugaacccagaagguggagguugcagugagccgagaucgcaccccugcacuccagccuggcgacagagcgagacucccucucaaaaaaaaaaaaaaauauauauauauauauauauauauauauuuauacauguauauguuauauauuuuauauauauacauguauauguuauauauuuuauauauauacauguauguuauauauuuuauauauauacauguauauguuauauauuuuauacauauacauauguauauagugaagaaaacaacucuuacagugacaguaucauguuugacgucugagagguaugcccugugaagcacacaggauagcggagacauguaggugggcaauccugggagaagguacccuuuuaacuaggguauguaguuaggaguuugagaaguuaagaaagaggaaggguuuucgagacagaaaagauaaguagguuuacaaaacuaagaugaaacuagaaagugaaaucaaaacuucauucuauaauuuaucaguagagaaagcacaaacaauauuuugcuuuaaagugguuaaacggcuccucaaaaguauaacauaacccaaaaacuuuagggaguggauuuaauucucaauauaauucaaauuuccuugaaauuuugucaacuacugucuaccuugcaagaacugaguuuaaccaaggcaacugaacagaugaccgacucuaccacacucauuugcaagauaaaggaaaauagcaaaaaaaaaccaaaaguacaagacauacauugcagauuuagaucacuguuaaaugaccagaaaaguauuuccaauguuaaaauuauucuaauucucaaaaaguaccuuuaauuucaaaaccacuauuaggagugcuuacggcuauucagagggaaguauuaauaaagcuaaagccuccauccgagcuguuaguaggacuccaucgcuucccaguauguauaacuccuuuucuaagccuccucucguccuggcaucaguggcaccaugagccaaaaacaaaacaaacagaaaacuugaguauuaccucgcugucagugcuccuucuaaaaacgacuguagcugaaaacucccuaagaaugaacucgaguguagagugcacagcggagagugaaacacccuagacagcacgcagcauuuaaagcuacaaaaaccuggcuguccacuucgccugguuuguuuuguuuuguuucaaucggccugcgguggcagcauagguugaaaggcggagacuggaaucgccugccaagccuccucuuugggucacacagagcggugccucccgguucacgccaaguccaucccccacccucuuucgccauucaucgcguuccccucccuuccccccaucaugugaccgcagcccggacuccgggcuuguuuuuccccucggcucagccccagcgcgcaggcgccugggagcccauucauucgaacugcguaacaaugagccccggggcccagcggcuccgcgagcuccucagcucagccagaaucccccucaguccagaaggaggcggcgccucacuggggucccccaccuccggccagccccccaccccuggccaagcuccgacccuccgcccacaaacggggaguugaagucaaacuuuccugggcagccccggcgcugcgucggccccuucccccgcccuggcccgccccaucuccacacccggcccggccacccaccgcgcgaccuggcccggaacuucgcccucccccugccuccucccggcccccgcccgagacccccuagcgccgccgccccgaagcccaggugagcucgcgggagacgcugcuccggugggcucgccgcgggcaccaaucgaacgguuaacugcccccaccccaagggcaacccuccgagaagaaggaacgaggacccgagcccuccagucugcccaaucccccgcgcuccugccccucccuuccccacccccaccucuucccuaacugaaagacaacaaaccugccgcgaagugccggcagcccaggcgcgggccgcuccggccacgacaacaccaccagcagcucucguacccccucuccgaccgacgucggccucccccgcgcggguuacugcucccgcggcagcucuuacuccucaaccgaaacuuuccuacuuaccaaacccgucgccauuaccaagucuuuc

SEQ ID NO: 21502 - RNA, 2784 nt, Homo sapiens
ucccgcccgccagcgccccagcgaggaagcagcgcgcagcccgcggcccagcgcacccgcagcagcgcccgcagcucguccgcgccauguuccaggcggccgagcgcccccaggagugggccauggagggcccccgcgacgggcugaagaaggagcggcuacuggacgaccgccacgacagcggccuggacuccaugaaagacgaggaguacgagcagauggucaaggagcugcaggagauccgccucgagccgcaggaggugccgcgcggcucggagcccuggaagcagcagcucaccgaggacggggacucguaaguggcggaggcccggggcugggggucgucgggagggcgggacgcgcgcggccugggggugggaggcgccgggccuggagcccgagccgggggaccagcgaugcagccgggcgggcgccgcggcaccccggggcuccugcaccgccccgaacgcugcagggcugcagggccgcgcggggcaccggcccaacucggaggggcggcggcugggcccugguggauggcagcgucgccacacgcccccuccccccagacccguccucuaggccgggggcggggcggcagcggggacgcgaaguccccgguugcauaaggcggggcgggaguuucuggccgcuggcgggcgccgagcagccgggaggggaaguacagggcguuccgagcuggcgggagggcggggcggucuggccggcgcccgccggggccgcggggggaggggggcggaaagucccugggcgccugccaggaacacucagcucauaauaaccucgcggaaaacaccgcggccucggccuccagaaaccccggccuugcgcaaucccccgcagcccgcgccucccugggccccacgcggugcacucaccaccccugggguuuuucccucucuuccccacagguuccugcacuuggccaucauccaugaagaaaaggcacugaccauggaagugauccgccaggugaagggagaccuggccuuccucaacuuccagaacaaccugcagcaggugcgccgcuugccuggcccggguucucucugacccugggacguagcugauguagcagagucaccccagauccuuucugaauucagggccacugagcacuauuuacccucaccuuuuacuucacaucagcccacauccuagagagugaaggaaauuccacugauuuggugaggucuuuaugacccaccuggagccucugcuauuugccagcccuccccaccccccugucuaggaggagcagcacccaaccaggagacacggguugaggggaacucgggguguggguuugguccauggcuuacuuucucuggucucucuugcauucguagacuccacuccacuuggcugugaucaccaaccagccagaaauugcugaggcacuucugggagcuggcugugauccugagcuccgagacuuucgaggaaauaccccccuacaccuugccugugagcagggcugccuggccagcgugggaguccugacucaguccugcaccaccccgcaccuccacuccauccugaaggcuaccaacuacaaugguaugucugccucccugcccugccccacccccucggagggcaggugacguggagaaggggcaggugggccaacuuaaggaguccaggcaagagcuuaaacuccuaacauuuggaagguugagaaaauaugugugcaaagugccuauuggaugccuuuauaaaguucuuucagaacccagacuguggguucuuaaaauucagaagauaagacuacuuguuccauaaaagaauaggugaaaggagugaggguugaaacaggugguuauacuuuuuuccuuuuguucuuccaggccacacgugucuacacuuagccucuauccauggcuaccugggcaucguggagcuuuugguguccuugggugcugaugucaaugcucagguuggugcuuccugcccccgacgcacugagucaggcuccucgugcuuauguugugagcagaaauuccaaaugcagccauaagcaucucaaauuccuuuugguuucaggagcccuguaauggccggacugcccuucaccucgcaguggaccugcaaaauccugaccuggugucacuccuguugaaguguggggcugaugucaacagaguuaccuaccagggcuauucucccuaccagcucaccuggggccgcccaagcacccggauacagcagcagcugggccagcugacacuagaaaaccuucagaugcugccagagagugaggaugaggagagcuaugacacagagucagaguucacggaguucacagaggacgaggugagucugugaacuccuucggcgcucuaacuaaugaggugccauucccuucacccucccaggccccuagagcugcuccuuaucagagggguaucuacauaaugagucucucaaauuucugugcauaaccaguaucccaagaauguaccugcccccccucuuuuuuuaaagagaagcauuaaaggcaaacucucucagccuguaaaguucauuauauuugggcuauggagaauggaguccaagaguuauuuccaguaguggccuccccaucccgguagcuuggcagagcuccgcuccggaagcuuaacgugucuuuuuuccccuuguuuucagcugcccuaugaugacuguguguuuggaggccagcgucugacguuaugagcgcaaaggggcugaaagaacauggacuuguauauuuguacaaaaaaaaaguuuuauuuuucuaaa

SEQ ID NO: 21503 - RNA, 13495 nt, Homo sapiens
cagacagcucuuaccacaugauacaagagccggcugguggaagaguggggaccagaaagguaaugcuuuuuaacucuuacuucugagcucuuuacacauucaaagauaggaaagcuaggaggaauuuuacaacuaauuggcauuuccaaugugcauugugauguguaccuuuuuauauuauucaggcagguuaauacagcuuuuaauaguccuagagcaugcaaauagauuauauguuuauacaagccacucagcacauauauacaaguacauaugccaaagagaaagcuauuuuuaagaguuacauucgcaaacaguaaauucagggaacacacacauacucagaugcagagagaauccaaauauugauaaguugcacuuaucuaaaugcugcuauuaggacuccugaguuguuuagagccauuaaacuuuugguuguauuucagacuuucuuguaaaacuuaauugaacugcaaaacauuuuggguacuguauaugugacuccaaauagguggaugauguuaaguauuauagcacaaagauuuuuuauaaaaccauuguaacacaaauguccccugccucccccauucucuuucaccauccccguaaaaaauaugaggcuuuuuaggcaauguugacaaaguuuuaacaauaaugguggaguaauugauguuucuggagcugaaaccccaaagguguuagguuacuuguaacagaaaaagucuuacaaauaguuguuuuggaaaaggggacaguauauauaauucagaaagcauuguuaaccugugcaaacuguaauuauaacuuagugucacaauuuucuugcccucuuccccuugcacucagaucuuaucuuguaguaaugauauuuauuaacucuuuccaccuaaacugcauugcuugacuguaaugcuaugaacacacuaggugucagauauaagcugaguguaucuucagaaaccaagagggcuuaugugugggaaagaaaccgagagggaaggaacgcuuuaacagauggaccccuuaaagauucuucugcaagauaaaagcaauaagacagaaaaugaaaaagaggggagggggaagaauuuuuuuuaagccuuagaaaggcauuguuaaaaaauucacauuuuucuuuuucugugcacacuaaaauccaugaugauuucaucugcacuguuccuuugagggaaaaagaagcagucaaggaggcugucuaugaaugcacuggucgggacaggcuuggggcaagcugaaaaaacuaccacaugacagagaaaaauaauuugccaauauauuuuagagagucuuuucccauaggaccaguuauucaagucauacgagugcacucuuuuuauaaaaggaugugggaaaggccaagagaauuuugcauuuuaucugugaaguccggcgaguggugguaggcuguaaugugugagagugaguggguccccggcagaagggggcagcugaacgcgacggggagaaagcgcuucuggaacuugggcuugugacaggcugccugcccucugguccuucagugcccugcugcauuucacaguugggaagaguggaguguauuauaugaccccaaacaaaaguuccauugcgcucuccucagauugccugccaguguugaugaccugaacauuuaaauaugaaugaauugggggaaaggaccaucuccccuggaucccaucaggccagaacaauccucuguuaccccugagucccucuucccugaccuccacuaccuguccacuggaccucccugcacccucugccccaccacguggccaggugggcguucuaccaccuagggcuguggcuuggcuggguggaggggcggugggaacacuuuuucaaucaauucaucccuauugauugagacacuguguuuguuugggguuucuuuucuccccuccaaaaaaggaagaaggugaaaccaggagacugggcagagaaagaaaaaaaaauagugaacaaaauuaggauaauuuauuuuagaagagaaaguagaacccccgaaaauggugauauuugaagagaggugucugugaggaagcuaagagcagaaggagagcagccugucagaaaacgggcugucccucccucccuaaucacagcccuacucacagcaaacucccucccucuccauucacucacuuacuuagggccaauccuuucucucucucucucucucucucucucucucucucucuuccuuucccucucucccucucccccucccuucccucccucucucccucucucucccccuucuuucccucucucuucucucccccucucuccucucucucugucucugucucccucccauccucucucucugucucugucugucuccccgccacccugucucucccucccucccugucucccucccucccucccuccuuccuucucucuuacucggagacagucagaacucuccucccugacagccacaaaccuacagcacugacugcauucagagaggaaccugcaaacaaaacuucacagaaaacuuuuuguucuuguuccagagaauuugcugaagaggagaaggaaaaaaaaaacaccaaaaaaaaaaauaaaaaaauccacacacacaaaaaaaccugcgcgugaggggggaggaaaagcagggccuuuuaaaaaggcaaucacaacaacuuuugcugccaggaugcccuugcuuuggcugagaggauuucuguuggcaaguugcuggauuauagugaggaguucccccaccccaggauccgaggggcacagcgcggcccccgacuguccguccugugcgcuggccgcccucccaaaggauguacccaacucucagccagagaugguggaggccgucaagaagcacauuuuaaacaugcugcacuugaagaagagacccgaugucacccagccgguacccaaggcggcgcuucugaacgcgaucagaaagcuucaugugggcaaagucggggagaacggguauguggagauagaggaugacauuggaaggagggcagaaaugaaugaacuuauggagcagaccucggagaucaucacguuugccgagucagguuggugcuggcauuggcaggggguggggagggguggggggugggaggguaaaauauauuucuuugacagucccaggaggaacuucuuuucccuucagcuggaaacugccugggaagguuauuaguuauuaggugaugguagcggacuagccgacggagggcaggcaggggagggggagaggacuuuacagaaaaggaauucucggucgagcucugccuggagaugacuggcuuacacuuacuaaacccagcgggucacacagagaggaagcucggggccaauguugagcuggaaggcagacugugaggggcugccuugcccugccugugaaaccagaucugagcagccggaggaaagccgcggcauuuucgggugcuaggggagcagaggaggcuuccggaccccauccaaguuuuuauugaggguagaggggugaauguaccaggauuggaguggaauggcacagaugaagucacucucuuaaaacaaaccuuccccuuuaaaaguccaaucuggggccacauuggagaagcagggcauauuuaugagugacagucauuuuuaccuuuagaaaaugucuauaagugcacaggcaccacauucaagacagggaagagcuacuuugggggacaguugucauugaaccagcaguuacuuuugggacacugacuuuugcucucugaaagaaaaaaaaauaaauaaaacaaccaguuuuguucuuucuaaaguuacuaagagcucucugccaaggaacgcaaccuugacaaaguacucucagauacuacgcugaacucacucaauccuuaagaggaagaacuuuaauaaauagauucuaaucguuggcccaggaccacacuaaccuguugcugaauagcaauaccugucaaaaguaugggcccauggacuuggagccaggcuauuuuuauaguuaagugacacagauccuuugcaugccugcaagcccaugcacgucaggcacacagauguguuaauaccguguuacuuucaugguaaugccaggcuaaagaauugcauccuuugccaacuccauuugaaaggaaugccauuguuuuguuugguagagcauauggccaguaaaguaugugcagggacucccagcauuuuuguuuaaaaguuugccgcagcaguauaaacaauuaaggcaacacucagaauuuccaaucugaaaaccuguugacucagauguucuguuuucaagaaaaccaugaaagaccagggcaucuuuccgggggugcagauagccugcuggcuguguggcuuccccuugcaggagaagcccugguguccuacaagcuucccaguuuggcucucucaccagaagccucucucacuuagggaagauccuacuuucuuucccuaaagcucuuucuuaacccagccccaaaaggcaugaucauuaggacuuuaucuucuggagcuuuuugaggaagaaagcuagguuggaacuuuucaaguugacacccauuuuuuuuucucaacuuuucauggugggaaaagguaaaaaagaaaauauuuacaauauuuggcugugcaugugaaacagauuucaguggucuagaggguugcuuccugucuuuguauaccaaccuccacacaugauggauucaaugacagcucguauccaguugccuuuaaccaugucauaugacuaaguauaccuaugccuuugaccacuuuuaaccgcacuaccguuacuagcaauaugccccucuuucugacuuacuggacuuguauagcaaaucacucucuuagcauuuagagauuuggcagugaaaaaauuugaccauuuacauucuuucuuauguguggucuuccuuucugugacagucuucucucaguuguaugagaucuugucauuuuuuuacuucucaguuagguguuuaguuugaaaaaaaaugagcgacuuuugaaaaagcgauucguuggacguucacauugagucaaguuuaagauuuguaaugggaaacuccugguugacuuuacaacuugacuuuggauucuuagaaaacacuuauuacaauugcuuauuuuucucugagggauuucacacaucaacuucaaguugauuuaauguaauuucauguauuuaaugauugcuguauggacugucuacucuucaagcagaaaaccacgugagcauuuugcugcugauuuugcuaguccagaaaagacauuuaucauccaaaugauuguagcaaauauaugaacaugaauagaaaagaccuaugucuuguugcuuuuggaauaauucaacuuuaauaacauuccaacuauguggaaugucaagaguuuuuggagaauagaaaaaggaaugcauuuuucuuucccuuauaaccauuuugugcagcauagaauccagacauugucacccaugagcaugccacagaugcagacccauagcagccccuuucaaccucaagauucuucaauuugaggcuacguuuaauuuuugccuuuucucuccuugauuguuggauaaagccaaggccuggcuacagaaguagagagccuccaaaagcugaagugcugaggacucuuuuaacugaguuugucccauccuguuuagguagaaagugcucaauuuuuguaaaguugaugcgaguuguuauugacuaaacagcagggaaucacucuaaggcucucugaaauguaucccaacaaacaaaaauuauuuuauuuuuauauaugucacaucacccaagauuucucaccaagguuaguguguucuuugcauggcuggcacaaaacccucaauguuuuaccuuaaggccuacagaguucuucacaaggaaagauagaagggauggguaaagccaagcuaucacuauaaaugucaugaagcuaaauucaguggccuuuucagcugaugcagcuuauuuuuauuuuauuuugacucaugacaguagguggucaaucaaugcauaauaauaauguaccucuaagucuccauaugcugucaaaccuggauguggguucugguaauuagcuuagcaauugauagcacuuguuguagaaagaauagggaaagaaagacaaaugacacaccaagaaauggaugugcucacguagccuagguguuguuaagcgcaacacauaagucuaccccuuggaggauacuauguauggaagauuugaguuagaaguuugcacugcccagacagggauccaagaagcuuugcuuggaugaccauuuuccccaccccaagaaagccaucucaaaaugaagcugacucccaccauuccaaucccaccuuccgaacuuuucugugaaucaccccuccuuuagggaugccuuuagggguuacacgcucucuuccgugaauaauggggaagagcggccacaagagggcgcguuccaaagacuuuugcuccuugucaguguauccagggaaaggcaguugcgcguacuggaagccccugucuguagcgcccuaaucuuggugauuaucaguuaccgccugcucccucucauccugcagaaaaaguuaggaauuuaugagaugggagaagcaugacuaccuguaauacauuaaaugagacagaaggaaaggaaauggaaauucuagugauacaugugaacauuccggagcucuauggaaggcagacgagugauaaauuucaaaagcaaacaaagcggagcagggagaaaugugacuaugaaucaucagcgauacugauuugcucacaagucucucccuaauacggucucccgggucguaacaaaaacaucuuccaucuccccugauuuuguugccuaguuuuccugccuuaucaacaguuuccaccagcgacaaaugacaagugacuucaaacagggaggaaaaagguucuuucuguaaugccuugugggaacaugguguucggcuucugaggaugcguuuguuuccgaacugaggguguggagagaaauggugggaaagaugggaaaagagauuaauaguggucugcggccugugcaguggauggacugggcugggggugguggagaugccaggguggaaaguccguuguaauauuuaaagaacugcaguaauaccuucccaggcacuuuucuugaaaacacauauuugucuuggccccucuucugcuaaaaaauacuugcacgugaucuccuagcuguaguucugaauucuucguacucgacugguuccuaaguccaaaaugagaagugccaaaguucucaggaacuuuggaagaagucucugaaauuuuguggguuaaaccuuaagaauuuuugcuacuuguaggaaccuaaaaccccuuucucccaaaauauuuaaccuuuuucaucaccacuuuaauggaagaggcauggaugauggacguuugugccagggcauuuauaaaucaauaauggacccuaaggagggaaauuaaagcuaaaaaauuaaucaagauaauuuauggccaaaccuauaguucuacugcaggaaagauccucuacuguaggucaaaggaggaauaaccuuaagaccucacuugcugcuuucugcagaaaccccuggaagcaguccaaaugcaaaguuagggcuucagagaaugcacccuguaaaugguaguuguguauacccuuaccauugacuauaccauaucuaggcacagugaaaucuugaugaagaauggaaaauuaaaggaacagacgcuuuuuacagggaggcuucccccagcccccaucccaugguaaguuuaaauguguucuauaaacaacgaggcuuuccacauucacauuagagacauaacuauugcccauauguaaaagagcaacauauuuuaagcaggacccuggugaggaaaacaaaaccaaaucgaaacacugcauguguguguugcuuauuuaacugaaaauguucauagacccacaaaucugagaugcuggacuuuuggaugaguccagcauuuugcaucuuaguguagggggagggaacaacaaggggcuuaguugcuuaacccuugccaugccuucaugauugacuuauucaaaacauuuuuaaaauucugaaagcaaaggaaaaugugcugcaaacacccuuccagcuaucuuuccuuccagcuuacacagucucuccucuguccaauccuucccacccagcagcauuucagagguauucccugugagguacaaaauuucucuuugcccauuuuucugcaccucuuuuucucucucuuugguauguguccaccaagcucauagagguuuaagugaugaaauauuaucacccacauggguuugcgugggacuuucuuagugaauuacucaggcagagcaggcugugauacagccuugcucacaagccucgggagggaaaaaauagcacagaggaugaaaagaauauuauuagagagcagguaaugaaagguucgcaaagcaaccagcuauaucugguuagcuagguaauagugcaggaaccuaggucgcaccuguacaaacuaaugcagaaccugcucacggcgcacuaugggaagacauucauuucaagaguuuacagcaugagauauuugaguaaaaccugaaacugauuagaaauugauccugaacaucccagccuuagucaaccuucccuuuuucaaauuguuaugcauggagauuggaggauuggggcaucuugaaagugucacugcaguauagcaaucucucucagguaauauagagauaaagggaauauaauaaauugaccuguuauuuauuaucuuuuucauaccuaggacauuccgaggcuuaauauauuucugaagccuacagcccugauaaacaucaaucccacgucaguuuccagcagucucaucuccccacacccuucugcaaugaaagcuaauguaaaagaaagaaauaugcacugcuuaauaagucagaauacaauagaacuuguaaaauguaccugcauauaagguagacauuaggaagacuugaaucucucucuucccccuguucuccugagcauuauggcaacagcauuuucaugaaauuagaucuguuuuauauuuuuuccugauaaaauaucaugcaauauacaaauagcaguuccagaaauggacaccaggagaaggaggcgacaggcaugucaauuaguagggggaaaauccaaaugucagaaauaugggggagagagaaagcacgcaggcaguggaugcaaauacagggaacagagucuuucaauucagauaauuaaacggaugcauaaaucagcacccuugccucucuacaauacgcaggcgaugccaugcaguuaauuaucagccaagaccagcaugaaagucauuuuaugaugacucucugauccuaauauaacagcaccugacagauugagcccccucuaaugaguacucucuuuguacaauccucucucaggaacacuaaaucauuugcuuccaaguacagcugccugugaagaagggguggggcuagaucaugcaucagaaaccugcucuugugaaaucaggggcuguccuguaggcugugugacuggaagccagcagccucagccucucuggcccuaaaaaagcaauuugcacacggcugucccuaauucuagucagccaaguaacccucccucggcacccccaccuaaacaucuguagucagccuuggguguuauucauggaaaguccacugcaugcgggucagcacugcuguccaucggcuucacccugaccccuucuggcagguguggaugagaguagagcagagcucauggggaugaguuaccccaaaccuauuaagccucccuauccggggcacuagucagacacuccaguuuuacacucuuuccuagaaaaacaaaacccaaccuugugcccucuggguucucuaauuuagcagcuacuaucugucuguuuuuggagugacacccugugcaguuuaggauuucagaagcuguccugcauagaggcagaagggaaaacagcagguaucuuguuaacauucucuauggggcaaggcagaugugcccaagcuggaggaaaccugcacacccuccaggcuaguuauccaaggcuugggagguuucccucggccuucuccuaaggccuuggcaggacccugccacccuaaaaucaacugcugauugccuuuuuagauuuaaaugauuaagcucugcuuaugggaaucuucuucucuuuuauuuuguuaagaaacaaacaacaacaacaaaacccacaccaauucuuagcaaaggggaauaucgaauucagauuuugaaaaaauaagucaucaugcuuccuaaaauaagacagcuucucccucuaacugcucucucugcucugguauucuaucuaaucauaaacccagcuuuauuauucauuucaacuccugccaaagacaugaggucggagucagaggaacuccccuuaccaccgccaccaucaucauggccagcauccucguaaguuuauagaaagaugccagagaaccuuuccuauccaucugcagcccugcuuggcccuugccucagugaauuuaccacuaucauaaucacagugugcagaguguguuaaauuaagaacagaauccacaguacgcaaugcacagaaaagccugccuucugcugcagagaacuugaaacugugccuaaaauuuauaguaccguaaacaucucagggccucgagugauaaguauggcuggauuuccguuaacuauagaaauccaggcagggagauccucccagggaguugcaaguucuaagaugaacuucuugaagauuguucccagauuugugcaugggauacauguacagcagacaguuguaaggagguccacggucauggaaaagaggauauguuucuauaugccaccaagugggaaaaauggaagugagggaaaauauuugauuaaucaaaaaauuuuaguuuggauaccugcuuucauaguaauuguugcugugucauuaaacauacaguugcuuaggaaaagagaaggaaauaggugacuuucuaauuuuagaguuaggcuggaacugagugguugcuaaauucaacugcccugacaauguggggauuuccuguccauuagcagcgauugcuauuugacauauguuucuggugcccauuaaucugcccuguaaugggucagaggcaaaaaugggggauucagagguacuagguggcucucuuaauuuaauagaacucaaugcuaaggacgccucuauuuguuaauaaguaaucaagucauuggcuacuuucugcuaaacacuagacuaugauagugaccuuagaccccgggcauucuaaaccaggcuggcaggaggguggugguggaggugaugugagguaagccuccuagaggaacugucauccaaacaaucugaaaauugaaacauuauuaaaggcagcacuaagggugguauguuggaguuggggcaggagcacuuaaggcagaaggaacagcaggugucacugccugcaguugagaaaggggguggaauucucaaggccuuagaccccagagaacaggacugggcaagagcugacauucaagggaggaacagcauguacagagcccaaagucccagccacuuucuguuggauacugagcaauaggaauucaguaaaggacuuucaagaagaagugaugugaucagauccaccugugggaaagaugccuuuagcugcuucauggagaaaugacuggagaggaggccuuccuuaguguugcagaggcaaaguaaagaaaaugcugcugcagugacccagcaaagaggugauggcggaggaaucaggcugugacaagggaagaagaggcuggcucaagugugucucgacugcacagacuuacacagcgagguggggccaggggcugcauuuuugucugagaauaguauuuccuuagcuuucuagagcuuacagugucuuuuuguuuauguuaucucauuugaccuuccuaaaccugugagauaacaggucaaauguccuuaugucauucccauuuuuauagaagaugaaacugagguugagcaauuagucaacagacacagacucgcaggcccucuucauucuaaagcaaggguccaaaaccuuuuuucuauaaagggccagagaguaaauaauuuaggcuuugugagccaggcagucuguugcagcuacgcaguccuugguuauuauagugcaaaaacagccauaggcagcauguacagaaaugagcauaaccaugcuccaacaaaacuuuauuuacaggcacuaauguuuaaauuucagguaauuuucacaugucacaaaauaucacuuuucuuuaaccacuuaaaaguauaaaagccauucuuaguuugcaggcaguacagaaacaguuucagcccaugggcugucauuuguugaccccuauucaagagggucugucacagaagacuccugcuugccugaaauuuacgagugcauguaaauguuggaauuaacaggugugccuguuuucucuuaugcugucuuucaucuucaggaacagccaggaagacgcugcacuucgagauuuccaaggaaggcagugaccugucagugguggagcgugcagaagucuggcucuuccuaaaaguccccaaggccaacaggaccaggaccaaagucaccauccgccucuuccagcagcagaagcacccgcagggcagcuuggacacaggggaagaggccgaggaagugggcuuaaagggggagaggagugaacuguugcucucugaaaaaguaguagacgcucggaagagcaccuggcaugucuucccugucuccagcagcauccagcgguugcuggaccagggcaagagcucccuggacguucggauugccugugagcagugccaggagaguggcgccagcuugguucuccugggcaagaagaagaagaaagaagaggagggggaagggaaaaagaagggcggaggugaagguggggcaggagcagaugaggaaaaggagcagucgcacagaccuuuccucaugcugcaggcccggcagucugaagaccacccucaucgccggcgucggcggggcuuggagugugauggcaaggucaacaucugcuguaagaaacaguucuuugucaguuucaaggacaucggcuggaaugacuggaucauugcucccucuggcuaucaugccaacuacugcgagggugagugcccgagccauauagcaggcacguccggguccucacuguccuuccacucaacagucaucaaccacuaccgcaugcggggccauagccccuuugccaaccucaaaucgugcugugugcccaccaagcugagacccauguccauguuguacuaugaugauggucaaaacaucaucaaaaaggacauucagaacaugaucguggaggagugugggugcucauagaguugcccagcccagggggaaagggagcaagaguuguccagagaagacaguggcaaaaugaagaaauuuuuaagguuucug

SEQ ID NO: 21504 - RNA, 91881 nt, Homo sapiens
gaguuucgcgggaggaccuuggcgcguaaaccguaucccuucauucauugucagcagcagcuuccuggagccauuuuucagcugccggccgcagcacccgggcugccgccgccgccucgcaauccguugcaucggccgcccccgacgccuccauccccgcuuggggcccgauauccgugcggccgggacccuccucucuccagagccccgauuauuuuuggcccccggggccugugcggugcggaaaaauaaaaagaaaagagagagagggggcucggaagcgccgggcggggaggagagaaggaggagagacuuggaaacuccgacugcaaauaauaaagaaauugaaaacaauacauuaauauaccauaacacuaaaaagagcaggagcgagagaugagaaagggaauccagcccgcucuggagcaguaccuggugaccgccggggguggggagggggcggcugucgucgccgccgccgcugcagccuccauggacaaaagggcacugcuagccagccccggcuucgccgccgccgccgccgcugccgccgccccgggcgcguacauccagauccucaccacgaacacuuccaccaccuccuguuccuccucccuccaaagcggcgccguagccgccggcccccuccuccccagugcccccggcgcggagcagaccgccggcagccuccucuacaccacgccgcacggacccuccagcagagccgggcugcugcagcagccaccagcgcugggacgcggcggcagcggcggcggcggcggcccuccgguaauacccucccuccccaccguccccagccccggcgggaggugggcucgcaccgcgcggggucgugggcgcgcugcgggccgcucggggagagcacugggccgagcaucgugggccucgggggcugccccuccaacgaggguucauuguuagaccugagugcucuucccggcgccaggagggucggggggcucggccaggcgcgcggggcggcggggauugccuuggcgcgaaccacaucaaacacuccaaaacuuuucgcggcccccccuucuuuuccugcacuuuucccuacccccacucucccuuccccuccaacucgaagcuuccucuuucucgggcguaggaaggggucacgccccggauggagaagggggugggggagggaguagugaacugggguguggggggcucugagggguugaaaccgggggacuguuggggugcuagcccccagucggccuuggaggcucguuggcggccgggggucccugcggcgugcucggagcgcaggggaucggcggggcugcgcuugacacauuuuaggaucuguaacucccggcaacaaaggggcugggggagguggaggggagucgggcgugggggagguggggcuggaagccgggugcggacuggggcgugggcugucuggggugaggggcucgcgggcuggcgcucuggccugggcgcauccuggcaguggcagcggcggcgcccgcguggcccaagcgcccaggccuuccucgccgggccccgggccugcccuugacccgccucuccccuugccccuuccuuccccgcccugucccccucuccgccccccggcgacggagggcgggggcagcuggguucccgucccgccgccugggucugucccucucuccgggacccgccggugacguuucgcacacgugcgcgcaggacgcgccugugacuggggaggaggcggcggcgggagggggcgcuggagggggagaggggggcacccacuuccuccugcucgccggcucccuggccugggacggucccggcgcccucgcacccgcccccggcaccgccacccucccucuccucuccccacccccccaccggcgcccgcccucgcccugcgccgccggucuguucggcccuccgggcccccucuccagccggccccccaccuccccccggagccaggcugguuucggaaaugcccuuacagcagcagguuagugaccgggacggcucgggggccgccgacgccgcgggggcaccggauucuguugggggcugaagcggugaggguaggcgguugagcgggguuuuggagugggaacgggggguugggugcucgagggaaaugaguaagcaagaaaaaucuaacuaaguaaaugccccggccuccgguucuaggaaccucggggcgggagugucugccccaggggguggguaugguguuuacguggauuuuuuuucuagggggcggauggaugggcgauagaaaaccggagggggcuucucgccaauggccgaguugagcucuguuuucugucuuccuucccuugugcuggagggggaggggggugggucagaggguagggugucuguaggauucccaggccacccgccacccccucccuuugucccuguaauuuauaaagcgccuuugagagaugauuuaggucaguaugcggcuucucuuuuuguugguacuagaaagaaguguggcccggaggucuccccuuucuccuuuucucuccuucauucccuuccuccaugccuccgggucuucacccucguggugaggcuuggccuccacggggcuagaaccgaaccagacucaguuagauccaugguagccugauuauaccaggcguggaccucaccuugucucagcuccaaauggguuuaauuuuuggagaaucaagauuuugcgggagucuuuaagaaagucagcacauaggcagcacuuugggaaaugggauggguuugggaauaaugaggcguuuuuuauuucuuuccuguucccaguuucuccccggguucggucuuaacugcuuuccagccccagagauacuugcugggcaugugugauguagucuuagucaaagaagcucaucguuuuuuagugacuagggucugccagcaggggggaaacggagcacaguaccugcuuagacauagcaguauccggugugcuggguuuucagucgcaagaauauuccaugcuuuuauuagcuucagauacucuuacugacuugaccuaagcauguuuggacauauuuuaagcauauuugaccccugcacaguucuguuacuauuucauaaaccuaaccuuaaacaaccagcuauugacauacuucuuggauuagauucacagauuugcaggggguaguuuugauaaugggaaauuaugagagcuucaaguugauuuuuaaaaaauuuuaacaguguuuguugggccaggucccuaagacuaucuuucaagccagguuuauuauaucuaguucauuguauuuaaguauuuaaaguauacuaaauuacccucaccaucuuccaaguuauuucaaaacuuuauucuccuugacaugaaauuauuauuccaggaauaauaauauccuuuugaguuuaugugcacacaaaagguuuuucauuacaggaauauaaauguuacucauauacauauucagaagcauuuuuuauaugauugcaauguaugcugaaucauugguuaucugcauuuuuuuuuuuuuuuuuuuugagacggagucucauucugucgcccaggcuggagugcaauggcacgaucucggcucacugcaaccuccgccucccgaguucaagcauucuccugccucagccuccugaguagcugagauuacaggcgugagccaccacgccuggccgguuaucuacacuuuuaagagcuauuucuacuggccgggcgcuguggcucaugccuguaaucccgguacuuugggaagccgaggggggcggaucacgcggucaagagauccagaccauccuggccaacauggugaaaccccgucucuacuaaaaauacaaaaauuagcugggugugguggugcgcgccuguaaucccagcuacucaggaggcugaggcaggaaaaucgcuugacccugggaagcggagguugcagugagcugagaucccgccacugcacucuagccuggcggcagagcgagauuccgucucaaaaaaggagcuguuucuucugggaggguguaggaaauuuaucuagucaaugcauacaaagucuuaagcacugaauauaaaguuugauuuauuguuuuucuuaucgaaauuauauuagacuuccauguaagucuucgaauuuugaauuuuguugauauucuuucccuaagcaggaaagacaggauggggaaagcuaagugauuggcugaacaaagaccaccuaaacacucuguguccaagaagagguugaaaagucuucagguggccagaguugcagaccuaucugguucugaucccaaguucugucucaagaauaucuaaggacuuaaccagaagcaacuucuucaccuuuuuuucaauggggguaaaaauaugaguacuaccuuaccagcuguaaagcaucuauuauuuacaaauuguauguucauuggcaaauaacuuaaucucucaacucaguuucuuccucuguaacauagggacaaaaacagugucaccuuuaagguucuuuugaagaguuaaauaugauaaugcaugugaacuauuuagcacagugccuggcaaaaaguagacacccaguacaauucauauuuauuauacaaauguuaauuuuuuucugacuuagugaaauaguguaaggccaggugcacauugucccuuuguuuacauauaugaagagaacuguuaaaagucuuuaagugaucuguaauuaauuauuuaugcccaauuaauuugggcuuuuaaauauauaaaacauggccauccuagggguaaaauagggacauuucaguaagacacgccuauauagagauagugguguugaacugccaagcauaugccuugaauugugacaauucaaggccacaucauccucacuuuuuugccugaguuccacuccguccaugauuccacagaccugccaacuuuugggugcaguuuaugcuuagcggcuuuuguuagaccugaacucucaaucuucaccaugucagagacaugcauuagacaaauuccaucuuaguuggugaacuguuggaaauguaagaacuccagagaaaccauagucagaagugcuacucaauggagcagacaaggcuucaucauuuucugcugcugcuucuaaaaagaagcugaaauuauuuuauucuagaaaauuugggauuuaauaauguaagagacuauguccugucacagucauagcaaccuacugauucuacuuugggaaagagcccucagugcuugaaauuuucaucuaagaauggagaaccauaggugcuauuucagcagggucucuuuuccuguacaauuauaaaaagaaaagugccggguuccugugguucuauacucaauaaucuugcuucugcugagauauaugguugaugccaaguuuaagcugggagacaauuuuuagucacuacauaccccaaaauggaaguuuuaauauaaugcagugcccagacuugggcacuacagguagcuccacuauaaucaguaccaagggcgccacucuaaucauccucugaaacaaagcacccuuaaauauggcacugugggcugaagaacuccaccuugugaacaggaaaggauuuuuuguuuuucuauaaaucgccaccuuguguauuacuuggaagaauggauucugagauuaauguuauacuguguaaagcuaacuugaaaacagaaaauaauacucuaagccuagacgugcauaaauaacauuaccuggagauugacagacggggugaaagcuuuuauugugguuucucagaaauauauaaagcaguaguuuuccuuuaacucuucugucuuuaaugccaucugcaaagauauaucauccauaccuuuaaccucuuuccuagggauuuggacccauuuggcaaauagcuucaaguacucauaguuaauuuucuggcugguuuuccuaaguuaaccugauuuuacaaauauuccauuuguaggaccaguuuacaucuacuuucccaagcuagccaacuucaauucccuuuuagucaucuacuuccuacuaacagcuguaacuaggaugagucaaaaucaauugccuaugcucaccagaucccugauaaauucccaugaagccaccugaaaggugguaaaagcaagguaaaacguggugaaagcaagguaaagaagguagauuucacaauuuuguuuuuuaaaaaggggaaucuucccugaauucuuugagguacuaaguacgugguuuaaugcauauuuucauucuuguuagcaguuuaaaaauaauguuucagagacuguauucacgauugcuaaaaagcauuuuuucuacuaaucauuguucaugggacuuaacaauggaagauaacugggaaagcaguaaauauaggaaaccacuaauagugucuccuucuuccuacccugacccucucuuuggcuucagaaagugacgaggaaaauguaucuuucacaaagaaaaguuauaccacagaagguacuaaaaagcaacaacugccuuuggggacaggaaacuuacagaguggggauuauuauagagggauaacauaccgaguuucuauuucaauaagagggaaauugguuuauauucuguucacacuuguuucaaacccucuccucuaaaagcaauguguuuuuggaauucaaggaauguacguucuuuccccaaccuuaacugggggucagucuuauggccaccauauuugucuacaauauaacuuuuaaaaaauauaauuuuugcccucaaauacucuccuauccaaugcaauguaacuuugaaggagaagugaugaaggccacugguugccagauuguaucacacagccagaugcacuuugcuuugaugaagaaucuaagugaugcaggcccccacuuagcuuuguaaacuaaggcagggguuuaugucagcucgagguagaaagcagugagaauuggcagcugauggaauagaaaggggacaaaaagaauaaaaaauaauugacuuuagucugcuuuccauuaccguagcccaacucucuggggccauuuguguggucuagacaacauucuuagaacuugacagucccugagaacgauauucuagguuggcaugggcaauaguuggcauuuacacuggucuuggaaucauaacauuugagaaguguaaggcacaagaguccucaucugcccaauccccuucauguugcaggugaggaaauucaggcccagugcuguuaaauuacuugcccaaggucacaggucuuugcuaguggcaaagccaaaaccgaaacgggagacucuugaauucuuagaagccucauucaccaagagaagguuaacugugucucaugaacccuauaugggaaaauugggguguguaggacacauuuuagauuuccuucaggagugguuaccuuuuuuaaaaaugcgcacauaaagaaguguccuuuaaacaguuggcuguggggguaaugacuuauucccaaagauacaaaauaagcaaggcuacuuuggauguuaaaugaaagggaauuauuuaaaaaaggaaagaaugacucuucaaaacgugauaguaauauuuuuaaagauuuauuugauauucgcaaauuugucuucugugguuauaucaauucuguugcucaaaaagugacacaugcuucauagagaauagaaucuaaaaggauuuuugagacuuucuuggggagaaggacacacagugccccucugguaguaacggaguuuuguccugggccaccaacauccugagugacugucaugcuuucagagguccccagcccuugcccaguaacauugaacaagguguucuuccucugugguuagcuccaagauuucugguuuagcaaaguggcuaaucaguuaacucuuuaagaggaaauugucauuccuuuagccaacgcuaauuuccuuaaaaugccuucuuuuccuuuuuggaacugagaaagcuuaaaaauagaauugcuucaagcccugaggccugaaagugaaacauaaucuaacguggcuguagugcacugacucguuaggggcagcgauauauggcuuaucuguaauccacaaaccagaaaggugcccaguguagauacggucuaacagccagugagcauuaaguaccaacugaugagaguaguaaucagugaagcugauuuccucuggaaaguuuuuuggcgaguagaguuugucuuagagaguggaggauuugaaugccucuugacuuucugcugaggagagcuucugccugcucuaguuuuuaugauccugaagggugguagcucuggacucugagaaugaugggcagugaacucagggucuguauauuucguuccacucugcucuuccccauuucugaugcuuugggggcuccauuucugauacauaaccagagcagcaucccugaggcccacacuaucuccugugugccuuucugcaucuggcagucccuuggagagaaggaggcucauguguuuauaaccugcacccuguccuaaaaggcauagugaggggcagcugaguauaaggucaggccacuuagccuggagccagagugccuguguucuuguucuggcucugcucacuagcccugugacuuugggcaagaaacuuggccucuauguuuucauuuccucaucuguaaauugggaggaaugauaguaccuaccuuaugggguuaggaaguugcaaugaguucuuauuuguaaagugcuuagaccagugucuggcacguaggaaggauuauguguuaaguagaaacaugguauaauugcccuuccuuccacaggcaucucaugggcuguccuuuugugauccauuuucuugguuuguuuuuguuuugagaccaagucuuguuccguugcccaggcugaaaugcaauggugcaaucuuggcucaccgcaaccucugccuccuggguucagccgauucuccugccucagccucccccguaacugggauuacaggugugcgccaccacgcccagcuaauuuuauuuguauuuuuaguagggacgggguuucaccauguuggucaggcuggucucgaacuccugaccucaggugaucugcccgccucggccucacaacgugcugggauuguaggcaugagccacuguuccuggccugaucuauuuucuuaacuagcccuuaguguucauuucaccccauugcaccucucuaaaaauggugaugaugggaaggagaaguaaaccguggaauggcucucgccuaaugcagucuuuagggucuagggucuuuguauuucuuuauaagcugcccauugacuugggaaaaagaacugaagaauaagcuucuuguaguagugcuaucaguagugauagugucaugaauaaaaccuuuauuucugugauuaaauguauuaauaaagugacacuacuagcaugaaugacacuauuaacauaauuucaauccuguacaguaaaccauggcuuaagacugaauggcaagaaucagggugucugagcugcugggcccugccagacucggagccccugccaguguguguauaucaaggcagggcgggggguugucuugcucuccagaggcaauggaaccugccucuaggccucccuuuucccuucucaucuccucaccccuccuuuuuuauguuagaucuauuccuaccccuuccccuucgccuugcccucugccuggcucuuagaaggaagcagacuugccaccuucaguggcugcuucccggacuuaccaaauuaauuaccaccuuuuccugccaucaagggauggugaaaucuugccuuuucggucuugcuucccauuccucugcacucggcugcugcgacaguguggugcugcaggcaccgcagauuucccucugguguguuugcucguagcuucucccucuccaccuuacuccuuuuguugcccuccucccacuggcccauugaggcccacaucaagggaaggcguaggcacagccucccccaguuucccaggggcuugggccucucccuucccuuggguuacugcuucuuuccuguaacaccucauggucugccucguagccuaaucuugcauguucaugacuuacuccuccuccaaaccuguaagcuccaagaaaucggucuggcuugcuuuuucaucauguggucccugcagugcccacuacacuauaggcucagcuaccugagaagaggcauuuucauuagacaccuuccaugugcuugguaccccauuaguccuauuggggauacaaaagaaguaugaggugugauccgcccacucuugaguuuacagucuguugaggagacaagcuuuaaacacaaguugaucugcaagcaagacuaaacaggcgguagggagaaaacaagacucaucuaguccucaguuguguggugucgacagaaagugccagaggaacaggugagagucaccagacuccagcugggccgugagauggggaggccacgguugucaaucuuggaguacauuagggcacacaugugaaucucccagggcgcuuuuuaaaaauacugauaccuaggccccacccagaccaaucagaaugucuagaggugagauuaagacauggauuuuuuuucuuuuuuuaaugugcucaguuggaaccacugggcuugguggaaagggaagauuggggaggcccuuucuggcggggagacauaagucaaaggcaggcaggcagaaagauuggcgucaggaggcagcauuuggacuagagucaucaguauggggagauaacaggaccgaagguuggauguguuggcaaaacugaucuagaauuggaguugccuuucuacaagggcugggcggggaguagauugggggugggaaguuugagugguguggggauuguucacgaauaaagaagaaacguacuaucaaaagggggccuugggaccuggucacaggcagugggugccagaggggauggcaggccuuguguuuugccaggucuucaaccuucucaaaaugccagaaaucuaccaguuuuaaaauguuggcugaauuuaaaaggaaauugcgcaggccaaacaaaauaggucucuaggccagauuuggcuuaagggcugccacucagcagucucuggucuaugggauaauaauagcuaauguuuaucgagugcccgcauguaucgagggcacuaaacuaagugcuuuacucgcauuagcacauuauccacauaacaaccuaugaaguggguauuauuaucauccuuguucuacacagggaagcagacagccagggguuaauggccuggcucugggccccauuaauaaguggggcaacugaaauuaaacccaaggagccuggcuccauagucucagcuuauuccuaguauuuauccucuguggucucuggcauuguauuaaguaguaaaaauccaagauaccugucaaaaagaaauaauccaguguuuuucaaguuuaccugauugccuguagcacuuguuacagauucagauucccaggcuccaucccuauccucugucagaagcccuaagaucuucugaugaaacauucuggaagcacggcuaguugagcacagggaaaaguuacugaaacuagauuguccaggugaaggcaggagccuucugccacauccauucacauaaugcuuaucucagcucuuccucguuuggaaagaccccagggccccaagccucauaccugcucucgugguuccaaaacuugcagacucccagguuguagcccaggcaaaccauacaaagaugggucucccaaaacuuaaaagaugugaaacaagaagugguuucuuggauucucaagcgguugagaauccgagcucaggaggucaaagugggcuugguggcuagacgccaggcaccagcaccagcuggguacccuugagugguuuuucugccuuaacaguaggaaggcuuuucauucugucuggucuggaccugccugaaacacagcuaaccaaguggacagagcgagaaaugugaauacgaggaccagagcacaccauuuagaguacgggcgcuauugaguugaugagucuggaagcaggauggcaacaaugauggugugaaaaggcagguggaagugaagggcagauuaagggagaaaagaaauacaagaccuuugacucccaaauauuuaacuccaggggcuggaagaaugggugaggccaagcuucuccucugucuggggugugcacuguguggaaggcaugauuagucagaauggauggggugguugugagugacuccaugggccaucccguuuucugaggggcuaaggcugagcaccggaagugggacuuuggcauagagguuauaguggaagucuugaugaacaauagcaggccaagaccuggucucccuagcuuacaaauaaaagaaauuuaacauggugccacaaaaaccuuucaucauuuucacuucuuccucuguaauaugaaaacgagacaaauucaucagguugauuuuuggggaucgaugcugucagggcucgcagagacgagccaucagauguuauuuauuacaugcuuuaccccgucuccuagcugcugugagaaagcccacaguuugcaaccucacaaagcaaagagccagcuggaaaguacugugcauccagacaggucacauagucauguccugaaccaagauagcucuuuuugccaugauuuccuacacucucugauuuuucucauuaaaaaaaaaaaaucuugaauuuauuuucuuaagcucuagcauucuaaaguuuaaacauaugagccuuugaauacuccugucuaggaaagagccguguaaauucuaaguaucucuauaauugacuuuugauauguuacuuguguuuaaacccaauuugcaacaccccuuuuguuggcuaauuuugucgcuauguuggguagcagaacuugugacgaucacacuaauaacauaaaguuucccaccuuucuuguugcuguuuuccuuguuagcaucucagacuucccaauucugggaauagucucuaggaggcaagguuuucagcuuuggaaaugcaugcgugacacaguagugugguauggaaggcguguggacuugaagauccggcuccagaaacacgcucugccaauuaccgugugugaccuuuuauaaauuacauccaugagcuguaguuaccuaaaauagugauccucucuccuucacuggcuggaaggauuaaaugagauaguguuuauaggaaauguacuuuguguuccuuaguugccuccccccgccacuccccgugguaggaacucuugaguacuugucaaaucugaacucucggcauuuuuaccuccuucagggaaaacuauuggacaggcucuuacugaacacccgcuuuugugcagaaugcacuuccugauacucugggaguuucagaggcuacuaagguguccuucuggcccucaaggaguucaucuggagacagggagacgacacauuuucuucaauaacuaagaaaagaaagggcaaugaagaccauaaggaaauaacagugaaguuucuuaggcauccaaacuugauggaggggacaaaggaggcuucaggaaguuuuaaacuagaacaggacuucagcgcucuuaacauuuuggucagauacuucuccguggugauaguuugugggcaguuaacagugguggagggcuguccugugcauuguagcaaguuuagcaggaucccuggccuccgcccacuuagaugccauuagcaccacuaguuaacaacaaucgaaauuaucuucacacugucaaauguccccgggaagcaaaaucacccccagcugagaaccaccgaacuagaccuugaagaaaggguagaagaggauaucauguuugccucuucuauauauaguacauauuuaaauuuuaaaauaugauauacauuuuaaaagcaacggauuucucauagcuggauuaacuuuggaaugccuaaccaccccauggcaccccagaacugggauccacugccccuacucuugguagugcucugugcaggccaccuaagcccugucuuuuuuaugaugaggcaugauauuaauuggcugcuggaagccucucuaacuugcagaagaaaggaucaaagucugcaguucagggaaggaaguuuugcauuuaucauugacccaacuggguaauuuaagagcgacuuucugcucagggucaacuucucagugugguuuuuaaucccacuucauaguuagaugauuuggucacaucacuuucccuccaaaccccauuuccucgucuguuaaaugaggaaaaucaugguucuuaccucacagaguuacuguaaggauugaaugcaauaaugccuguaaagugcuggcuccgucccuggccaugugcuaaacacucugacauuuguugucuuccucauguauaucauuauugugguugucauuaaguugggcuuccguuucaggacaguucaacaguaagcagccauucccuuuguugcuggugcuucugcagcuauuuuccuugcucaccuauacccacgcuggccccaguuucaaccacagggccggcugacccauuuauuuagcagauagguguuaagcaccuagcauaugccagccaccauucuagguaccaggaauacagcagugucagaacagacaaaauucccugccucugugugguuugugucauaguuggugaagauuuugccacaucauaaauacccuggucuugucuuugauggguucuuuuucuuuuauuuuuuaaaugguucuaaguauguggugcuggaccagcagcauuacuugggaacuuguuagaaaugaaaguuuucagguuguacuccagacccacugucagaaacucaggaaguggaagugggggugagcagcacugguguauggcuuaacaaguccccaacgucauuccaaugcaccaaguuugugugugaaucaguguuugggaaaagaaaggaguagggggaaacccaggccguaacugggcugcaauguuauaugguaacaucaaauaagguguugcucauaucaugagauucuaguaacaucagaguuuacaaaggauagucuuagguacaccaagacacuuaaaacuagcaguacccuuugaucucuuuccugggccuggccaccccuccuuuaaaugggagggcuuugggaggccuccuaagucaccacagcacacgggacucagcaacagaaauucuuagccuucccuaggcuuuuccuugccugauauacaaggaaguugcuuuccccacuuuucuccagacuucuggcauguuugacaauuauuuuuucuuuuaauuccuucaguuuuuauuggcuucuuaccuggcaucauuaaaaaauuuuuauagcugcaaucaaauugccaacuggauggacaaggcuuaucugaaaaugaaaugguagcucuccuuuguaugucugguaauuuggguauuuaaagauacagugaaaaguaaaugaaaugagagacuaugggaaaguguccaguguggagcugggcacagggugaccguuugauaaaugcugguacagucuuccccccaaucccaacucauuauaaaaaccaauaaaggcauuaaauagacaccacgguucuuugugugaaaagcuuuggauuacauacagucugaaugagugaauaccauaauguaaauuguaaccaaaauaauagaauccaaaaucuuaaguaaugacuuugaauaaaaauaaguguuuuaaaaguuaguaacuuuuuaaaaaauaaguguaauuaaauaaacuuuuaaauuuaaaaagauguuacuugauuuuuauuuccugauaauggauuuaaaaaaaaaaaaaaaggcccagaucagacuggcagaaauacuuuuauuucugcacuagcccaaagccuggauaugcuuauaaggcauauaaccuguccauuuaacagcugucauuuaauucacaaacacuaauuaauuacagccauguuaaaagggguguuugggacgguuugguaguuccuuuugaagaaaaccugugucuugaaaaugcauaugaaagauuaccagguucuguuauauauaguccagguucgucuuggugguucuauucgaaaaauaucucucugaccaucggugggcauuuccucucucuuucugucuaccuacagccaaaacaaguucugguuacagugacaguuuuaaguuugccauuugugguugguucuauuauagaggcugggggaggaaggcaagcaguccucacuucuugcuuccugccuugcucuagaguguaaggaucagcuucucuaaucccuugacuuuucacugcucuauguagucaggguagacaagggguggcccucaaacaacagccaccucuggaggucuagcgugacuaaaccacugucuucuuuuccaaauccagcacuggggaccgacgugugggccucccaucugacuuguggagugaaagaaaugggaauagagcagcgcuguccauauagucgaguuuuguaaauauuugucagauggaacuagagaugcauuaucacauucgacaguaacaaguggcaaguguugagcucuuuuaagucuugcuuuuuauuucuuauaauaugcaaauaacuguuaaaauggccagccaguuggcugucuguuuuagcuaagguaggucucuugcaauuuuugcacccuagggagaucucaauaggaguaggucuagcccuaaacugugcaggauuaggaauucugauuuacugaucuggagggcggcuuuguguuaaucagaguucuaaaggcggacaaacuagacugugaacuuaauacuuacccugagaaguauaacugccaaguggacaguugcagaaauugguuauugccuguguucucgaucagaagguuauuagcugugucagaguaaaggcauugaaugaucccauuaguaccuuccagcuguggucuccucucuagagcguaccugcaggggagggaguacugcuagccacuuauggagcauauggacacugucauucacccacccagguguccaguuccaugacucuggugugaaacacugaauuuguuuguuaccuuuuuuuuuuuguaagaaaauacuuguuuuuaguaccugcuuauuauuuuuuuaaaauaaaaaauauauaaggaaguggagugaaaaugaaaauacuuucuucauucccucuugaucuugcuuccuucccagagauaaccacaaucacagcuuggccuuuccuuuuuauaaucauuugcaaaucuauauuuuauuuauauaaaaguaaaaaugauucaaaaauacaaaagugcacaucguggcuugcccuuuugcuuaguauuuccagagacguaauucccuaucuguauauauuguugcucauuauucuuuguaauagcugcgcugccacucguuauauagauaugccagaauguguuuaguuauucccauuugauggucauuucugucauuuuucauuuuaacuauugcuauuaugaacagugcuacauuggauaucuauguacauaaguuuuugugcuuguguguauuucuguaggcugcauuucuaagcguugaauuuuuauaucacagggcauguauauuaaaaugcugauagauuagauagguccaaauuacccuccaaaaaggcugaacaaauuuauauucccaccacaaguguagagaguugccuguuuucucauacuuuuuccaacacuagguaacauuagucuuuuugcaguugcugcucaugcuagauaguaccuccuuuuauuuauuuauuuauuuauuuauuuacuuacuuacuuacuuacuuauuuugagauggagucuugcucuguugcccaggcuggagugcaguggcaugaucugggcucacugcaaccuccauuucccagguguucaagcaauucuccugccucagccuccccaguagcuggacuacaggcgcacgccaccauggcuggcuacuuuuuucauauuuuaguagaguugggguuucaccguguugcccaggcuggucucaaacucuugagcucagucaaucugcccgccucagccucccaaagugcugggauuacaggcgcaagcuacugugcccagccaauuuuuauuuauuuauugagacagagucucauucuguugcccaggcuggagugcaguggugcagucuuggcucucugcgaccucugcuucccgggcucaagugauucuuccuccucagccuacugaguagcugggacuaguggcgcaugccaucacacccggcuacuuuuuguauuuuuuguagagaugagguuuuaccauguugcccagccugccuccuuauuuuacuuguauguuuuuuaaauuauugcugcugcuaccaccaccaccgcuacuauuacugcuacugacuaauguuuauugaauguuuuuaugugucagggauaguuuuaagcacguuauaugaaaucacuaauuuaaaccuuaacaucucuauaaagugggugugauuauuguccacauuuuacagaugaugaaaaagacgaauuaguaaauuuaaguaucugcccuaauuugcauuucugugaguagccucuuugaauucuuuaucauuuuugugcccaaggcuauuuauaguuuucuuacugaauuauuggaacuuuuaaugaacuauagauaaugggcuuucucugguguguguguguguguguguguguguauaguaaauacaggcauaccucagagauauugcaggucugauuccagagcacagcaauaaagcaaaugucacaauaaagcaagucauauggagucuuugguuucccagugcauauaaaguuuacacuguacuguagucuauucagugggcaacagcauuauaucaaaaaccaacguacauauucuuaacuuaaaaauacuauauugcuacaaaaugccaacaauccccugagccuucagcgagucaucuuuuugcugguggaggguuuugccuucacacugaagacuguugcuguuuagggaagaagucauugaaugcuggggcagcuguggcaauuucuucacauaagaaaaaaucaaguuuuccacauugauugacucuuccuuucauaaaagauuucucuguaguaugugauacuauuugauagcauuuuucccacacuagaccuucuuucaaaaucagaguaauccuucccaaacuguccugcugcuuuaucaacuaaauuuaugcaauaucccaaauccuuuguugucauuucaacauuguucacagucaucuuccaucucaagaaaucgcuuuauuugcuuauccguaagaagcaacuccucaucuauucaaguuugaacaugagauuguagcaguucaaucaccuauuaacgcuccauuuucauucuaguucucuugcuacuuccaccacaucggcaguuucuccacuaagucuugaaccccugucauccauaaggguugggaucaacuucuuccgaacuucuguuaauauugauauuuuggcuuccucccauuaaccaugaguguugauauuggcaucuagaauggagacuccuuuccagaaaguuuguaauuuacuuuauccagauccuuuggaggaaucacuauuuauggcagcuauaaccuuacaaaauguacuucuuaaauaauaagacuagaaauucaaaauuacuccuugauuuaugggcugcagaauggauguuguguuaccagccaugaaaacauuaaucuccuuguacaucuccaucagaguuuuugugugaccaggucuauugucaaugagugguaauauugugaaaggaaucuuuuuuucugagcaguaguuaucaacaaugggcuuaaaauagucaguaaaccaugcuguaaacagaugugcugucauucaagcuuuauuacuucacugauagaucacagaguagauuuaacauaguucuuuuuucugaccugggcugguucaccccuccuuaggcaaccugguggucccccacucccaggaggucgccauauugaugccgaacuuagugcggacacccgaucggcauagcgcacuacagcccagaacuccugggcucaagcuauccucccaccucagccuccugaguagcugggacuacaggcaugugccaccgcgcucggcgaucuagcauaguucuuaagggcccuaggguuuuugaaaugguaaacgaucauuggcuucaacuuaaugucaccaauugcauuagccccuaaccaaagagucagccugucuuuugaugcuuugaagccagauauugacuucuccucucuagcuaugcaaguacuaagugguaucaucuuccaauagaaagcuguuucaucuacauugaagaucuguuguuuaggguagccacuuucaugagugaucuuagcuagaucuucugaauaacuugcugcuguuucuaugucagcacuugcugcuucgcguugcacuuuuaugauauggagaaggcuucuuuccuuaaaggucgugaaccaacuucugcuaccuuccaaccucugcagcuuccucaccugucagccgucaaaagagcugaugagauuuagggccuugcucuggauuaggcuuuggcuuaagggaauguuguggcugguuugaucuucuauccagaccacucaaacuuucuccauaucaguaauaaggcuguuuuguucucgugucauuuguguguucauggaguaccauguuuaauguccuucaagaccuuucccuucacauucacaaccuggcuaacuauuuggcacaaguggccuaguuuuuugccuauuucagguuuugacguacauuuccucaccaagcuuaauaauuucuagcuuuugauuuagagggagggaugugugauucuuccuuucaccugaacacuuaagagaccauugugggauuacuaauuagccuaauuucaguauucuuguuucuuaaggaauagggaggcccgagaagaggguaagagacaggguacagcuggaagguggagcauucagaacacgcacaauggcuaucaauuaaguuugccauuauauauuguuacuaaacauuauuuagugacauuaguaauugcaauagugacaucaaagaucacugaucacggaucaccacaacagacauaauaguaaugaaaaaguuugaaauauuacgagaauuaccaaaauuugacagagauauguaguaagcacuguuggaaaaauggugcugauagacuagcuugaugcaggguugucacaaaccuucaguuuguaaaacacugcaguauccguggagcacaaugaaaugugguaucccuguauuguuuugcccaagccuauuauguuucuuuugauuuuucuaugauguauuucuuucuacauauguuuauuuaguuuuuauaaugucaugugucacuuaacgauggggauauagucugagaaaugugucauuaggaaauuucaucauuuugcagacaucauagagaguacuuacacaaaccucaugguauagccuacuauaccccaagguucuauggucuagccucuugcuccuaggcuacaaaccuguacuguauguuacugggcugaauacuguaggcaacuuaaacacagugguauguauccaaacauagcaacaguauaguaaaaauacagucuuauaaucuuaugggaccacuggaauauauacagucugcugucgacugaaagcaucauuguuuggcagaugacuacaugugacauuacagugcuuuuuuuuugagaccaagucuugcucuugucgcccagguuggagugcaauggcacgaucucggcucacugcaaccucugccuccuggguucaaccgauucuccugccucagccucccaaguaacugggauuacaggcgcccaccaccacacccagcuaauuuuuguauuuuuaguagagacaggguuuugccauguuggccaggcuggucucgaacuccucacgucgugaucugccugccucggccucccaaagugcugggauuacaggugugagccaccacacccggccauuacagugcuuuuuuugagacagaguuucgcucuuguugcccaggcuggagugcaauggccugaucuuggcucacugcaaccucugccucccgaguucaaccgauucuccugccucagccucccgaguagcugggauuacagguaccugccaccaugcccggcuaauuuuuuguauuguuaguagagaugggguuucaccauguuggucaggcuggucucgaacuccugaccucaggugauccacccaccucggccucccaaagugcugggauuacaggugugagccacugcacacagccgaaauuacagcuuuuacaguuugaguuugguggcuugcuuugggaaggccuuuccuaaucugcaaaccauaacaauauucuauauauuuuuucuccuggcuucauaauuuuauuauuuugaucuuuaaccucaguggaaggguguguguguguguguguguguguguguguguguguguguuuuaaaggugugacuuuauuuuuccuaaacgaauagccaguuaaacuagugccauuuauuggaugguuccgcuuuccccacgcaugcacuugaaaugcccuuuucucagagagacacagagagaguguguguauguguguguguguguguguguguguguacaugcauacaugcauguaugugcugugugcaugugugucuguguuguucugucucugaacuuucuacucugcuccauugauaccuuuaucccuuuguaaagaagcagcacacuguuuugaauacaguagcuuugugauaugauuugcuauagauaaggaaaaucugcuuccuguuacauacuuuuuuuuuucauuaaaauuacaguuuuuauguucaugcuuacuugcauuuuuacaaauugagcuucuucucccccauccacugugaguuuaggguuauaagaaaaaaaacucucugcacuuauuagauagucuacugcacugggaauagcaguaagcuguuuacauuuuuucuuucaucugauacaacaaaccuugagaguuggugccaauauccucaucuguagaugaggaaagugaggcucagugaugaagcaguuuguccaaggcugcauuucuggacauuggcagaaccaggguuccagaccaaguccaggaaauuucgaaaccucucuuaaccauuaugcaacccagacacgugggguuuucucacaugacgagggcaggccauugucuagggcggguuaucagguguuucuccauguccugcagggcggucaguggcuuuuacagaguagaguguuuauugcaugaagggaagaccuagcaagaucucucuaaaggauuuauccauuggggcagcaagaguugaaaaauuuggcuuugccaaggguauuuguucagauuuaggauacaagucaaguugggaccacaggcuaaaguuuaagugaguggggagagaaauuauuuacccagugcuuuuuuuuaaugccagacacuguaacccuuccucggcucuuuucuagaguugggucugugguuuggaauacaaaggugaggaauacacagcccuggacauucagaauggggcaguaggcugggaggagcugugcgcacaaccccaggaaccuucuacuuuuuuuuuuuuuuuuuuugagacaaagucucgcucugucacccaggcuggagugcaguggcacgaucuuggcucacugcaaacucugccuccuggguucaaccgauucuucugccucagccgccugaguagccaggacuacaggcguacgccacaaugccuggcuaauuuuuguauuuuuaguagagacgggguuucaccaugucggccaggcuggucuugaacuccugacccuaggugaucugcccgcccgccccgccucggccucccaaagugcugggauuacaggcgugagccacugcgcccggccccuucuaccuuuuagaagaaaaugcaacaacgugucuuagcucucuaguggaggaacagaggucucagguggauccagaaaugcuuugcuauagaguggcauuuaaacugggacauucaugugucuaaauuaccuaacaguuugagcccucccuucccccgaggugguugcuucuucauuugaauucucucaggugccuucuguugguucuuagaggugaacaucagaaaaguaauuuucuuuggagaaguuugaagcagccucccaaacagaaguccuguugagcucccacugggaguuuuggaaaaguaaucucauuuauuaggaauaguguauugauuuuguguguaaaauggacuaagaggccugugacaaugaguccauuugaaauugcaaauuuaaauaucuaauacaauaguugugcggaaauacuacaccagaauauaaaugauuagcugcuuagugaauuucucaugugcauguaauuaauuggcaguggugguggggaucaaguuuguuuucauauccugaguccuuuaauuuaccuuuucuucaacaauuacugguguaaguauaggggaauuaaaucuuagugucuuuuauaaaaauauauaguuuugcuuugucauucauuuauuguuuuuuggucuacauuauccaauuuuguauuacacaauagaaggcaccuaaucaaagauuucuuguuuuuacugcaugauugcacucuuaauuuugugaaagcauagguuuacuuccagacugagagguaaaugaauaauuauuuugugauuuauuuagcacuugccgccccaaucuuguuuuucacgucugcaguuauggcugaaauaucuuauuccauucccagccucucuguuggugguaucugccugaucuccaccuagugucauugugggaucguggccacacaugggccuuccagggcugugcuguuggugaccaguggugcuuguaacccugaaguguuggcauggccucagcugacugggcuuucccucaugcccagggcuuaaacuugaacucugccugcucuguuagcaguuuuucucuacauuucuuuuaaaauagacuuucacuucuuccuucccaucccccccaauacaacugcccuggcauccuggcuuuuuccauucuugacaaaugaucuguccacuguaacuguagcuccacugugcugauaucuguugaaauuagaccuagaaucuaaauguggcuccaugaaacuaugggugagacauuuuuuuucuucaaauagucuaugguuuauuggcaccccaaaccaccuauccauaccuucuccacugugaugcugggggaagaaaaugggguaauauauguguaaaagugacugagaaugaaaaguucugcauaagguacaauguuagcugggguuuuugcauauauaauaagaagacaaauguucacuaccacuccugccugccuucccugggcauaucgaacugauuccagccuaauagcauuucuuaucauauaaugggaaucacaaacccucccuauguccacuccuacagcgccuucuuacccuaaugaggcuuuguaacucaaagauuuaaacaucucauuuaugcuccauugacugaguuaaccaaacacuuuguauuuggcccuuuccucuuagaaguucagaacaauaauaugguccugaaacuacuccugcaaaaucugcuuagggaagaagggucggccagggcagggguuacauugggguuugcaguguagucaggcaccagggaccuggcagguugggugggaucaauucuuuucaccucagggcuccaguuucucauuugucaaauaaaagugauuucuaaggcccccuucugcucagaccuucugugacuguccacuaagccacagagacucacuguggccauugaauucuuggggaccucagggagguuuugcugccgaagugacugcccauucugccggcauacauuuggacuaccauuugaggugacuuggagagaaugucacuguggaaguuggccuuccugacaccugccacacaccuuccaugccaugcaucuccucuuuucgaaguccuaggagcuccuugaugauauuuacuauuuacauuugcaucucugauagugcucuuuccaagugaguuggcagcaguucauuuaaauucugaagcagaucucugaguuaggguuugguucuucuggccuuugagaugggugcugcccagcacagcaggccucggugaacaccgcuguucaccaagggacuuuggucccucuccugcaacgauucagugaacugccuugaagcucucgcagggacucugaaguacugaaauguuuauuucuaaguuagaggcgaggaaaugaaacuaaggucacagacauuuagugauuuucuuuucucccaaggugagggaggugguuaagggcuuggacuuuggaguuuaaaaucucaccagcugcgggaacucaggcagucauuucucuuuucuagacccaaacuuccucuuuuauuuuuuauuuuuuuuuauuuuuugagauggauucuugcugugacaccuaggcuggagugcaauggugcgaucuuggcucacugcaaccucugcuucccggauucaagcgauuuuccugccucagccucccaaguagugggauuauaggcauaugccaccaugccuggcuaauuuuuguauuuuuaguagagacgggauuucaccauacuggccaggcuggucucgaacucuugaccucaagugauccaccugccucggccucccaaagugcugggauuacagacgugagccaccacgcccagcccccaagcuuccucaucuaacaugggacgguuaaugacuuaccucucaggguugacugggaagggagcggcugaaugagaaccaauguugggaauguagacagggucagaaagguuagcccucugauacgugcuaagcaaagauuagaguuggugcugaaaacaggucucuugccuaaaucuuggauuaguacacaacuuccacauauaaagaguuaggggcaucuuuagguagauaaaucuauuuuaauuguuccguaaauauauuuagaagaauuuuggucaacauggauuuggugcaaauuucguugcagcuuuuuuucccccuuuuguuauucuaagcugcccuacaaugauauuuuuagaaauuucugggaacucaagacugucauugccagggcagagccaaaacaccagagguucucguagaccagugguucucaacuggggaauguucugccccucaugugaccuuuggcaaugucuggagacauuuuugauuuucguaacugggagugggagaugcuauuggcaucuagugcguagaggccagggauacuguuaaacauacuauaacauaugugacagccuccccacaacaaagaauuauccagcccaaaaugucacuagugccaagguuaacaagucuugcucucagauaauucuuugccuaucacaggcauucuuuguccccagcuacagugucauauaagccaucucaaacaaggguauauucguugucccccuuauccacgguguugcuuuucgugcuuucaguuaccuaagguccaaaaauauuacaugaaaaauuccagaaauaaacaauucauaaguuuuaaauugcacucgguucugaguagcaucauuaaauaccaccugggacuugagucauccccuuuguccgguguauucgcacuauguuacacuauuccccaacccucauuccuuacuguauaggaaaaaacaguauguauaggguuugguacuaucugagguuucaggccugcaguaggggucuuggaauguauccucggaggaugaggagagacuaccguauuuuuuccggaaagucuaggaccauuucucaaacuaagagaaggacaaaguuggagaggaaacuguuucuguucugcauaguuugagauauguacaauuuugagacccaauccaauuuuuuuccaaccacuuucuuguguguuuuuuuuuucaguaucuuaacccacauugauguuuuaucuucuguaagcacuaaacaguggcaaguuacacaaauaaaaugugugcuuacuacauuuuaauugcucuuuuuuaugcaaauaauaauagaugguuuuuuuguucuuacacauugauuccugggggaauuuuaauauuuuauuaaauauuaaauaaaaugcccuauuuuuuuccuuucaaauugaaccacccuaguuauaaugagccaucaguucuaaaaugaauccucucuguuaaaauggcagcuuguucuaacuaaucaugcuuugaguauucugcuguaguuaaucaaaguuaaaauaggagguuauauuuuaaauauaaauucuacuuuuaaauucuaaauuugcuauuuuuccauucuggaauauuaugauaggguuaccagauaaaauacacgaugccaaguucaauuugaauuucagauaaacaacaaauaacuuuuuuaguauaaguaggucccaugcaauauuggggauauagauauuuuuuaaauuuguuguuuguuugaaauucuaauuuaacuuacuuaaugcucuguauuuuuauuugcuaaaucugauaacucuaaagauaggacucaggauaauuggaaaauaccaggaaauaccacucacgucugacaucucccugcauaacuuuaucuuggauguuuuacuuuacaaaguauuaaguaauaaaucucguauaguuauuugccaaagagaaggaaauaaauuucugaagggaauuuagaaaauuugucccauaagcacauuuauuggucuuaaaggguagcuugaauaaacuggaguuaguuguucacgugacauucagaaguaccauauuugacauaacaccucaauuccagaggggaaacuuggaugggagagaaaaauccuuuuuauggguuggcuucuagagauuaccuagaacuuaagugaggugauuuuacucuuucuucuuuucauaagcaguaggauucacuucagaguugagggccuguugcaauagagggacauguugauuauaaaagaauuggguuauuuuuggcuaaagcaggcagaucaccugaggucaggaguuugagaccagccuggucaacauggcaaaaccccaucuguaauaaaaauacaaaaauuaguugggcaugguggcgcacaccugucaucccagcuacuugggaggcugaggcaggagaaucacuugaacccaggagauggagguugcagugggccaagauggcgccacugcaguccacccugggcaaccaagagagacucugucucaagaaaaagaaaaaaaagaauuagauuaucuuuggaaaauagcaaaaaggcccaaccaaaauucucacuuaaaacacagaauucacaagagugugcugaaaaugagcaugccggagacacgguauuccucaacacuucucgucaucagcugacaccugaaucuacccggugggaggaaugcaacugucucuggaugccacuaucauuacaucucuguggccucaaauggguccauugcagaaucuugcuaucuucagugaccuuaaagauguuuuugcuucuggagaaggaaccagcugcaucaacggugaucugcugacuucauacaguacuccgucugcucccaccucgcaucccauggcccagugucccgugagcugagauuugccuucugcugacgguguccugccucaggugccaggagcacugcuuuuugcuuuuuugucucucuaggagcagacugaacauauugcaaccugugagucggaggggggucaacaccccagggccacccucuaccagugggaauggaagccaguggauaaauggcccuacuuccuagaaaaguuccagggggcauucuggaugcuucuugggaggccucagcagaaugaagccccuguuaccuguagccaugaccuucuacacacacucuucaauaauacacccaccucacucucccuccuccuaggaucacuucccaauaaacuaccugcacacaacuccuugucucagccucuguuuuuggaaauaucuaaauuuagacaccuauuacauuagucugguagggcugccauaagaaaguaccacagacuggguggcuucaacagcagaaaucuauucucucccugaucuggagacuggaaguccaagauguugucagggagguuuccucugaggccgcucucggcuccaagauggcugccucuucaccuggucgucccucugucauaagcucaccgggugucuuuuccuucagauuggauuugggcuuaccccaauggccucuuucaacuuaaucaccucuuuaaagguucauucuccaaauacagccacauucugaggcacuggggguuaugacuucaacauaggaauuuaacggggacgugggggugggcguuuagcccaaggcaccugugaaggagaaaaaucugauuuagaauacaagcuaccccaacauaauuggccucaagauuguggcuguuuucaaaaaacucuuccaucuuguauagaacucaccuacucuggggccuuggggaggggggucugugaacauggaggccaugguguucguuggccaccuccuuuuagauuaacugcgcagccugugucuucacuucugcucuguacauggagaagacagggaaggcaaggcugcugcuuaccugaaggaguucaaaguguaaauaagacaagcccauuagaucuaucaggggaaagccguuuagguuuguuugagacaagauauaugguguagaccacagaccuuacguuuagggaaagcguacuucuucagugggcugaguuucuuguaacagaagguguggucggaugauuacagcugggguugaauuagaugauuuauggaacagcuucugcccugaaauuuucugauugagagauggauguggucuggaguaugugaaaaugggauagauggagggaagguuaggggagaggugaacagggccucuuccagggucuuguggaagacccuguucgacguuuccucacguagacugucugaugaggcucuuccagggugugguauggccaggguguguuaaauguagggagcacaaggcaagaaagggcugcaccaagcugcuuccugccucagggccuuugcacuugcugucccaucugccuggaauggccuugccucacaucuucauaugaccuuggcuccuugucaucuauugacucaccugucacuucagaaaagcccuugcuaccaucuggucugccagucacucuuuauccuauuuucauguuuuauuaacauucaucaccaucugcaguuagacucuuuuguuugccuagugcccacaauguugcccgacgcucacuaggugcucugugaauauuugcuaaaugaaugaagaacuugaaggaagcuggcaguggguggacucgcugagauuaaggggcauggaagauuacucaaggcagccucagccccuuucuaauguuuuguuuuguuuuuaaauucagacucuguggacucaguucaauucacacaauugccaagugccugucugugucgugcauuaugcuaguuagaucccaggaaucaaaugaauuagaccugaaggagauuacagaccaguucuaugguucagguuguuaaugugggccccuggauagaauucuagauauuacuuaauuuuuuugugugacuacccucuaacugaaauuuagcguuuucuucuaguaugaacguaggcacuaaaccacaguagaacuggcaguguguuugacugucacccauagaaauagauauuuucauaucacauuacacuuguugcagcugucuugaaauauuguuuaugcucaucaugacuucaaaauuacaguaauuuuugaccugcugcuggaucuuuuuauuucacgcacuaacacagaagaacauagauuacuguaugauaaauugcuuuuuaauauuuugaauagcuauauuucaauacaaaguguuuccuuuguaaucccauauauauauauauuuucuuuuuuaagacauaaaaaagcacuagccugagaaaagggguccaauagacuucaucaggaggccaaaggaggcgucuauggcacgaaaacaugaauucugguggaauuaugugaaaagagaaguccuaucacuccuuaaaaucauguuaaugaagauuccuaucaaaugugguccccacccccugcucuggguuuacugcuucccugugaaucuucuccacacuuuuguuaauuuugggauggaaguuugagagagauacuuuuuucauagauagguuggaagugaugcucaccuuaucaggacuguaagaggauauugcaagcuuugaugauugagcagaaaaaucuuugcacagcuggucagaacaagcuuguccugccuugugggagggacagaguuuuccaaaugaucuuuugguuaagaccuuaauuaaaaacagccuaaauucacuuguggcaagaauuuauuaaaggaagauaaccaugagcaaauccacguugugguauaagaaaagggagcaccaucguuaaaaaagucagaggcuugaauucuggugaacuuagcacaaagaagcaagaaaacuuuagacugguuucuuaacaguuugcuaucuguauaacuaggggugaauugaucucaaagaccuaagaaucuguggacuuaaagacacugauuuguggcauaauucgagguaguuuaaacuggaauaucaaggugucagaagaaaaauguacaaguaauacaucucaguuucuuuucuccuacgccacuuaaaucuuagacccaccgaaagcucuaaauguaucaguggauuuuucauuauuuccaaaaauauucugcuugcucuuucugaauaaacuauagagagaaacacagguuucucuucaggugccuuauuaaguuuaacuguuguauaguacagcuuugcuucuuuguuucauuuaggaccagaagggguccagguagcugaauaucccuuccuugcccugacauccccauucacugcagcaagcuuuauaaugccuguggucauccuugguaugaaugagcacuggagaccccaccaugggcaguacuaagcagaaucaggcuucuguucaucagaaugaacaaaggcacacgcauaaaaugagagcguggcagauggagagggguggggagccuagagggugacuggcugcaggccucagcaguggagacaagggcacaggaacauggcgccagggccgacagauuuggcgucagccguggaugcucugcauagcacccaucuguaaaugggugugguccuggacaagugagguccugcuggauuauuuaagaauauuuuauggugaguuguauuuguucuuuccagcaacagcucuuugaaguaguuuagugguauauccauuuuacagucagcacuucagacucaaguuuggugaucacaugccccaagucuccaacuccugggcucaagcaaucuuccuuccucagccucccaaagugcugggauugcaggcaugagccacugcaccuggccgaugugccccaagucauguaaaaaauuaauagacaaugcagaauauaugggagaaugacguauugcugggccuuuuugauuugcuagugagaccagaacacuuuaacauacuaaaaguuauagcugguuagcaagccaacuuuuuaacuucaaaagauagggaaaaauaagcauuauuaaaacucauugacuuggccgggcacaguggcucacaccuguaaucccagcacuuugggaggccaaggcagguggaucacaaggucaagagaucgagaccauccuggccaacauggugaaacccugucuuuacuaaaaauacaaacauuagcugggugugguggcgcacgccuguagucccagcuacuugggaggcugaggcaggagaauugcuugaauucgggagguggagguugcagugagccgagauugugccacugcacuccagccuggcgacagagggagacuccgucucaaaaaaauaaauaaauaaaguaaauucauugacuugcugaacaccauaauuaaagggauucuggagguaagaaaaaggugcuccuuuuguuguuauauaacaacaauaaacauuauuguuacuauuauuacagcccuuaucuugcuuucuuuucuugucccuaucaaccuucccuggaagaaagagaacuuuuccaggcuaagaucauacauuaaagaauuguccuuuuuuuuuuuuuuuuuuuuuuccaagacagagucucucucuguugcccaggcuggagugcaguggugugaucucagcucacugcaaccuccgccuccuggauucaagcaauucuucugccucagccucccgaguagcuggaauuacaggcauguaccaccacgcccagcuaauuuuuguauuuucaguagggaugagguuucaccauguuggccagguuggucucaaacuccugaccucaggugauccaccugccucggccucccaaagugcugggacuauaggcgugagccaccaugccuggucuaaagaauugucuuuacgauagaggaauguuugacuuuagcacauuucugguaaaaucaagauucuagaucgggguguccaaucuuuuggcuucccugggccacguuggaagaagacuucuugggccacacauaaaauacacuaacacuaacaauagcugaugagcuaggaaacacacacacacacacacacacacacagagagagagagagagaaaaauuuuguaacguuuuaagaaacuucgugaauuucuguugggaugcauucaaagcugucuugggccacaugcggcccgugggccggagguuggacaagcuuguucuagacguucuuccucugucucucuauguuagaugcuuucccacguuagcaguccuuuuccccuccucucuuaaaugaccaagcaggacuaggaaagcauaaaggcaaugagaacacgcugccugggauuuaagcccuugaauuccaauaagguucuaauauggacuucuacuaaagcauaaugguuaauuccauuuagagaguggggaacaucuuucauacuuuuuaaaacaucaggccaggugcagaggcucauaccuguaaucccagugcugugggaggcugaggugggaggaucaccugaagccaggaguuugaaaccagccugggcagcacagugagaccccaucuccacgagaauguuaaaaauuagccaggugugguggcauguaccuguaaucccagcuauuugggaggcugaaguaugaggaucccuugagcccaggaguucaaggcugcagugguugcaguaagcugugauugugcugcugcacuccagcuugggcgcagaguaagacucagucucuuaaaaauuuaaagucauuauucccagguggaguguacuacugagaaauagaagucccuugguuggaccuagcuuauaagaaacuucaaagcagucauugccaacuacaggugaugauugguaauuugagcaaaauuugauagcuuuugaaauggcaucaauuuaaaagaaguaguuuuuguuucuugauccggggcaaggcuauuauucugguuuccaauacccuuuauccaucugaagagcaucaaaauuggcgggugccaaucaaguuuggaaauggaacugagcagcauaguaaccuauagaaaauucaugaauauagaaaauucaagaucauacauuaaagaauugucuuuuuuuuuucaaaaaaauuuuuuuucuaaaaauguaguguuauauuaaaauguagugaauauuauaauaauucuaaaaauguaguguuuauauuguuuuccugcuuaaguuaggccaaaguugguaaaaugcauuuuagaacccuauuuuuguuaaggagagcacagagccacugguuuagagaaguuuguaauauccagaggaugaagaaaacggacacuugucauucugaguucacgggaacgggagaaacugaacccuuuuagguugaucaucagcuugaugugaagggacuugagagauucucuaaucuauucuuuccuuuaacugguuaggaagcagaguccaagagaaaugcccugcccagggucuggcagaacugauggagagcagccuucguggcuaccaccuucccauaaagucugugcucuccagcggcgcuugguaauaagauuuauuuaaugacacguguaacucuaagacuauuugugauggcgaauaccacagauuugacuggguaaugugauauuuguuauuugcuuuaaguuaacuuuagccuuuagcacagugugauggaaagggcaccaaacuugugaucuagaagacuuggguucaaguuucagauuugaauuagcuuugcuucugcaaaucugaggacccuauuuucuuaauccaugaaaugggaauaauaauacucacccaauuuaccuuacacagucgugaggauucauuguaaugggcuuuguaaaaauauaaagugcuauauaaacauaaggguguuaaucuccugucuuuggugacaggcuaaaaagacauacuuguuucaaauuuuggauacucuaauuugcauaaucuuacacauucucuuucucuauuuuuaacucuauguuuuccccaucagauuuuuuucuguuaggaguuacaauaucucucuucaacugggcuuugccucaagguguauaaacuuaaagcauuaucuccggugcaguuugucagugucucggcauauuugaaauuuuuaguacugcauuugguauaugaaagcugcauccuauguaagaccauaggauauuuaaacagauguucaaauuucuauugugaaaauccuagcucauuccuugcuagagaugaagcacugaggacaguacaaucaccaccuuaaaacaaaccaccuaagcacagcuuuggcugcacagauuggaagggaaucugguaauuacacucuuuaguucuucugugaauauaaccaaucugggcaauuugggcaccagaguggauuuuuaggcaugaauuaucugguuaaguuagccagauaauugccagcugucucccgugcuuucugcucuggagaccccagccggaguaauugucuucuguuuacucaugcaagcaaguugcugguuuccauuuucaaacaaaaacuaacugcauguuagaaugguauuuuaauugagcuauuuuuguugcugauucagagauucccccacccuuugccaaaggaguugcccagauuagaacccauuaauuuaguugauuugggggguuccuuguugacuuuggggaagacauaaauauuauaaaagagauuuagaaguugaugguauaagguuuuccgaaacauucaaaacuuaucucaaauucugaccaaacauuuuucuacuaauuuuccuaacuaaauggaaacuccagcuguauaaauaaugauuuuuguuugaaaacauuuuuucucuugauuuuagaaccaucgagggaauuaaauuauaaauaaguagcaggaaagaacaacuuugucaaugugaaacagaaugcaaaauuacucacauuuugaacugaguuccagaauguaaagcaacgcuuuagcaugggcugcugaagcgagcugcucuuuagggaggaggaggaggcuuacugagacguuuuguuuguuucuuuauuuuauuuauuaauguauuugccauuucuccauuagaucugauuuuaauacuguaagucuuuccacugauuacaagugcagugacaugucccucugcaaccaucauuuuccucccauuuuuucuuuucucuuuuuuaaagagacagggucucugucacccaggcuugcauacaguggcgugaucauagcucacugcagucucaaacucuugaguucaagugauccucccaccucagccuccugaguaacuaggacuaggugcaugccaccaaagccuggcuaauuuuuuaaauuucuuuguagagaggggucucacuauguugcccaggcuggugucaaacuccugggcucaauccuccugccucggccucccagaacauugggguuacaagcaugagccacuguaccuggcccuccuccaauuuuuucuuaagaaaaaagagaauucauacuucauuuaccugacaguccucaucccauuuaaguguauacaauggaaauacguacauuuaugaccaauauuggucucuuucuuucuguagguuugaguuuugauuauagacuucgauggagaaagcaauggcgccacaacccagccagggugcccugccaggacuuccucaucucuugcagugaaacccccuuaucaaacauuacgugcuaucuggcccccuuugucauacuuucuugcacuccacuuacuacauaucaaggauuugccauguuguggaaaaguugguuucauaacauauuuugaacucuuauuuaagggaguuguuuuucuuauauucuucauuccacaaauacuuaaccaaggcauauuuugccacagguacaugacuuccaaagaaaucauaacuauaguuauccaaaaaaauuaaaauaauuuaguaauguccacaucgucuuaaacacucuuccagaauguuccaaaggaacaaaugguugcagugacuuuuaacuuuagccccagccuacuuccagcuaaggcaguucucacugcagauauauguauucauugguccaaagaaagagagaggaaaacuuggcucccgaguauuuagagugaaugauucacgauucuguacaugggagucuuggcuccuucucugucucucaggcuuuuugguaggaagucaaugauaccaguagaaaaaaggcuguuuuucugacuuaggauuugguccgcucucugcaacccacuagagaaacugaaguuuucuuuccauaaugaucugaaguguugauaguuaccaucucuguaaaagcucauuaaaaaaugacuuauuuuccuuuggaaggagaggucacaugcuggagcuagcaguggaauaucaggaccaaggaucauaagccuccugcuguaacucugguuuccagauuuauuugagccuacuucugccagaaguaaauuuggugggcaucuugaauggagaaaugaacagaugaucaaggagagggaaaagggucaggaguaggggugggaagaccccaaaauccagugaaaagggucagggguaggggugggaagccccaaaauccaguguggcagauaaggggaggcccaaaauccaguguggcagacaaggggugagggcauccgaaacacacaguuuacuauuuuaaccauuuuuagguguaugauucaguagcauuggcuacauuuacaauguuaugcaagcaucauccauguccagauuuuuuucaccgucucuaacagaaaaucuaccauugaacaauaacuccccucccaucccucuagucccugguaagcucuauucuacuuucugucuguaugaacuugaccacucuagauaccucauauaaguggaaucauaaaauauuuacccuucuguaucugccuuauuucacuuagcacaaugucuuuaaguuucauucauauuguagcauguaucagaaucucauucuuuuuaucucugaauaauauuccaugguauguauaaggccccauuuuguuuaucuuuucauucaucaauggacauuugaguuguuuucuucucuuggcuaucgugaauaaugaugcaaugaacauggauguaugagaguaucuucuguuugaguccccuuuuaaaauuccuuuggguauauauccagaaguagaauugcuggucauaugguaauucuguguuuagcuuguguuuuuguuuuuguuuuuuugagauggaaucuugcucuguugcccaggcuggaguguaguggcaugaccuuggcucacuacaaccuccaccuccuggguucaagcgauucuucugccucaaccuccuaaguagcugagaucacgcguggguaauuuuuuuuuuuuuuuuuuuuuuaguacagacagcguuucacuguguuggccaggcuggucucgaacuccuuaccucaagccauccacccaccuuggccucccaacgugcugggauuauaggcaugagccaccgcuuccggccauauguuuaacuuuuugaggaacuaucaaacuguuuuccacagcgggugccccaucuuacaauccuacuagccaugcacuaggggauugacgcggauccuuucuuugacccauccgcaugucacccaaccuuuuuuuuuuuuugcuaaccagcaguuugcucaacaggccucauccucauucaucacugggucuccuuuugcuguuugccgagucugccugccccuuugguguuggcuuuggcuagagaaaggagcauauuuguuuugcuacugaccugguuggacaugcaugccagccuguuuaugaggugcuuucucuggcugagggagucaggggcugugcaacuguauucuuuagugugaaggugagccaacacagcgaaguaugcucgcccugccuccuccagaaacaaucugccuuugagucuuuucauucuccugguaaccgucuucuuaauagcuguggcuucaucuaaaugaaaaauuuaucuugugcugcuuacccaaaggagaggcuccucacaugucagauauuauuucaccaauuaucucaguaacuucugugcuuuuuauuccugaaagcaaaguugagaaugaugcagguuuccacaacaugcgguguuucgugcauuuuuauccuuacguaguuacaagaaacaaagcaaaauuuagaauuauuugaaguacuuuuaacacccucaauuugauauguuguguguauauuuauaucuggacacaauucuuuucauugaacaguauagacaaagcauuuagaggacaguuaaguuucuccaauaaucauguuuaaacauaucucaggccgggugagguggcucaugccuguaaucccagcacuuugggaggccgaggcagauuggaucaccugaggucaggaguuggagaucagccuggaaaacauggugaaaccccgucucuacuaaaaauagaaaaauuggccgggcaugguggcaggcaccuguaaucccagcugugcaggagacugaggcaggagaaucacuugaaccuaggaggcagagguugcagugagccaagauugcgccauugcacuccagccugggcgacaagagcaaacugucucaaaaaaaaaaaaaucucaaaucuauuuuuuaaauuuaaccuuugaaacauuuguguaacgcagguggcucaugggcaccaccaucuucuuuuggcagaugaggaaacaaaccugucugucaacacagaaagcugggucugcucaagaauugcugugggguacaguggcaauagcagggacaagagggaugcagggguccugucuucgugucuguggaccagcccuucucaaaguccacggcugccccucuuggcuccauucuuugucucuucauggaauuguucugugggaauagucugcauauagugauucugcauuccaacaucuaacuucccugugccuuccuauuuacaaaagacacaguuucuugaccugaaauccccaguuugggauuauuaauaacauuuuuuuguaaccuguagugcuucagauacugucucagccuaugugaauucugguagcauuauugccuuauagaaauuauuugacaggccagaugcaguggcucauacccauaaucccagugcuuugggaagcugaggugggcugauugguugagcccaggaguucgagaucagccugggcaacauagccagaccccuaucucuucaaaaaaauuuaacagggcaugguggugcacgccuguagucuuaguuacucgggagagcgagaacccaucucugaaaagagcaaugcuagagguaagaaagucuaucuuuguuuuuuuaagcugguauucccauucugccccccaauuuaucuucaccccuuucaaggugagugcuuugugauggcccuaacauuuauuuagucuaaacaaaagaaaaauuauuugagaguuaauugugugugucuguacugcaugucuuccgucaaauuaaaaguuaacuauugcauuuuauuuauuuuaccuuaauuucauaucaaguacuuucauacuuuuuagcuuuuaaaaugacagaggcugggcucagugucucacuccuguaaucccagcaccuugagaggccgaggugggaggauuacugaagcccaggaguucaagaccagucugggcaacauagugaaaccaggucucuacaaaaaaaaauuagucaggcaugguggugugcgcccauguucccagcuacuuggaaggcugagcccaggaggcagaggcugcaguuagcuguguuugugccucuacacucuagccugggcagcagagcgagaccuagucuugaaaaauaaauauaaaauaauagaaugcucuucccagcuagauuguaagguuuuuauauguuaguguccccaugguauauuguaaguuguagguacauaccccuauuuauuauauguuaugguguuuuuaggcaaugagauuuuuaauauuagcuacucaugauucgcaacaaguucggucuuuaugaaauaaacuucauucaaaucuuugaauuccauuuuuaagugcagcuacaguugauaccuuagacaaaugaaagauuugucuacuucuuaguucauuccuacagaaaauaagaacaucuaguaucuaauaugaucccucgugggcccucaagaaauacuagucuuuuuuagaaagucuagucgugggucuguuucucuuuauuccauugugucugccugccuuguuauugcugugucuagaagaaaaugaagaaaauuagcauggcuccuuucguugcuguuuuguacaacuuuuguauccucacucagaagcaagauccuuggaaaugaaaugcuaugucaaaaaccagacgaaaaaaacacaacaacaacagaaaacacauuuuuuauaacuacucgauucaagauuuuguugcuaggucuuggaaaauguuguaugucaacccaaaggucuugggaagucccccugagucaugaaugggugugguaggacugggauguggaccucugggcuuugcuucugaugauaacuucuccuagggcagcagucaugcuggggacagccguuuugucuguuuaucucuaggccuugcacugucccugucauauaauagaugcucaauacaugucuuuugaacugaacugcauuggccuggccaugguuuaagcauuuggaccaauaacacccugagugucaaguuccuccucagucgggcuggagagucgagagcgggucauggugaguuggucuuuuuguguaagaaucccuaguggcagcagcgccuuguacuuaaaaauagaauacuaccaacaucaucuuccuucccaggaugacaaggcauugagaaaauuagaauguguauauuuucucccuuuuuuuuuuuugagacagucucacucugucccccaggcuggaguacaguggcgcgaucucagcucauugcaaccuccgccucccggguucaagcgauucuccugccucagccucucgaguagcugggauuacaggcccgugccaccaagcccagcuaauuuuuguaguuucaguagagacgggguuucaccauguuggccaggcuggucucgaauuccugaccucgugagccaccgugcccggccucuccauuuucuaagacaugcguuuuuucauuuguacauacguaucuuagcauugauacccccucuacauuuguuuauaaaacagugguacaucuuguaaucaguagcuucuuagaacugaggaauucguuuugucaucacucugaagggcaguuuagccaguacaguaagucuucacuccauagguucuuggaaauugcaauuuuaaaugaaugagauaucaugaaagcaauuugaccauaggcuaauugauauacauaagacuuaaguuccuuccaaaauacguacaauguuaaacacugaaauaaagguaagcuauacauacauuuaagaaagauuaauuuaaaaacaaguaagaugauuauuuaaucaguuauuccagcucgggguuucugguggauggagccugucccagcagcucagggugcaaggcagggcaccagcccuggacaggaugccaucccaucacagagcacauucguacacagccagagucacucagacugggacaguguagacaugccacuuugccucaugugcacagcuuuggggugugggaggaacccugaggacccagagaaaacccacgcggauguggggaaaacguggaaacuccaccgauaguggccauggccaggaauccuuuuuuuuuuccucauuaauguuauaacaaaaugacauugaaugaaauguuauucaaggaccugcuguaguuacaaauugguuauuagacggguugaagucucugcuuggccacuuucuagcugacguuaaguuucucaucugacuuaaaaguccaggaaagacgaaaugauauuauuuagcacagcagccugacuuauaguagagcaucaguacauauuaccuauaguuguuuucaugaaacuauuucaccagaaguuuagggauuuauccucaaaggcauuaggagugccuacacggcacauaagggcauuguuuuguaucauaccacaaguagcacuuaagguuggaaucauugcugaccccaauguaaaaugccucuuucuggaccagaaaauggaaagugaaauuugcaauucaucccauguuauuuauuuauuuagagacagagucuugcugugucacccggacuagagcuggagugcaguggugcaaucuuggcucccugcaaccucugccuccuagguucaagcgauucuccugccucagccucccgaguagcugggacuacuacaggugugcgcuaccacaccugcuaauuuuuguauuuuuaguagagacaggguuucaccauguuggccaggcuggucucaacuccugggcuccagugaucugccugcaucggccucucaaagugccaggauuacaggagugagcaaccaugcccggcccucuguauuuuugaugggauggaugguucaacauuuaaagagaaccuaaaaaguuaaaaguaaaagcaaagaagucuuaauaacaaaaagcaccuucaugcaaugucacuguuuuacugcaucuuaauaaagaaauguggccaccuuagacccagaauauaaucaauuuuuaauugucuuucuuggauaauaucaagauagaguguaauaaguuagguuaacauauuagcuugcaucuugucagggaaaauagguagauccucugaacacagaggaaggagggacguccacguuuguccuguuuagugucauacugaagaagaguaugaccagccagugcugggcguucugcagcuugggacagauguuggggggaagggcacugccuuucuugugaacuuucuugcccaagggacaaaugagcuaagcaguacuacguuauuagugggauguguauguguguguguguguaugagagagagagagagagaaagagaaagagaacagagccuguaagucuugccauuuugccuuuucagacaacccacccccaccccucagcauaggaauguaguccuaaccccaagccacugcuucuucugcuugcagcucuaaacuugagcaggucuugggggcaguucaccagugcaccacacuacacuacucucagcaaucuuuuuuuuuuuuaaacagugauuugcacugaucuagccucuaagggguaagggccgagaugaagcagagaauuuauuuuuauauuaugucgucuggugcagagacugcuacaaaaucaggagucaaaaaucuaagggaauaggcugugaagucauuuuguccaugaguuguguuacaacacauucauucauuguaaacaaucaccaacagucauugccauaauuuauucuuggcaguaaauuggguuuucuagugacagaguaagccaucagaauuaagcaaccaggagcuccaguucaugugugcuggaaaagauguuugcgagacuucagguaccacuaccucauauuaaaggugagcaaguggaggcccagagagggcaggugacuugcccaaggucacacaguggguuagagccauaucaaggacuagaacauugguaauccaucacaucguccuuaaaccuuucugccccacuuccuguugacacaauaggcaggauauuaaacuccaguuucauuccuggggauugauaugaaagguuuuuuacuuguccaaucccauuuuccuuguccaggcagaugacagguaguaauuucagaaacugagcaagggauggugaaagcuagauuguagugggcucuuuuugguuugguuguuaugagcgcucucaaugcaaagcuuagaaaccucuccagagaaauaaucagcucuccaaggagugcucuugcagacuagcauguugccuugcuugcugguguguaucuuccuauaaauuccugguauccaguguccauacaggagaaauuggcugacuuguuuucuugcuguguuguaugacagauaaucagaaauguaacucuggugccuugucaugugcccagaggaaguuaaaugugcuugccuuuaauauguauauguauacacacacacacacacacagcaguuagaaaauagauguuuguaaaauaugauuuuuuuagggaauauguaaaaacuggcaucucuucagauagacauagagguacuuaaaaaccuugguuaauaugucuuguuuguauacuccaugugguguauuuuacacaguaucuaaagguguugccugauuuugaauuaguuaaaagacagguuagagacgugggagaagaguauguuguauuucuugucugaucugaggaauuuuauauuccugaagucuauaauuaggugcuuguguugauuguuuauugaaacaaagcugaaggugggggugaggggagugccacauaguggaaaacacucuauggcaaacaucugagcuuuacuuaaaagcaugggcugcaaagaaauguaaauucauuggcuuaauuggaagagaguauuuauagaaauugaaugauccaguaaaacuaaaagccuggcuucuuucaucuucagagaccugccuuaguaaaugcuguucuggaaaucccuugccugcaaaguggacuuugccauccaauuucuggccuccuggcagucagucacuuugaccuaacccuauugcuugacucguauuuacuacguacuuuccuuuuuuggcuuaggguuguacugaaaauguacauguaaagaaaaaaauguccauguacacugaaguuuucugauuuuuuauauagcuccauaauuugauuucaauaacuauuacaaagaaacuuuuauaagaagauacaauuugaaaaucuugcugugcagccucuucccaucuacucugccugccuacuacgccuuuuauaguucaccauauccauuagguucucgaaaauucuuccacuguuuaugcaaaucuuuaaauuuuuaaauacuuuuauuuuccuucuuagaaaaggugacaacuagaugcuauucugcaccuuguuuuuacauggaaucauauaccuuaauaagcuuuucagacacucuuucaaucuucugcuauuaugaaguugcagugaauaaccuuguauaucacuucauacaugugcagguauaucuguaggguaauuuccuauaaggggaucaggauuugggccagcagauaugugcauauguauuugugaucguguggcuagccccuccuuuuuuuaacuuuuauuuuaaguuuagggguacaucugcagguuuguuauauagggaaacucgugucaugaagguuuguuguacagauuauuucaucacacagguauuaagccuaguacccauuaguuauuuuuccugauccucucccuccucccacucuccaccuucucugguaggccccacugucuguuccccuuuauguguccauauguucuuauaauuuagcucccacuuauaagugagaacaugcaguauaugguuuuccguuccuguguuaguuugcuaaggauaauggccuccagcuccauccaugucccugcaaagaacacagucucauuauuuuuauggcugcauaguauuccgagguauauauguaccacauuuucauuauccggucuaucauuggugagcauuuagguugauuccaugucuuugcuauugugaauagugcugcagugaacauacgguaugcaugagucuucauaacagaacaauuuauauuccuuugaguauauacccagaaaugggaaugcuggguugaaugguauuucugguaguuuuuuugguccuugagaaaucgccacacugcuuuccauaaugguugaacuaauuuauacuuccaccaacaauguauaagccuuuuuuuuggcaaccucaccagcaucuauuguuuuuugauuguuuaauaauagacauucugucuggugugagaugguaucucauugugguuuugauuugcauuuuucuaaugaucagugacauugagcuuuuuuucauaugcuuauuggcugcaucacaugugugucuuuugaaaagugucugcucauguccuuugcccacguuuuaauggggcuguuuguuuuuuucuuguaaauuuguuuaaguuucuuaccgaugcuggauauuagaccuuugucagaugcauaguuugcaaaaauuuucucccauucuauauguugucuguuuacucuguugagaguuucuuuugcugugcagaagcucuuuaguuuaauuagaucccauuugucaauuuuugcuuuuguuccaauugcuuuuggugucuucgucaugaaaucuuugcccguuccuguuuucagaaugguauugccuugguugucuucccggguuuuuauaaaaguuuuggauuuuacacuuaccuuuaauccaucuucaguugauuuuuauauaugguauaacgaaagaguccacuuucaaucuucugcauauggcuagccaguuaucccagcaccauuuauugaauaaguaguucuuuacccguugcuuaauuuuugucagguuugucgaagaucauaugguuguaggugugcggccuuacuucugggcucucauucugucccauuggucuaugugucuguuuuuguaccaguaccaugcuguuuugguuacuguggcccuauaguauaguuugaagucaaguaguguaaugccuccagcuuuguucuuuuugcuuaggauugccuuugcuauucaggcucuuuuuugguuccauaugaauuuuaaaauaguuuuuucuaguucugugaagaauguuguugguaguuugauaggaauaacauugaauguguaaauugcuuauguuuucccauuuguuugugucaucucugauuucuuugaagaguguuuuuaauucuuguuguagagaucuuucuaguguauuccuagguguuuuauucuuuuuguggcaguugugaaugggauuauguuucugauuuggcucuuggcuuaacuguugguauaugggaaugcuagugguuuuuguauguugcuuuuguauccugagacuucgcugaauuuauguaucagcuuaaggagcuuuugggcugagacuaugggguuuucuagauauagaaucauguugucugcaaacagaggguaguuugacuuccucucuuuuuauuuggaggcacuuuauuucuuucucuugacugauugcucuggccagggcuuccaauauuauguugaauaggaguggugagagagggcauccuugucuuuugccaguuuucaaggggaaugcuuccagcuuuugcccauucaguauuauguuggcuguggauuugucaucgauggcucuuaauauuuugagguauguucauucaauauguaguuuacugagaauuuuuaacaugaagcaguguugaauuuuauugaaagccuuuucagcaucuauugagauaaucauguguuuuuugucuuuaguuguuuaugugaugaaucacauuuauugcuuugccuguguugaaccaaccuugcaucccagggauaaagccuacuugaucaugauggguaagcuuuuugaugugcuaguggguuuguuuugccaguauuuuauugaggauuuuugcauagauguucaucaaggauauuggccuuauuuuuucauugugucucugccagguuucgguauaaggaggaugcuagccucauagaaugaguuggggaagaaucccuccuccucaauuuuuuggacuaguuacagugggaaugguaccagcucuuuguacgucugguagaauuuggauuuggcuguaaaucugucugguccugggcuuuucuugguugguaggcuauuuauugcugauucaauuucagaguucauuauuggucucuucagggauucuguuucuuucugguucacucuugggaggguguauguguccaggaauuuauccauuucuuuuggauuuuauaguuccugucgcuugcccuuucaguggacuauuuuuguuuuuuuaaauggaaugcuucacaaauaugccccuuccuugcacagaggccaugcuaauuuucucuguauuuuuccaauuuucauauaugugcugcugaagcgaucacccuaaguacuguuugauuuuugcacuccugucaacuuaauuagggcugcaccaauagaguggguuaucaaacuuuuggauuuuugccaaucucauuuguaaaauauacuuuauugauaugguuuagauuugcauaccuuuuuuaaaaaagcaaaagccuggacaucuuuucaagauguuuaaaggccauuuguuggccaggugcgguggcucacaccuguaaucccagcacuuugggaggcugaggaggguggaucacgaggucaggagauccagaccauccuggccaaccaacauggugaaaccccgucucuacugaaaauacaaaaaaauuagcugggcaugguggcacacaccuguagucccagcugcucaggaagcugaggcaggagaaucguuugaacccggguggcagagguugcagugagccgagaucgcaccacuguacuccagccuggugacagagugagacuccaucucaaaaaaaaagaagccauuuguuuuucuuguuucuuucuuuuuguuuguuuguuuguuuguuuguuuguuuugcaaacuguacuuaauuccuguacgugauuuacucuucuguuggauucuugcucuuuuucuuguugauuuguaagggcucuuuauauaauagggagauuagcucuaagucugugauaugaucuucaaauuuuucuugguuuaucauuuccuuuaguauuugugggguuuuuuuggucuuauacagaauuuuccauucuuucuuuuauggcuucuggauuucgagucacagaaagcauuuccaccaaccccuuccacacauacacgcacaagaauugacccauauuuucuugcagaauuucuaugcuauuacuuuuuuuacauuuaaauauuugcuccauuugagguuuauccugauauucuguuaaguauggauucaaguuuuuuguuuuuguuuuuguuuuuguuuuggaaauaggcucucacucuguugcccagacuggagugcaguggugcagugacggcucacugcagccucgaccuccugugcucaggugauucucuugccucagccuccugaguagcugggaccacaggugcacaccaccaugccuggcaaauuuuauuauuuguggagacgaggucucgcuacauuguccaggcuggucucuaacuccugggcucgggcgauccuaccuccgccucccaaagugcugagauuauaggcaggagcagucgugccugacucaacuuuauuuuuuguagauggcuacccaauuucccuaaccacuuagucaaaaugcccaccuuuccucccacugaagugccaccauuauaaaguaaauauuuuguaaaugaaaaaugcccacuauucccuuguaaaacaagaaacugugggucaccauuuuuuggaaagaauguuucaguucucuuuuuaacucaagacagcucuuccacuuuguccuccaaggauaauauuuacuccagagugaaugaaugagguuaacaacccaccugcuuguuucucccuaguggaauguuaacauuuugccucuuggcacaauucucaagauuuaucuuaagacccugucuccuuucacucaaaguauuugucucuuuaucacaaagccugaagaaacauuucuuguuacucaaggaccaugccuuuuaugagcccuaagaacaggaguuaucaaaguguggucuuccccagaccagcagucucaacaucagcugagaauugucagaaaugcaaacugcuauccuugagcuacagaaucagagacccuguguggacaagcccaacaaucugaauucaacaagccucucagguguuucugagcaugcucaagauugagacccaugaccuuagagguaauauuuaauuucauaauggcaguuuacaacccuauagcacugccuugugggcggauggguuugguccuaaucuucuugacauguaaaaauguagacucacagcaggaagugauaauaucuguucuuuaaaggugguauucuuagaguaggaaacuuuucugaguuuuuuccaggagucacaaagauaccucacuaggaccgcuagugcuuuggacuagaacaccuuacauccagaaucuugccacugggucagugcuucccuuugucauauaauaaaaaaccagcaaaacugguuucuauaauaugcuaaggaguuuuguagcguugaagacuugucuuacccccacaaaagcaucauuguuccuucucaucccuugccccucugccuuuaaaauuaauuugauaccagaauggcaaauacuucugaugacuguuagccacgccauaauggugcuuguauuuggcagguuaaggcagaguucccauaccucugagccuaauugccagccaggguucagcucagagcaguaguucuaaaguuuuucuggacauuagacuccacuggauagcuuuugaaaauucaacuacccgggccaaauccauguaacuaauucuauaucucagggguggaacccagggaucaggauuuuuuuuuauuacccagccgaugacaauguauaucgaaguuaguuuaagaacaaaggaugugcgcacuuguuuuaaaguaguuuugguuaugauaauaagaauuauaagagggaccaaauaucaaaugcaagaaaaugguccugaaugccaauacaaucagaauaagaaaugcauaaauagcgacuugcuugaagcugaaaucaacuccuuuuuggaugccuuucuugucuuuugaagaacacauguuguaguauguguuucucuccauauccuguguguuucauuguaauagucuugcugauugauuuuguuggcugcaagcaaagugauaaaaugccagugggugccugugccagggaggucaggacuggacuuucccacuuggcucuguuuugaugcauuuagcagauugauuccaacccucuuuggagacucugaccuacaaaagugucuguuaucuuugagagcuccagggaaagcuauggaccuuucuagaucuuuucccaccuuuuggcccaucagauauugccuuguccacagcagaacuugacgauucaucauagaagccuaugguuuuauuuauugacacugcuguacaauuuucccuguagcgagucauaguuggcugaagagagagucgaagauuaaguacaaaacuuucuaaacauccuguuuucccucaagacagggcacuguucuuaauaaacugaacauucuuuugcacuggcccuggggcaagggugucccaaaagcuuugacaggggugccauuuggucauaaacagugugguaauaggguggagucagaaagaaauucucucaucccuuuuacaacuccaggcaauucuagaaccaacccuugggaacccagggaaagaacucugaaaugauacgcuggcugagguuugccguggccacaccucaggguuaagcauugaaggagcuaggcaaagaguguguguguuuagcuacaaacuaagucacagaucaagaggcuuuugguauucuuccauuuuugcuuagaauucuaugaugguuuuugaaauauauuguccuuacuuuauguucuuaccuguaaucucauaaguuucugguaaauuuagcuuuugccagguuccggugggucuuacccagagauggucagaguaaaugaacaaaagaaggaauugauuaggaugugaaacuucagauacgcucacaggccuucaagcccuagaaaguaguaugccagugaauuuucuaguccucucuacacuuuguacagaugaagaaaccgagacccagggaacucaaccaagguuucuugccauuccuccagucccccaguuaaaaaaaaaaaaaaaauuagguucuauuuugcaaacugacaaggagaauuauacaauggaaauaacacucauuuuaauguaucuguucuuguaguuucuuauuuuauucaccuuuauaaaccauucugagaacauugucauaaagagcauucuccuaaauuggaaugugauucaaauaguccugucuccuuuccuccuugcuuuuuaugaaaugacugccuacacgcacucgcgcacauauuuuagugagcaaugcaaugugcgaauacaaauagaaauagauuuuguuaaaaaaaaauuaaugucaguccacuaguuaaaaaaguaccaaagucauuacaagauucauuaacuauguuuaagaaaaguauugagggcuuuuugggggauuaaauaauuuuaauuuauaaauaauggccucagauucauaaaccuuaacugauuguagagauuaugaagguuuguuucucacacaguuaauuauuuguugcuuuuuaaauaaccagauaauuacuuugcauuuguaaugauuaauugcaaaaaguugguuauaagaaucccuagaugaauucucagguaagaucucaugcagaauucuuugaaguucauuuggggucauuuaucaagaaaagcaaugcauuucagguuuaugaacucacuuugcccacaggugagguuuccaggcuucgaaccagcaggaggagagucagugggaggaucugacguagguauggcuucagagaugaagagaguauuucuccuccgcacccccuuugccuacaccuagaaauaaguuuagccuagggaaaaaauguucccugacuugucagguucagcuaguguacccuuugagauccuucauucucucuuuuucuuuuugagaagaagucuuacucuguugcccaggcuggaguacaguggucccaucuuggcucacugcacccuccgcaccccagguucaagcgauucucccgucucggccucccaaguagcugggauuacaaaagcacaccaucaucccuagcuuauuuuuucuuuuuuuuuuuuuuuuuuuuaguagagaugggguuucaccauguuggccaggcugcucgaucucuugaccucagguaauccgaccaccucggccucccaaaguggugggauuacaggugucaaccacugcaccuagcccguucucucuuuaaucucccaauuaacgaacaucuacugcgacagcauccauuaccuagaauuguaggaagguauauaggauagacguagcaaagagguaaguggguaagaaaauaaacacucauaaaaaggagacaaacugucagagugguccccuagcuacaccugccacaauugccuccugagaaguccuuguucugcacgagcuaaaauucccauucaaauaaauuguugcucuuccuauaaucauugagcugcugaauagagccaggguccuugauagacgucauaguuuguuauugacuuuaucaccaguaaaaguuaauacugucaucccuuuccugcagcaacacacuaccauuuuuuuuuccaaaauuaauuuagguaaagaacauuuuucuuaguauaauuuucauugaauucaguauuaucaaguuuguauauuuuuagagcuuuuggaucgcuauuccagcccacauuuuucauagcaauuugucuaguauuucuucaagaucuuuuuauguucauuugaaaaaugaacaugacuucauauguauucauuagcaaucacugccguaggccuuucuguuugauuuuucuucugaaccucagagauaguggcucauuaugaaguagaaaaaggcuaacuaagaccuuguucugaacuuacaguggguaagcaagaggcuucagauccauaaucucuaucaaaauguuugcccacauuacuguaacagggagucauucagaaugagaguggaggaauuugacuccuuuuaaagaaucgcgugugcuuuuucuacuuucaugguugugucguuuugccggggagauuuugaaagagaagacucauaucuugucuuccccauaccgaggggucuuuaaccccuaaucuauaaauuaaauagguaggucaagcaauaccuaccagaguugguugcucugcccacuggcuccucucugcaccucccucccagaccauuucuccacuuccucagccuuagaaaaaacagcucacucaugguggugcuugccgguggaccuuggagauaagcuucuauucuugguuguuuuuaagaaaacugaauucucuucuuagagccaacccauaucuuaucaguguaacuuuacucacucuccaagcccuaauuccauucuguccuuuaaacauuaggagauuucccaaaaauaggcuugucaguaaaacucuggugugacaaaggggcaaaaguguugcuuuuuuguguggagauugcauuuuuaauauucuguuccccagaagugguuccaggaugcuucccuagaagucuuugggaagaacaauuagaguaagaaagguucuuccauuaucugccccaggcugggugucuucggaugacucugucaccucacaaguuguuuaauccuguauuuagcuugucagggaucauacgaaauggggucuacaucagauuuuccacaguuguuuuuuuucuuuagugauauagccuggaagggcugggggcgguggcucacgccuguaaucccagcacuuuaggaggccaaggcggcuggaucaccugaggucaguaucaccugagaccagucuggccaacauggugaaaccccgucucuacuaaaaauauaaaaguuagucuuagccuagcgugguggccgacaccuguaaucccagcuacucgggaggcugaggcaggagucucacuugaaccccagaggcagagguugcagugagccaacaucgugccacugcacuccagccugggugacagagugaaacuccaucugaaaacaaacaaaaaaaggucauauagccaggaagagcuucagugggaagaacagcaggaggaaugaagucccacggguuaucugaagagauguacugauuucagaacagugaugccagcuaugaaaacuaacuaccacuuauaucauuagaugaagagccuguucugaaaccucccguuaccacuauauuauguuuaaaaaguauacaucugaacagucaguguagcugaaaauugaugucaccguuuacauugauuuuuuuuaauacauagaaaauuuuuuuaucuuaacaaauuaaagguuuguuagaggauccacuuuccuuuaauuaaaauaaucgauauggaaguacacaguaggcauuggauacauuuuuguuuccuuuugaaaaucugugaguuacagccagacucuucgucccagcacuuuaggaggccuaggcgggcagaucacuugaguccaggaguucgagaccagccugggcaauguggugaaacccugucucuccaaaaauacacaaauuagccaggugugguggcgugcaccuguagucccagcuacuuggggggucgaggugagaagauugcuugagcccaugagauugaagcuacagugauugcaccacugcacuccagccugggcaacagagcaagacccugucucaaaagaaaaagaaaacuugugaguuaccuaccuuuggggaaguggagaacugauguuauagaaaugggcaauaauccuaaaaucuggggguucccauugcucacuucuuuucucucauccgcucauucauucuuucacuaaauguuauucuuugucaguguucauagaggcuucccacgacuugucucccagaagcccagcugucucagaacuucucacgggcugacugguuccuccaauuucccuagacuuuuuuguuuguuuguuuuuaacauguguauccuuuguuuuuauucuauuuucaccaauuuuacaaaugaauuacacagauuauguauucccacacacauucuaucagaaguauauaggauguauuagcgucuucagcccuuccccuucuccucacuuauggacuuccuuccaggccuuuuucuauguauuuucaacagugguuauuuuggcuuuacauuggaaaccaugccuuaucuacaguucugacuuguuuuuuuccuuacuuguuaaaggaaagauguaccuuggccauagaauacugcagguacauaauguucuauaauauggguauauaagauaaaaugguuuauuuaaccauucccuuuuaaugaacaauagucauuuagauuuuuaacuuaccccuguugauuauagugcuauaauaaacauccuuauacaugccuuccugugcauguuuuucaguauuucucuaagauaaauugauucccagaaguacacuuguagagucaaaaagucaugcauguuuuggccaggcaugguggcucacgcccguaaucccagcacuuugggaggccgaggagggcagaucaucugaggucaggaguucgagaccagccuggccaacauggugaaacccuaucucuacuaaaaauacaaaaauuagcugggugugguggugcacaccuguaaucccagcuacaugggaggcugaggcaggagaaucacuugaacccaggagauggaaguuccagugagccgagaucacaccacuacacucuagccugggagacagagcaagacucuaucuccaaaaaaaaaaaaaaaaaaaaaaaaaaaagccauguauauuuuaaauauuaacacugccagguaauccuccaaaauaguuauacuaagucucaugcccauucuucugccucacuaauugacacuuguuuuuaauuuuuuaauuuacuauaaaacauuucagaugcaaaagauagaaagaauagcacccaugaaaugacauuaacaauacauuugaaggucgggcacgguggcucacuccuguaaucccagcacuuugggaggccgaggugaguggaucacaaggucaggagaucgagaccauccuggcuaacauggugaaaccccguuucuacuaaaaauacaaaaaacuuagccaguugugguggugggcaccuguagucccagccacuugggaggcugaggcgggagaauggcgugaacccgggaggcagagcuugcagugagccaagauggcaccacugcacuccagccugggcgacagagcgagacaauacauuugaagucuuguuucucuccccaaaugcauuguuuuuuccacuacauuucccuucauuucucauacuuugccuguguuguguaugucuacuuuuacuacguauuuauuaaucuaaugcuauuuaguaauguuuucaauguuuuuaaaauuuuauaaaaagaugccguauacauucugagguuuuuuuguuuguuuuuuacucacuacuauauuugugugauuggccuguguugauaacuauagccuggugcuaaugcugcucuacaaauucuuguguacacauccuugugcauaugcgcaagaguuuauggugcauauugagaaguugaugguuuucacuaaauauugauaaaacucuucucccgaggggcccuccccgucaaccccuggcuucaagcauaguaucaguuucucguauuuucagcacuugguauuuuuagacuuugucauuuuugccaaccuuguaagugugagaaggcuauuucauuuuaauuuauauuucucugacuucguauuuuaauauuuucaaccauuuaguagucucuucuaggaauccccuauuccugucuuuuaucuaauuuuucucuuggguuauauguucuuuucuuacuggcuacuccuaauucuuuaccuauucuggauaauaaugcugagguagcuuaccuuuccauuguuuuacuguggccuuuuguugacagauagcacgugugauuugugcugcccucccgugcagucucuuguuuauaccucaguaugucuggaguugaguuuuguauguaguuugagggauccaauuuuauuuuuccgauacacaguuuauuaaauuguccauucuuugcaguaucugcagugucccauuuguaauauaugacaucuucauguauguguggagcugugucucgguuuucuauacuauucuuuuggucuauuuaccuaucgguaugccuguacauauuucacuaauucuuuuuuuuuuuuuuucugagacagagucucacucugucacccaggcuggagugcaguggcgugaucuuggcucacugcaaccuccaucucccagguucaagcgauucucccaccucagccuccuaaguaacugggauuacagguguccgcccucuuaccuugcaaauuuuuguauuuuuaguagagacaggguuucaccagguuggugaggcuggucuugaacuccugaccucagguaauccgcccaccucggccucccaaagugcugggauuacaggcgugagccaccacacccugccuaguucacuaauuccuauaguuacacaauaaaaaccuggguaucgggcagggcaggucucucuaucuuguucuuuuuguuuuguucucuuucucucucucucuuuuuuuuuuuuuuuuuuuuuuuuuuuuuuuuuuuuugagacagggucucacuguaucacccagccuggacucaaacuccugagcucaagcaauccuuccaccucagcccccauucacucuuuagugcagucauagcucacugcagccucaaauuccuaggcucaagugauccucccacuuuaaccucuaaguggugggauuacaggugugcaccaccagacuuggcuaauuuuuuuauuuugguagagaccgggucuugcuguugcccacgcuguucuugaacuccuggucucaagugauucuccugccucugccucucaaaauucugggauuacaaggcaugagccccacugcaccaggccaaaucucuuuaaaagauaaucaauuuuaaaaauuaguaaauuguggccaggugcaguggcacacacuuaaaaucccagugcuuugggaggcugagguaggaggauagcuugaagccaggaguucgagaccagccugggcaacauagugaaguccccuaucuguaaaaacaaagagagagauuuaaauguaacauauuuacccacauaguuaccauuucuacugcucuuaauuccuucgccuagaucuguuuuccauuugacaucauuuuauucuguuugaggcacuuccuuuaauauuuucucuauucuacuggugaagaauucuuucggcuuucguaucucugggaaaaagucccuauuuugccuugagauuuuaaaagguuuucgcuggguaugucugagaauauagaggaacuaaaaaccucaguuucuccuacuguaguuucacaucacgcuucugacaccagaugugcugagucaggggguacuuucccuagacaucaagcaagcaauucauucugcaguggacaccagcugggugucccccaguucaauucuacuucaucuacccagagauagcgucagaucccacagguugaaggcugagccccgcacaacugucccccacuuccaaugccagucgcaagccccagauugucuuaccuguuuuuuucugacugaauagcuauaaauugggguucccacaacccccuucuuggguuugauuaauuugccagagcaggucacagaacucagggaaacagcauuuacugguuuauuauaaaggauauuacaaaggguacagauaaagggaugcacagggcgagguaugggggcaggaguguggagcuuccaugcccuccccaggugugccacccucuaggaaccucuguguguucaguuauucagaagcucuccaaacccaguccuucgggggcuuuuauggaagcugcauuacauaggcaugguugauugcaucauuggccuuuggugaucagaugggcuguugucuguucaccuugaaacugccuugaaaugcaucauaaacacagcagcucuuugucagucaaucagagagcuguuuaucagacacugaagaauccagcagcuccucacacaguuccagagucaggccuaagggggagguuaucuccuccuugcauuccucagguagguagcaugaucucuuauaaaccauuuccauuuuaugauagaacucuucugggcacugccauccccauuacaguguuccugugacaucacccccagacagcaugguuauuucagguuucagggucauuuuguguucuucagucuaggcuccacacaggacuaugccuccaggauaugucuccaccagcagucagcuucugcucuacgcccuguggccuugggcaaccuugcuggcucccauuuagcacguccaauuaauauugcucaaaggguggauuugcaugccuucuguuuuacaguacuauguagggggagcauuucccacucagauguaauguccauugcaugauaaagagacacagcuauuucuuaugaaguguguucaaauauaccaccucucucuaaacuuuuaccuuaguuccaucaacccuuacuuuccuaacuguagccuucauuaggccuuuaccaacagguuucggucguacaauucaguacuagcuaggggaaguguucccuggacagacauaauauccauuccuauaaaucauuuagguaaagaggcacaacuuccuuauauaaagccuacuuaaacaucccagcuuugaucauccuagcaauccuuacauuuuuauguucucacaaucuuaacuguagcccaagucagggcuugcccaguggguuuugauagcacagugcuuaaggcucccauaucgaggagucccaggaauuauucuucaccucccagacgauuuucccacuuguguccauaaggcuguggguacccagcaggggacugggccaagacaccuuugcugucugucagucuuuuucuugauuaaucugccugacuauugccccaggcaauuucagaucagauccuucauuguaaucucugccucugacuuuuuaaauuucuccaaacuaggguaaauguagcaaacauuuuucaaaccccuuuaugucgagagaccagcaggacuucccuuugaucuauccagccuuccacaguguugcauuaaaacauuuguuuuaaccucauuuuauuucaguuuccauuuuauucaucccaauuuuuuuuauuuuccauagguuauuggggaacaggugguauuugguuacaugaguaaguucuuuaguggugauuugugagauuuuggugcacucaucacucgagcaguguacacugcacccaauuuguagucuuuuaucccucacuccccugcguccccaaaguccauugugucauucuuaugccuuugcauccucauagcuuagcucccaccuaugagugagaacauacgauguuugguuuuccauuccugaguuacuucacuuagaauaauggucuccaaucucauccagguagcugcaaaugccauuaauucauuuuuuauggcugaguaguauuccaucauauauauauauaccacaguuucuuuauccacuuguugauugaugggcauuuggguugguuccaauuuuugcaauugugaaucgugcugcuauaaacaugcgugugcaaauauuuuuuuugaauaaugacuucuuuuccucuggguagguacccaguagugggauugcuggaucaagugguaauuucuacuuuuaguucuuuaaggaauccccacacuguuuuccauagggguugugcuaguuuacauucccaccagcaguguagaagugcucccuguucacauccacgccaacauguuuuuggggugcggggcggggggugugggcagagucucgcucugucacccaggcuggagugcagugucgugaugucagcucacugcaaucuccaccuccuagguucaagcgauucuccuaccucagccuccugaguagcugggacuacucaugcacaccaccacgcccggcuacuuuuuguauuuuugguagagaugggguuucaccauguuggccaggcugaucuugaacucuugaccuccagugaucugccuaccucagccucccaaaaugcuggcauuacaggugugagccaccauggccagcaauuauuuuuugauguuuugauuauggccauucuugcagaaguaagguaguauugcauggugguuuugauuugcauuucccugaucauuagugaugcugagcacuuuuucauguucuuagcugacuuuuuggugggauuuuuuggguuuuuucuugcuaauuuguuuuauucaucccauuucuuaauagccaucuaaagauuuccaccauacugggaaaagucccaugacucuucucuuuguuuuuccucuguuucaucccuaucgguguguucuuuuuuuuuuuuuuugagacggagucuggcucugucgcccaggcucgagugcaguggcgcaaucucugcucacugcaaucuccgccugccggguucaagcaguucucugccucagccucccaaguagcugggauuucagcugccugccaccacgcccagccaauuuuuguauuuuugguagagaugggguuucaccgucuuggccaggcuggucuugagcuccugaccucgugacccaccugccuuggccucccaaagugcugggauuacaggugugaacaaccgcgcccggcccaguguguucuuauucaccuuauuucuuaacaaccauaaaaaauuuccaccuuccugugaggaguccugugacucuuccccccuacccuucaucauucucuuguuaauuaaccuaauguuuguauuagcaucuguaagacucaugaggggaaacugagcaaguacaucucauaaggcuucuugaacuaucucucgauuuuguggcaacaagguuaaauggggcauccacauuaaaggggcgccccuaaucgcaucauuuaccaugacuuggguagcaaggcauauucagugcuugaauaaucugguggucauaaacccaggccccacauggcaugaauacaaaguguaucagcuguuucagcuugacguuuauagguggagucaggcagucccccuucuuccaacauucaaaaccaaagacacugcuccuaaauuacucucacagugcauuuuaguaaagccuccucaggaagcugaugauaccaaucuaaaaaaugaaacaauuccuucacacuauacccucugcuuucaauggcuucuugauuuugcccuuuccugacacugccuucuuggugcccaaaguccuuaggggugcuuucugaugucgcugcauaauuuuucccuugugggagcgagguucugugagucuacuggcugaagcauagauugacugaaaucugaacuuggucuggcaucgagguuuggcccagcacuuucuuuuuacuuucauucuagcuauuacagauaacaauaaccaaaggguugcauauuuuguuuuuuucuuauuaguucgcauuucuucaugcauucagcaaaccaccuuccagggaguuagauugauccaccucuaaauuccauugguaacuuuuaccuuuagugacugaugccacuccauaccauggguauggagcugccacuccauaccaugggugaccacaugggcacccaggaaucaaagguuucucaccccccaaccccuuuaucuguuuucuucccaaacaugagcuagggauguucuagcagucccgauucugacaccaauucugaaaaugcugaggaaugaacaaacucgguuucucccacuauuuucgcauauuacaguugugacaccagaugugugggggguuuccccaggcaucaagcaagcaauucauucugcagcggacacuagcugggcguccuccaauucaauucugacaccaucuacccagagaagugucacaucacacagauugaggguucagucucacaagaccacccccaacuucugaugccaguugcaagccccagguuguuuuaccugugccucuggccaaccugcuguaaaucgggguucccgcggcccauuccucagauucaguuaauuugcuagagcagcucacagaacucaggaaacauugagguuuacugguuuauuauaaacgauaucacagaggaugcagaugaagaggugcauagggcaaggcaugugagaaggagcacgcagcuuccaugaccuccuugcaugcgucacccuccaggaaccuccuuguguucagcuaccuggaagcucuccguacccuguccucuuggguuuuuugggaagcuucauuauguuggcaugauugauuaaaucacuggccauuggggaucaacuuaaccuucagccccucuccucuccuuggagguuuagagaugggucugaaaguucugacccucugauccugccuugguuuuuccagugaccauuguccauccugaagccaccuaagggcagccggccuucauucaaaucaucagcacacaaaaagauacuucaucuucuauaguaagugggccuaccuuacaccaagacugauaaagugagggguuuucuaaacauaggagagaaaguucaggugcugggcacucaaaucaagugacagauguucaccucgggcaucagcacaguguaugcagugaaggaaaacugcagaaugacagccaugcagcagaccuggagaaccccuagcuagucucaggucuggauaucaggaggccagagagcuucaggcaggaggaaaaguggagauuugguagaauaucugauaugauggagaguuggaaaaaauuugaggauuuggugagggcaaauggugccaacgagcuagaaagacaauuggaaacuccaaagaaaacaaacaagcuuuacaagaaaggauauauagucucaguauauuauuugauacugcagugaauacuguuuauacagucaugauguauagcacugguuuuuuauuuaaccaaaacuaauuauguaacuauuggggggaaauggaagaagugagauggguaucguaucauugaaggaugucaguacauuagaacuaaaauggcuaaaccagaaauagcugugugagcauaucacuuagagauacagaggugaccaccaggagaaauaguaaaggugguucccccagcaagguagccauuauaggcucucugagcuaguggguuuugaaaaaccaugugcaucuauuuguuuuuuaauugucuuaaauuauucuuaaaaacaaaauaaguuucuauaggagggaccgcagucaccaguucauagguuaaauggcuuuuauuccaaaaguucuaagucagugagauugcuuuuccuuuagaaacauucauauauaugugguuagauccccaaacuaguccacaaauacagguuauagugaaauuaaaauauccuaguuuagaaaucaaaagaagaaaaaugaccaacuuuggaguccauucuaguaauccaagugagaaaggauggggauacgguuggaguuuucugcacaccuguucaguucaccaguuauucuucucugagauagucugguuugugauuaggcuucucacccagcggcucacagaggaugcuacucucauuagauucugcacuuaccucucacuguaaaaagcuggagaagacuuuggagcccuucaucuuagguaaccucgucaaugacagguugacacuaggagugcauuuagcuuggcaugaaagggaccauaagcugucccccuuccucaucauucuguacucaaagccccucacuacucacaagcaccuccgaaccaggacuuuucaaaaucucugcuucuguucuuauuuggacagcccauucaacuccucugacuucacucccuuaucugcauaacacagcucaagagcugucaccucuuaacaaucucuccagaccucuacccacuucuccaugcaccccucuucaugcccuccuggacccacccugggcucacugcaguauucauucauaauaaauuucccauuguuucccauuguuugcuugccuguauacuuguugauagcagggaccaccauguugccuuuauaaucauaugcccaugcagggcuugguacauagcaggcacucaauaaauauuugaauggauucaaaaaugaugagccagauugaguuaauacauaguuacagcugaaaacuaacuuuucuuaaaauccucaugcccugacccacuaaccuaauggccagaguccaagugagguucagcuguggucugcuaugaagcuggaaauucccuccuuuggguuauuucacugauguacuuaacuuggucuucauucuuuuuauuucuauuuuauuucauuuuccuucuuccuuuguucaaaauaccugucucgucuuugguuuugagacaaaagguaucaucuaucaaguucuaucccuuuccugaucuccuauuaacuagggagaagggaguuuauuuuagcauucacaguuuguuaacauacagcaggccaugccuugugcuugauuuaauuuuuccuguggcucaguggcaugguggauaagaacaucccuucccuccccaccacgaagcuggaugcccuuucugguggcauaucccauuucuguuuugaacccguacauauugaaugguacauaagacauucaacagucuagaaaauaagccaccagauuucuguuuaaccccaaauggaaaugauauugcuuuucuuguuaugcaaguaacccacgcucacuuuaaaaugauuuucaaauauaaaaaagcuaaaaagaagaaaguaaaaucaccauaagccuacuauccaaagauuaaugcuuuucaacuauuuggugugugguauguauccuuagauacuugcuuucuaugcauauaauuuucuuacaaaaauaguuuuacuauucacaccugcuuuuuuuaaguuacauaugucgcuguacaucauuauuaauuacauaacauuucaagauauaaauguauaauaacuuacugaauuuuucuucugagguugggcauuuauguugcacauauaggccgggcacgguggcucacaccuguaaugccagcacuuugggaggccgaagcgggugcaucaccugaggucaggaguucgagacuagccuggccaacauggugaaaccuugugucuauuaaaaauacaaaauuagccgggugugguggugcacgccuguaaucccagcuacuugggagcugaggcaggagaaucacuugaacccaggaggcagagguugcagugaguggagacugcaccauugcacucuagccugggcaaaaagagcgaaacuccacucaaaaaaauaaaauaaaaauauguuggacauauguggaaaaaucaaauauucaagaaacaggcugugcuguuuuuaauagacaaacccuagaaacaaccuaaauguugaggauguacuccaagaaguagaagugccaguuaguaugguaauaauguauauguagacacauugcuuuuucaaauaagauuaaaaauugcagaaauguaaacaugaagucauuacucauuuaauuugacuucccagagauaaccaccauuaacauuugguguggaucuauuuucaggccuuuuucucuauggauuuaggaaaaauuuuagugaagucugugguuucauauuuuuuuauauuacacauaucucugcaacuuuaauuuuucuccuuuauauuucuugaaagucuuuugaagucaucuauagagauuaaacuccagccugcccccccuccaacacacacacacacacacacacacacacacacacacacacacacucacaucuaucccuucugcagguugguaacauuggagcuuuguaauuuaccugccaagggacuuugggaauuuauuccuugguucauucaaaauaaauaagucaauuugacugagugcaugccauaugcaaggcucuggggaaacuaagcugcuuaugaccugagcuuagaguccagugaggaagccuggaguaugcauuugucauggugguaaaaucgugcaguggcagcauggauguugcuauggaagcagaggaaggaaucucaauaaggccaagggugucauggucacugacaaauuauugcauagacugagguucaaauccugguaucugugcugaacguggaggcucacaucuguaaucucaacacuuugggaggcugagguaggagggucauuugagcauaggaguucaagauuggcuuggacaaaauagcaagaccucaucucuaccaaaaaaaaaauuagccacucaugguagugcuacucaggaggcugaggugggaggcuugcuugagccaggaguuugaggcuucagugaaccaugaucacaccaccgcccuccagcuuggguaacaaagcuagacccugucucuaaaaaaauaaaaaauaagaauucuaguaucugucccuuguuaacugagaccucggguaaauccuuaacuucugucucagugcaagcuggguguaauaauaccuaccccacaaugccagcaugauuauucauuggaaaaaugauuauaggagaggaguauugaauguccauuaguauaugucugcuuaaguaaauaaaucguggcauauuaauuaauacaauauuaugcagcuaugagaaaugagaucauuccauguguucugauaaggucuaacucggacauauguuauuaauagaaaaguguguguuuugcuacgauuuaugggaaaaacuuuuuaaagaugggaugguagauagucuagguaaauacaaguauguauauagcuaucugaaaggauauccaaguaacuucauagugcuugccuuugaggaagggaacugggaucaggaguagggagaaaguuugcuuuccauuuauacucauuuaugcugcuuaaauuaccauauacauuuauuauauguaaagaagaguuuuuaaaucaggaauaaaauaaagugugucauuaaggcaauaucaacuuaaucuagcuauucaaauauuuuuacaugggacuuuucacaaucuuuucaugaaguaguuauaagcauggacuuguaggugugcuuacuggcuauagaaucuuggaaaagucaguuaaucacacuagaccucccuuuucuucuauaaaauaagaauuaauaauagccaccuuauuaaggguguugugaaaauaagauaacaaaauugaguggaaaacaguuaacauggugcguagcauauuauaagcacucaaauauuuguuguguaauaauuaauacuaaaggucuguaucuaucagugguauuaauaauaaucuaauucagcugccuuauaccaaaaagggauauuugugggcucacacaaaugaaagucuguggcaugugugccuuuggguauggcuguaucuagcaccucccuugaagggauugggacucagccuuuccccagcucuucuguguuggcucacuucccaaguagcuccaggcucgcacccuacuggccuaauaaugcccagugaaaagaacccaguacuuucccagugguucccaagaaaaaucccaggauugacugacccuuccugcauuggucauggucucaucuuuaccccagacacuugagccuugggauugaggccaggauucaguacucaccucugcaacuuugaugggaagagucguccuaauguugaucagucucaagucuugucuuuucaugcuuggagacuaauagaaacuaagaacaucaguagagcuccuuccccaguggaaaaaaaauaggggcaacaaauaucaggcaggcagacuauagauguuccccacuggcuccagugguaauucuuuugggguuuugugguuuuuuuucguuuugagagagagagaugggagacuugcugugcugcccagguuggucucaaacuccugggcccaagugauccucuugccucagucucccaaguaccugggacuacaggcgcauuaccauugcacccagcucuaacuacauacauuuuccuacauagauuuucagaacugcuuaccaguacaacuguuucuuugcagaggcauguuaacguccauggggcugagguuuuaacguuagcacauaccuuguuuauaguacaaguuacccuugaaaguacugccggaaggugccacauggaguuccacacagaaucucacagagccaggcuuuaccacugcuuggaaccaaauggcccauccuucuguugauuacuggauaaguuggcuguuuuacugguaggggccauguaauguaaagaucugugcauaaacaaugaauaccucuccaaucaguacgaugcucacgcugugaacuaacaaaaauugagaugaccaagagaagagauuuccaucuacccuggugcucagcccagggcagggugguguagacagagcucacccgcacuauuuaaauccugucauauaguuuuuuguuuuaccaggcaugugugcuugaauuugcuaaguuaagcauuaaaauaaugcugcuccaucaaauaucaaaauucuuagcccuuuuucaagagauucuaauuauugcacccauguucagaucugagaccaaacagguaauaugugguccccacaaauccaguuccgcccucccuguucacucaacaggggaggaaaaauaacaggauaacccaacgggaaccucccuucugaaaaggggaaaugacauaaagugcucaccuccugcuucuugucauguccuccacagggacagcaguuuguagagccuauaaguccaccccaaguuccaccuccugggaggaauucuggggcugccccuucuucacaccucacuuauuucuggcguggcuuuuggaccuagugauugauuuccuuagagguucaacaucauggaccuucacuuucuagacuuagugauucuuucgcaauaaaagugccuugcaauuuuaguagcuuguccaucuagcauucaaauuuggucaauuuaugguuuggugcuuaguaacgagaguuacacaugaagacuagucccggucuuucgaaguuaagucucagucacuuagcagcagacauggaaauuucccuaaccuacaguuuaaugguuccauaggccuuugccucauggcagucugaaacagcagccugggagggagagauaaaacuaguaugcccccagccugcugaccagugggugguucuuuacugcugaggcacggcccuaggucccuaggaguucugggucccagacucuuuuccaaguuugccuucuuucuguucacuuuauuuucauuuuuugagacaagagucuuucucugucauccaggcuggauugcggaggcaccaaccuccaccucccagguucaagcaauucucaugccccagccucccaaguaacuggaacuacaggugcaugcuaccaugcugggcuacuuuuuguauuuuuaguagaguuaggguuucaccaggcuggucucaaacuccugaccucaggugaucugccuaccucggccucucaaagugcugggauuacaggcgugagccauugugcccagcccauuuguugacuuuaauuugggcagagaauacagcucuaugucuccuuagauugcuuucuguagagaaggccuccauagcaaagcuguuuucuuugaggcgggccagccucagaugaaguuucucucuaucuguaguaucuuccuggcggucacaagaagugaccaacacacucugccacucucuaacaaggccugccaacucccugucacaccauagccaucuugacucagccaguuccauaagcugucacuggcaacagcacaauucuagguucccgacucaaaacacuugaagcagcugggcacgguggcucacgccuguaaucccagcacuugaggaggccgaggaaggcggaucacgaggucaggagaucaagaagauccuggcuaacauggugaaaccccgucucuacuaaaacuacaaaaaauuagccgggcgugguggcggacgccuguagucccagcuacucgagaggcugaggcaggagaauggcaugaacccgggaggcggagcuugcaauaaguugaaauugcaccacugcacuccagccugggugacagagcgagacuccgggucucaaaaaaaaaaaaugcuuuaagcaaaaaggagaguuuauuggcuaauguaacuggaaagucugggaaagaccaacaguugcccccagggcaugaccagagccagaguuuugagugguggucucagaccccucucucuccuucucuccacucugcuuuccccugggaaggccccauucucaggcagcuuuaggcuccucacuuaccaaccuuacuggaaagacauaccugcuucuugccagauaguuccagaaacauuccugggguuagccuuugcuccuccagccuuggucauaagccauucaaccuguucgcggugggggcggggagggcaggaugggccacaaugauuagccaggccuggaucaccugugugcacagaugcgcuuagaccaggaaagggauggcuccccaaggaacaaacagggagcuucugccugauaaagagugaauguuugcuggaccaaccacagcaggcccacacaaggacuugacagaauggcugggaggggaagaugaaguccagcaagcagauuguccuuccggagccauuagaaugauguuuaacuuagcacugcaguagaaagauaaggugugccacugaggcaagccacaucguaaaauauauauauaaagaaacagaugaaauaauuuuaaugcuacaucugacccauuaacaacauugggguuagaggugcccugacacagucaaaaauuuagauagaucuuuugacuccccuaaacuuaacuaauagccuguuguuugggguuuucauuauuauuuuagugauggggggucuugcuacguugaucaggcuggucuugaacucuuggccucaagucauccuccugaguagcugggauuacaggugugauccaugcacccagcccuaauagccuacuguugacuagaagccuuaccaauaacauaaacagucauuaacacauuucauaugguauauguauuauauacuguauucuuacaaugaaguuagagaggaaauguuaucaauaaaagaaaguuuggaaugaaugaaaguggaauccacaggauagauuucccucaucagccaagcaggacuagaggugagggugugugaaauaggccgugcugggcagagcugggcuuugccugagugucuuacucuuuucccuuaugaucuaaagccagguuucuccaacuuuaagguguaucagaaucaccuggaaggccuguuagauugcucagccccauucccagaguuucugauccaaugcaucuuagguaugcucuggaauuugcguuuccuagcagcugaacuugguccaggguucaaaguguagaaggcauaugggcauauaaagcagcuggaugaaaaaaaaaucauaaggaagagaaaauagauuuacuauucauuacuggaaguggaucaucauaaaauucauccucguuaucuucacauugaggaagguguggugaaagaaaagaggagggguuggucuuacugucucagggaugacagaggaagaagaaaacccacauauagguggacacacucauggccgggugcaguggcucacggcuguaaucccagcacuuugggaggaugaggcaggaggaucacuugagcccaagaguucaacaccagccugggcaacauacagaggccccaucucuacccaaaaaaaaaaaaauuuaaauuagccagacaucauggugugcaccuguggucccaucuacucaggaggcugagaugggaggauuccuugagccugggaggacaagguugcagugagcugagaucacaccacugcacuccagccugggcggcagagcaagacccugucucuaaaaaaauaaaaucaguggaaacggacaguccaaacccauguuguucaagggucaguuguauuuuauuuauuucauuuaacaugugaucacuacuaaaauuguugagauauuuuacccuguuuuguacuaagucuucgaaauucaguguguauuuuacaauuauagcacaugucaguuuggaugagcuaguaaccaguggcuaucguaguagacggugcaggguuagcugguaacuuuccauagaggggcugaauaucuagcuuccgcugauaaguuauuacuuacguuuucacaucacggggaguuguuuugaaauugcaacucucggcuggguacaguggcucacgccuguaaucccaucacuuugggaggccaaggugggcagaucaccaaagaucaggacuucgagaccagccuggccaacauggcgaaaccccgucucuacuaaaaauacaaaaauuagcugggagugguggcgugcaccugcagucccagcuacuuggggagggcugaggcaggagaaucacuugaacucagaggcagagguugcagugagccaagaucgcgccacuccacuccagccugggcgacagagcaagacucugucuuaaaaaaaagaaacugcaaaucuccucauuagaagaaucugccugaaaaugagccuaaauacauauuuuugugcugaguguccaguuggugccauuuauuuucuaaaacaccugucauacccauacaauuaguacuuaacaacugcuuaaccaucuaucuuuucucuuggacucgaagccccuuaucuaucuugcuuacuaagcccaaugccuagguaccuagaagacgcuauguggauauuuuaaaauuuaauuggaguuaaauuaaaaacuuagauaagggcuucucauuugcuaggcuugauaagaaaauggagaaaguaauagugguugaagcccaagauugcauguuugcaguauuuguuuucccgaugaagggccguuuguagucugugacuaguuguguuacgauccaaucacccuuucucucauugaauauacaguauauagagagagugauugaaaaucuacagaaacccaggcucugugccaagcacuggguauacaaagauaaaugggaaacagucccugccuuaaaggaaaugagaaacagauaagucuuacaguaauaccgaauaagugucaugauacaaauaaacacagaguguuuggggagcacaaggaaggggguccaacccaggucggagaaugggagaugggcaggaaagacucacuguggaaagggaauuuaagccccacggcgccugugauauucuuagcauccaaccccaugccaggcacaugauguguugaaucaaugaacaaagugacuccugaaccuaaugcugaaggaucgcuguguuuguccaucuggguguggacggaugaucacggcaggugaagagagugugcaugacaacccagccuacaacgcuagaauccuggcucuagggaaugacaagaugcugagugggguggagcagaggggugagagcuggcaugagccugcagcauuuggcaggccagcccacaaacugccucccuucuuguucuuguccauaugaccggugacgagagaucgcacuuucuuauuacaggcaaagcgaaggcuggagcuaggagaaagcggucaucaguaccucucagaugguuuaaaaacccccaagggcaaaggaagagcugcacuacgaaguccagauaguccaaaaaguaaggaucuuuucaucucuuuccuuauucuccuugguauggcauuuccaaguuucaaagcuuauggccggaaggaugccaaggugugaauaauucuggcauguuuuguucuuuuucauuucuuucugugcuuauccaaaaaaauaaauacaaugucagcagacaaccagugaaaggcuacagagucacacugguaccauaagggaagacuucuuuuaacuguauguaguuucauuuuucaacucggaauacgaacuuuuggcaccauucuauaucaaauuuaauuuuaacuucccuuaauggacauugcuucagagucugaggcaaacuggauguccacgaacuaugccagagucaccagugucugugccgaccucaaucuccagcucagcauaugauagcguaagaauugauugagcccgauaaauugcaggcuguuucucuuucuaucaaauacuauuaccguuucuugugggagagagagaaacguagguuagaaauagccaacuagucccauuauguauguguuugcauuuaacauaagggcuaaauuagacuuuguucucucucuuccuuuaguucaugcauuaggcaauccacaaauugugugacacuaaauuaaaaccuugaccugugcaccuaugggggaacaaguacaauauuaaguaaggaaauuuccuuuaagagagauggggagauuuggcagaagacuuuuccagguaauuauuuaucaaaaugaagcauuguuuggaaaauuggugaacaggugauacacgcacacacagauaccagagccugaaaggccauuugagaugggucuguuuaagaccuuguccugcagugcuagugagacucauagccuggcuccaucaccguaggccucgugugugcugguccccugaggccacagcacucuuucauucauuugacagauauuuuuuagcgcccgcuauauguaaauucuucauuggagccagggaaugguguaagucaagguagaaacucuugagaaauucaaggugaaaugcuuuaaucaaacccuggaauuuuuaccuucccuuccugcucuaauaaaaaacuuucauagcuuucuaugacuugccaacaccaacagcaacgacagccuugcuucagauacuaauacuuuggcugcagugggaaagagagcuugcuugacugcaaagacacccuucauuucuuuaccuuucccccuaucccccacccgcucgguuuuuguuuuucuuuaagcuccaaaaucucccucagaaaaaacgcgguaugauacgucucuuggucugcucaccaagaaguucauucagcuccugagccagucacccgaugggguauuggauuugaacaaggcagcagaagugcuaaaagugcaaaagagaaggauuuaugauaucaccaacguucuggaaggcauccaccucauuaagaagaagucuaaaaacaacguccaauggaugugaguaggaguccuccccaugccccggcucugagggggucguuucaaacugccugguuucuuaguuccucacuuucacauccacgcccacacguucuuuucuuuucucuccuacuguuuucuucucucucauucucucuucccuccucagcuucuaagccagaaguuugaagucucuuuacaaagagacuuuguuuagauacugucagagauaaaaggauuuauauuugaugagcauccagcaacggcauccuuaaagaggucccugcaguuggaaaguggacugcuguucaucuguuacauagaugucugugugcacccacguguguaucugacagauguguacacgucuucagcuuguuucuaauaagaaucuggaaaugauggcuuauggguuaucuauguguauacguacaacugcauaguuacagaauaucuuuauccaugguucuaauagcagauuaacucacuuucuggguaaauuaaggcaagacuuaaaugccuccauuucgucuguagagcagggaugguagcaugauacuuauacagccacacguaugauuacauauguaauauauuuugugaauuuuagagcaucuaaauagccacuauaagcacaguauugaauuauuaaagcauuuuggaaggaauaauucuguuacaggagggcuuugaaaagauacuaauucagauggaagaugaauacauaccuuuuuuugcacauuuuggaauuuuguugacaguuugguaacccguuuuggccucugguuuagagaaacauauugugcacuagucucaguucuugcauacaucacauacaucuguuuccuuuacuuucuuuucuuuuuaguuguugauauaagacccucaguaauuaccugaguuuuugaugcuuuuuuggauggguuguuuuuuuguuuuuuuuuuuuuuuaauuuugaaccauuccaucuucucugucuuucucuaucuuuuuauccuuuuucgccuuucuucccccaccaccugggagccaugaggcaagggaggaaggugguugccuucuuuugcccucugaauuugaaccuucugaagaaguagaccuccccuggaggaaagaauccugaaaauagcagugcgcuuucacuaaauuucuaugcugugaaaagugcagaacuguauuuaugaaaaaaaaaauauauauauauauauauauauguguaaauguucuaauuuuaacacuuggcuaacaagcaaugugaccuccuaugucaagaggagacauuuacccaaaggaucauuucuccuuccccucccucccaugaguagccaugaagagucuguguuuggguuucuaggggcugcagucugucugaggaugggggcaugcuggcccagugucaaggccugucaaaagaagugaccgagcucagucaggaagagaagaaauuagaugaacugauccaaagcugcacccuggaccucaaacuguuaaccgaggauucagagaaucaaagauauccuuugugccgccaguucucuggggguuagugcuuccuagacuauuuccagaguugacaaucugacuuaugcacaagguagauuauuauucugaugucaugcaaaugaguaccugugugccuguguguguaugugugugugugugcacguguguguguaaacccaguuagcuuugccuaaaaagucaguauuuaugguaagauagucaccaacucgauccuauuauuaucuauuuugauaccaggugggaacuguuuuuuaaagcauuuuuucaugugugguugagacauggguauacucguagcguaaggccacacuauuaaaagauacauaaggugucgguauuaauauuaaugacaacacuaagcagauucgucuuuggcuucccagauuuuugguggguguuagcugucacuguugggguucucacauucuauuuucuucucaccagauaucguagcaauugaaauugguugaaucuaucugauugggcuauaguugaaggguuugaaagaguagagaaaaaucauacuauaacucuuaaagugcauucugcugauucccaaugaaaaaacugauuucaaaagcaccccaagaccugagaaaccccucucaauuccucuguuccacuacaaacauuaguccucgcaaauaaaaauacaaaaggucaguucuuguucucaacuuccugacaaucuauugacgaucucaggaaaacuugcucuucaucaucucacuacagacaaaguaagagagagauugccucauuaugucaaacaagacuugccaauauucucaguuauuagaagacaaaaaacaguacuguaaguuaucccaucucuaguuuuaguuccaaacuucugaugauugcacauuuaccauuauuugacaaaaacuaaaaaguguucugcccagauucuucuagugucucaucuuuaacaggcucccccuuggagaauauggagauauuuauuuucuuccaauguuggcaguuuuucaaaccugcaauuguucauuuccuguugaccaaagaauuaaccuugucagccgauaauuagugagauggaagagaggcguagugauuuggacccccagugguuggcagaguggguuuacaggggaagaaaccaacaguugggcuguuucauucauuguuugguugggagccccauuguggaagagaugggugguuacaugugauuggcagccuuccgggacauguggcuuauggcauugucaccuauauuagcucucucuggggccuuuguugcagaaaaugaaagcuuccuugcagggaacuucgaacccaaggaguaaauucaggagggagccacaaaggaagcacuuuuaaguuuguaagauuagaaaauacauuugcacaauuuauuucaguucaccauucaguucccaaauugguacagcuuguucacaaauguguugaaauuuuccuuccugcagcauguugaguaaucguagaugaguuuuucuuuuacacuugaucuuagccaaaaggccaagaagugaugaguuuuuauuuuaauaaguucuugucauacagcuuuuugacagugagcuguaguguaaguaccugguugucaguuuuuuccaguguucucaguaaaaaaucagaacugccuggcccucuauaaaggcauccguugacuucuuugauggguuauguagugaccuaaaacccagaauccugcaagagcagccacuacaagcucaacacugaauuagccaucaucucaacuguaaagauuugaaggagauagucugugauagauccccuacauguguaugcagauuucgugugaaugugcuuucuuucuggaguaguaguuccauagcugcauucaguuucuaauaagaagcuacuacagccaggcacgguggcucaugccuguaaucccagcuacucgggaggcugaggcaggagaaucacuugaaccugggagacagagguggcagugagcugaaaucgugccacugcacuccagccuuagugacagagugggaguccgucucaaaaaaaaaaaaaaaaagaagcuacuaucguaagggacaugauuuauucuagggucucuaagcccccccuuuuuuuuauauuaaacauauuagaucacggacucuauuagccauuaaauacguuauacuaccugcugaaaugccuucauugguuuguuacuugcuguuuuauccuaggaauuuuuuguggguacauauaaaaaauaauaacgggcuaaagacauuguacauuaauugaauacuuuugucauaucguaaguaccauauucuuucaugauagccuuuuaggcuuggcugucaggacauuuaaaagaaugguucagugcuuagaaaaaaugaccaaggccgggcgccguggcucacaccuguaaucccagcacuuugggaggccggaggcaggcagaucacuugaguccaggaguucaagaccagccugggcaacaggguaaaaccccaucucuacuaaaaauaaaaaaaauuagccgggugugguggugcacgccuguagucccaucuguuugggaggcugaggcacgagaaucauuuaaccccagagacggagguugcagugagcugagauugggccacugaacuccagccugggugacagagcaagauucugucucaaaaagaaaaaggaaauaacuaccaagaguacugagauauuauacuuuucucuuuuccuaaaucaguguuucucaaauucauucaagucgcagagcaccuggaaacugcuuucuuccucaugaacacugaaauauugauagaguuaauauaguaucacgcaaagcauaauuuuucuaacagaaauaaugacacucuuuucuguaggcaguacauaaucacaaccagcccaggugcacuuaagaaaacaagcugucugccugagcaguauucugaguuccuccacuaauguauuuguuacuuauuuauuuacuugguggcugcugacacuugcuuguagauagaaguaacuggaguuucaaaaaaauuauggcuaauagagauuacauuuuuuuuuccugcaaauuggaaucugccaucauucaguuugagugacagaacacuuuauuggaguucauggaaugccugugcugcaaaggacccuggcuucaagauaaaauuucugaccacuuaguuuuuuauuuucuuaugaucauuuauuuuaacuguucuguuucuauguuuaauauuuuaaauagccauagucuuuuuagaaaugggcgggauaaagcuauucauuucuuuaguuguuuagagugucaaccagaaaugaagauucaugggagacccuaaacauuugcacauccagaaggggagacauacacauacuuuuuugagaaggagucucgcucugucgcccaggcuggagugcaguggcgcgaucucgucucacugcaagcuccaccucccggguucaugccauucuccggccucagccucccgaguagcugggacuacaggcgcccgccaccacgccuggcuaacuuuuuguauuuuuaguagagacgggguuucaccguguuagccagguuggucuccaucuccugaccucaugauccacccgccucggccucccaaagugcugggauuacaggugugagccaccgcgcccggccacauaugcauacuucuaagucauaaaauacuuuaaaauauuccaugcaucuauuuugucauuuucaucauacuuauaucugagguaauuagauggaagauuccuugacacucuuuacguuagcuuauguuacauaucaagauauucgaaaaauuaguggccuuaaagaccaaacuguuauaguugugaaagccccuccagaaacaagacuugaagugccugacucaauagagguaaggagacagcgucuuuguucaucugcaaagaucuuuguggaaugccugaaauugaaugacucauugacucauaguuaaagucugucccccuccuaugaacuugaugguucuuucccauuuauuuuacuuaaccauacauuugaaaacauuucaaugguuugauguucauugaguauucaaacaaccuaacuuugaccuagcaggauguucaguucaaagugguauaugaugcgcugucccucucauacuuucucuuuuucauaauuugucaucaacgguuuugaucaauuugaaucacuuuggaaaguuuauauugauuauccuguauaugguccccaccacgaacagauauauaaauguuuuaaagucucucccuaacuuauaacauuuugagagaucacauggggcuuuggguuagcugauagacuagaauauugcaagaaaguagggggcauauuuuuguaauuuucagauauacuuggauaauagaggccuagacuacaacuauaacauaaagaguuguaguaaaaagaaaaugcauaggagauaaaaagagaaugaaaguuacacgcuuccaucuaggguagacuucuuaccuuaaaagauaauaauagcucuuugaccuagaugaaaaagauuuuuaaauguugguaugcugcauucucuuaauagaugcaguuccuagcacuuaagaauacuauucaucaguauacaguucaacaugaaaaaguccuaccauaaaggaacaauaacauggagauacugaauuuggaacacuuaaaggaccuuguaauaauuugcagaaaaagaauauauccaaagaacacaauucaccucacccauugugcuauuuucagaaugacuccccucucccccaagccccacuaaaauaguuuucuuucucuagggcaggacucagcaaacuuuuucauugaagugccagguagauaguaaauauuuuuggcuuugcgagccguacagccugugucuagacuauucaacugugcaccucugacauugugauacgaaaacagccagaggcaauaauaaacaaugggaauggaugugacucucuuccaauaaaacuuuauuuacaaagccacuuggugaacuggauuuggcccuuaggcugugguuugcugaccccugcucuagaggaugacagucuuucauagaguuggacuaguagggaaaaagcaagugaaaaacgaacauuguucuuacuuuccauuuuuagacaagaauuacuauggcuuuuauuucuaaaagaacuucugauucgaacuucucccacuucuguucauagagccuacaaauacauuuggcaaguacccaagggcccauugagguuuacuuauguccagaagagacugaaacacacaguccaaugaaaacaaacaaccaagaccacaaugggaauaucccuaaacccgcuuccaaagguaaaaacuccacuuuugucuuuuagaaacuauguuaaaaaugagggugacuagaaccaucuguauuggaaccacaagccuaggcaagaaacacaaacuucuauugguauuagguaacauguuuuaaaagacauucugacugguuugcagaagaaaauaaugauuugggaaaaacggcuccuucacccacuuauggagucgcuucaggcuuuugcuauuggcagagaauguuuccuuacagcauuuuugaaaaccagcuaaagugaggagcaaagcugugaacugucuuguuggaucaucagagacacuuggccacacaccuuugaaucacacugcagagcucaucagagagggaaaugaaaaagguuugaggagaaaagccuuuguuggagaauuuuugucuuauuuucccccccaaugagauggggagaggauaugggaggagaacgcuaggaaaguaagucuugccgggugcgguggcucacaccuguaaucccagcacuuugggaggccgaggcaggcagaucacgaggucaggagaucgagacuguccuggccaacacagugaaacccugucucuacuaaaaauacaaaaauuagcugugcgugguggcacgugccuguaaucccugcuacucgggaggcugaggcaggagaaucacuugaaccagggagucggagguugcagugagccgagauccgccacugcacuccagccuggugacagagugagacuccaucucaaaaaaagaaaagaaaagaaaagaaaucuaacuucuccuucccgcucugcaaagagcaaaggaagcucuuugcaguauauauuuuuccauuuccuaacuugaggagauauauaugcaauuguuucccuuagugucucccuauauagcagcaagaauaagggugauuuaagugaauaagucugauuuaauacugagcaaaaguacaucaccugaaaugguaaaacaaaaggccaucuuucuucaccacagaaauccaaaguggaucugucuuauuguauguauuuuuagagaucuuuuuaauaagcugguuguucaaaaaagacugaguuaaaaucagugaauucugcauguagucccagcuauagggaggcugggguggcaggaucgcuugagcccaggaguucgagguuagagugagcuaugcuugccugugaauagccacuacacuccagcguagacaacauagcaagacgccgucucuuaaaaaaaaaaguucuuuuuucaguuggugaguuucuacuaggaagccaacuuuucaguauguauauauuguuuuguuuugauuuucuuaaaacaaugacuagauagcagagagaaguuuuugaacuuguuauccucucaucauugaaguuauuugcauucuuguuuauugacaguaguuauuugaaaaaugagugaguagacuagggccaaagaaagauggccaggcaugguggcucacaccuguaauuucagcacuuugggaggccaaggaagacagaucacuugagcccaggaguucgagaccagacugggcaacauggcaaaacccugucucuacaaaaaaagauuaaccaggcaugguggcucacaccuggagucccagcuacuugggaggcugaggugggagggucccuugaacccagaaguucaagacugcagugagucaugaucacaccacugcacuccagccaagagaauaagacccugucucaaaaauuaaaagggggacggggguggcaaggaacuuuuuuguaccuguuagcauaaaaggugaucugcaucauaaagucgucucauugucauuauuugcggaagguacaugcuuuuuucuaacagcaacauauacauucuuccagaaaaauucauuugauuuuucuaacuuauuuuuuguuuccaucaauguuuucuuuucagacuuggcuucaaccaacucaggacauagcgauugcucaguuucuaugggaaaccuuucuccucuggccuccccagccaaccucuuacagcagacugaggaccaaauuccuuccaaccuagaaggaccguuugugaacuuacugccuccccugcugcaagaggacuaucuccugagccucggggaggaggaaggcaucagcgaucucuucgaugcuuacgauuuggaaaagcucccacugguggaagacuucauguguaguugauuaugcuucgugugaacucuccuuaaaaaccgauauuuuuuuaucauggaaccagaacaucugucaugcaguguugucccuuccuaccuucuuccuccaagagaguaucaugaaguaaacuacaaacuucagaagaaagcugacauuuuaaugaauuuuuuaaaaaauuaauaaacaaauugucuaaacgcacaguugcaggcucccuugggaaagcccugcuuugcuccaggcuccaagaucuccuggcuaagucagcaagugagaaaaugugcaaucaggugucucucaccccgaauuguccuuccuccuuccuccccggauuggcuugcugugccugacggaugggcuguagaauggggucuggccaccuggccugcugggaaacagcaaucuuccuuaauagcauuucaagccgugccuucuccgcagaaugcaugucuuugaggucugcuaauauggaauggaacugcagcaaaugcaaacuugaagucaugcaaaaguaugaaauggauuucuucagcucuucuuaggaauauuuaaauuacugucauaauucaguuuaagcuaugaacugugugucccaguaggaggucaagaaaaccuccacagccuucuggaugaagaaccuguuuucaaauauacuuguugcagauacagaagacuaguagaguucugccacucuaagcuguuguggauuuuccugucuccaugaaccacucccauucccccguccccaauguguuugugaguuuccaguugauuuguagcaaaugccuacuuaguucuuuguggauuguucuagacuuuuaauuuuuuuagcugccauuuaagcauuccuguggcacccaucaccauuucaauuuaauuguuuacuuugaagcgguuuuugcaaauucauauuacuuaagcagagggagagaaccucuacugaucagagcaucuaaaccugugugaucuaagguuuaucagccucugcaaggagcuuugucccaucgugcuuccauucccaggagggggagcuuggagcgagucaguccuggggcuugcugacauggguggcccauuggaaaggagaaccaggucagaugauguaacagccccaaggagcagcaggcaugggucccuccauccuugggcuucccgggccccugugacaggggaaagggcucucuuacaccgcacucagggagaccacuucucaggauggggucagauggagagaccucuagggagaaagacauccccauugugugaguggcauuuccuuaagcuggcaggaacagggagcagcccugugucgggggcuggaauaguucuggccagaccccguuccccuuccucuaugaaggaauaaguuggaccaagggaagucggggacguaaaaaaugaagcaaaacaaugccagggugucucccgcuuuacucuucaggaauggugucccaaguuggaggcuuugugucagcugcaaauccuaccaguuauguccaagaauggcuuucccucgggcagguggcagcggccaucucccacugggaauauggcguaguaucuccgguccauuccuuggaugcuaaggacugcgggaaugagggagucagauaaagaacaaaccucgaaacgaacaguuaaauugaaaugcuaugugccugacccaaugguaggcacauaguaggcacucaacucauauguuuaauugaauugaaaauaucccuuaggaaaaaaaaaaaacacacaaaaaaccacaagagccccagccaguuuacuccagguagauuuccacaauaugcaaaguggugguggggucaagacagaugacaccagcacuuuaaacucuuuguguggguaugcguggguguauguuugggaagaaaaacaaaggugcagacuaucuuccuuuuuuucuucuucagccuccaucccuggccuccuccccucacacacacuggacuugguacaaaaugucggugugguccuagaugaagcauuggggugggggagggagagggagcuuuguguuaagugccuacuggaaaugcacugugggguuuuuuccuguaugggaaaccauuuaugccaagcuuuuccccauuucccauauuuaucucaucugguuagcugccucugcuuccagcuuuguguaauucucuuugccagcugcacaaagcugauuuuuuccaaagucuaaagacugagcucaccuggcuagauuguuguguguuuuguugaauuuuuucauaauguaaugccguauuuauuguuuuuaaaaugaaaggaauacuaauaagucuuaaaaguuccuucaugcauaagauuuuuuuccaguuacuggguuuaacugguguacauuaauuagauguccauacuguauuuuguuugcauuaaguaauuuucuuuuugacuuaguauccggcacacaaaguggguuaguacuacaguauuugcguuacuuuaaguacuaaguaugcagguuuccugguaccauugaguugcugcuauuaaagcucacacacgaaauggcuaaaaguuacaagugugcaaauuaugacugcgugagccuuagaaaauaaaauguauaaagggcaacacaugagcugucaaacaguguuaggaguguguuuauauguacagaguugugcauagcaaucguuuuauuuaaguugauauguagucuacucacauuuucauuauuuagcaauuuuguacaaaaauagcaauuaauuuguaaacacugccagaauacuuucuagcugcuuuguaauuuuuuaagaguguuauuuuguuuuuguuuuucuguucuuuguuguggcucuuguuuucauuuuuguuguacguguagaucuguaaauaaaauugcaguauuuaaagcuuaagcuuucaggaaaaagaaaauaagaauucagugugugcaugacaacucguguguaugagaaggagggauaugaaggaagauggcuugcagaguaagucggguggcaauugucagggugugggaauuucuuuuccuacgggguacgugauuuuguaaaaaggaaguauuucucccaaaauugggaguaggcaaacuacuaaucaguuuagcuuuguguuguaugcuaguuuaaaaaagaaaauauguaauauaauguaaaaaaaaacaaaaaaaagcuuuuaugauggauuuuguaaauagauuuguuacagggugaccuguucucuagcugugaucuuaccacuucaaauggguguaauuugaauaaauuuuguaugguaaaggaucaauaaaaugauuuuuuuuaagaguucag

SEQ ID NO: 21505 - RNA, 6653 nt, Homo sapiens
cggcagugagggcgcggcggcgcgggcggcuuggggcuggauuccgcccgcgcucccucgcucgcucgcucccuccccagcccccucccacccaggcccaccccacccagcaccccuggcgcagggacugcuggaaccuggcugugcgcgcugucgcuuuaagacagacucugccggcgccguccggagccuuagaaaccggccccggaucgcgagccggagccggagccggagccggggccggccgggcugcugaggcccgagcggcaggagcgcagcgcggagcgcugagccaggcgcccagucgcgagaagcugccgccgccucugcccgcccggcgccgcagccccgggcgguccauggggcgggcacggcgucgcugcaggcgccggcagcccuggagggcagccgcuuaggcgcugcgcucuuguccccgcaggucgcagccagggcggcggggcgcgcccagccccggccccuggagcgcccgccgcgguccccaccuccauggacgccuucaaggggggcaugagccuggagcggcugccggaggggcuccggccgccgccgccgccaccccaugacauggggcccgccuuccaccuggcccggcccgccgacccccgcgagccgcucgagaacuccgccagcgagucgucugacacggagcugccagguaagcgccguuccccgcgcggcgcgcacagagccuacccgggcgcggagcacggggagcugggagcagggccugacgcccgcgccgcgcaaccaagcucccucuccgccccagaagcgucaggagcuuucuuuuucccguucucgaccugacggugaacgcggaaacuuacgcacacgcgaaggcacuuccacgcgguccccacgcgccaagagacuggcagaugcacgagccuacagcuggaggguuggacugacagccccucuugaucaggaguaaauagaacgggaaagaauuugauuugcgcaacugggcgcuaaggagcggcucggacgaagggagaggaggagaccgagaaaggaagaggggugacgggcgagagaacgcacucagagagacagagagggagguuaacaccgugacaguaggcgacagaaugaaagagaccaaagagaaggggcgggcgggaaggguaaacggggggagaggggucaucaaguagaagggagacacagaggacggugagggcgagcgggccaacaggcgcggccggacucccagcaaggccagccggaacgccgaucaagggauccggcccacgugcgcggccgaagcccggagcagcccggcucuggcccccgccccggcuccugcgcgucucccuccgcgcugccuuuuuuuguccgagcuggagcuuuuuuccagcagcgaacugggcccgcggguggccggcgcgggcaguggggcagcgaauccgcugcccagcgcagccggccggguuccggaggggcuccgagcuccccggugugggcgccucuucugcguucauuucuuaauacacagcugaauguuucucuccacuuucuuaguaucuguuucucuuuugcaucccuaagugauuuuucugagagguuguuugcuugguuaaaacauaaucaacgcugaacucuacuuuuguuuucaaaaguuuuaagcgcggucuuugguugguuuuauuuuuaaaaccuagagagauauauaaucguauauugauuuuuuugaaccaaaucuaugaggaugaauuaauuuuaacuguaucuuucgauucugaaagaauuaacguacgaaguguaggucuggaauuuaaaauaucuacaugcaacauuauucuuccggagauuuuaaaaagucaauccaaaauggcgcguuucuccggaauuuucucaaaauccauuuacagugguguuauuuggggaauuuaaauuaucuaacuauaauguguuucucugggauuuaaaaauuaucucuacaagggccuuauugggaaggaguuaaaaaucuaucuacaacgguacauuauuuuuuuaaaucccagagaaauaaaugcuucugucaaccuggaguuuauacacuuacagcucuguauuuaguuagggguguguuuguacggagcuuucuggcuucuuaauuuacauuugcucuguguuucuuccugucugauuuugagaauuuguggcccuuucagugucuuuaggcauagagcugugagcuuuucugggcuucuguguuuuguuuuuaaacucuuuuucuuuauguauuaauguuucuaugacugcguguguuuuguguagcuucaaagagagacagacuaaagcccgaggucaccuagacagagucugucugucugggcugcaguuggugggguuuucuaggcuuugggacuggaggccuggaagcaaggccgagaacccggcuguguugugccugcccaguggggcucccauacaccccugaggagaagaaaguggagggacuuuaggcuggagagaucugauccuaguucagaaaagcagagacccccucagauuuagacccccuaagaguucgcaaaacaaacaaacaaaaagcauacauuugcugggaacaucagcagcagggucagaaucugagccgagcuaagggugcaggcccugcccagccaggaacgcaggcccgcggcuccagcuccgauucuugggcucuucuccgcggcacaccagacuagaggugccuacugacgaccagcacccggcgggcgcuuuccaguggggacaguucccaggaacccuagagggagggagggagggaagaccgccagcgcugguggcgagcgguucgguggagccgggacggggugcaacggggcguaagcccaggugacccgcuccccguccugccuacugcagagaaggagcgcggcggggaacccaaggggcccgaggacaguggugcgggaggcacgggcugcggcggcgcagacgacccagccaagaagaagaagcagcggcggcaacguacgcacuucacaagccagcaguugcaagagcuagaggccacguuccagaggaaccgcuaccccgacaugagcaugagggaggagaucgccguguggaccaaccucaccgagccgcgcgugcgggugagcaaggggugcgcgccuaagggcacccgcgcagagggcucccgggccgccucugcugcagcccuccaaagcuuagacccacaagcagaacuucacucucccaccauucagaccugcucccucccuccaccggagauccccaccuuaggcccuggcccacuagcgucugccaggccuccaggcgccucggaccuucaaccccuuugacccucauccuaccugauccucggacuaaggcaaccccagcccaaagaccugugcccccaggggacucccccaugcccuauggggcccaggacccacucagauguuagcaggauacccugggccagagacugggcaguggauucccugccgcuggggaccucgggagcuguuggccuuaucccgaaaacgaaagggaaaggcagguccugucuggcugccucggagaagccugaaaggugccuggguuuggggcucucaaaacuuccuggagcaguggucccaucucauaagcagauucucuaaaagcucaagauauucuccacccuccccagccaucaguaggacccuuugccuucugcccuuuccggaaggucucccgucaggugaggugggggguggcuccgggagccaaauguccuucccagucccuuuuaggauaugccaucucagacccaagaccagccugcauucucccucuucucacccguuugguuuccaguaaaagcaaggcuuuccugccaggguagcaagagaaucauuucuucccugggggcguaaauauuuaaucagauauugggagcaccucccaagucgaccaaaaucccagcuggcccacagacuccuuaccauaaccccagcccucaccccucccuaggcaggcuggccagcccagugggacuuggaaugaagacacagcacucaguaauccugaacucacuaauccugcccagguuuauggugguagggguggguggggguggaaucagguagugucagugcuggggacuagggaaagcugagaagcagggaucuggcaaacuagcucaggaaacuccacucagaacuggaggaaaauccgagugggcagagggcaugcgguaggcagauagguaaggaugggggaggacuaggagguucuuaccaaauuuggggggagaaaaggaagggcaggaagauuagaagaaucuaguaagaauagaaaaaauuuaaauauuuguggagaaacauauuuggcauauauuuaggcggcaggaaagaaauuaaauaggaagcaaaaagaucagguauuugagaaaaagaaucaacuguuuaaggggaacagugcaggucagauauuuggaaaggauucaaaagccuaauauuugaggacgauucaaaaggaucaaaaaugggggauaaacaagaaaacagacugagggagaagaaagagguucagacagugggguggacugaacgaaaauaaacauuuggagccaaaaagaaaacaucaaauauugccgauaaagaugauaacaaacuauuugagcgaugaaauagaucgaagaauugggggagucggaaaguccuaugucucagggaggaaaaauaccuuuuguauuugagggagaauaaaaagacugaaauauuuaguagauagagcgaaccuguuugggggagaaggcagaggugaacugguugagagaggaagaaagaaaacgaauaucuguuaaacgagaauccguauucggagaagaaaacggauauaauuucgggagaggauaaagaucggaaaaagaaauuaguauuuucuggggacaggaaaggaaccauuguggagggaaugcaggagcggaaauaucggucgaaggagagaaacgacguucggagggcagcgggccgacggaaggcuccaggcgguggggaaggggguggggucccucccggcccgcagcggcccugacccuucucccguccccucccccaggucugguucaagaaccggcgagccaaguggcguaagcgcgagcguaaccagcagcuggaccugugcaaggguggcuacgugccgcaguucagcggccuagugcagcccuacgaggacguguacgccgccggcuacuccuacaacaacugggccgccaagagccuggcgccagcgccgcucuccaccaagagcuucaccuucuucaacuccaugagcccgcugucgucgcaguccauguucucagcacccagcuccaucuccuccaugaccaugccguccagcaugggcccaggcgccgugccuggcaugcccaacucgggccucaacaacaucaacaaccucaccggcuccucgcucaacucggccaugucgccgggcgcuugcccguacggcacucccgccucgcccuacagcgucuaccgggacacgugcaacucgagccuagccagccugcggcucaaguccaaacagcacucgucguuuggcuacggcggccugcagggcccggccucgggccucaacgcgugccaguacaacagcugaccgccccgccgcaccacgcgggccggcggccggagcggggaagggcgcgggcgcgggcgcggaggacgcacgcggggccccggcucgcaagccccagcucaccgcgccgcggaccucacaccugcgcagcccccuccucccacuucccacuccggguugguuuuguguuugcuuuuccggaccccacucugcccuccaaaaagacaaaaaaaaaaaaaaaaaaaaaaaagcaaaaagacgucggagaaaagugccgcgaaaaaauggaugaguugcaauuucucucgggauggcgcgggugguguguguguucccacgggccccggaggcccacuccgcggagggcacgcggcgcgguaggcgagcgccgaggcccagcggccgggggaggacgaccucguaucccgcguccccgccgcgcuggauccggacugaguggccgggccugcggacuggaugugcggggccuggacuugccuaggauuucccgaccccguacaaaccaaguugcccucuccgagcuaggcccggccgagagcgccuuagcucgagucggauccguguuggggcgggcguuggguuuggggggacggugcccccagcccaggaucgggcacucaguggagccgcacacggccccggcgcgccugguagagccucgcuggccccgcgccccggagcccuauauuaaggccacggagcgacagcgggcagugcgggccuggcgggaggugggggagguccaucucagaacaccccagccuugagcuuagcugcaggcccaggcccucugcucugcucccgggcuaggagguggcccucugucugggcgaacagcccccuccucaccgcccgccgugcaagagucgagccggcagagcaaggggcgcggccccagggcccugcgcccacuuugcacacccgcucuccggcccgcgccccuguuuacagcgucccuguguauguuggacugacuguaauaaaucugucuauaucgacuuguccauguacgucuauuaaaaccauaguccgagcgugcuaag

SEQ ID NO: 21506 - RNA, 3144 nt, Homo sapiens
agccgggcucagcggauccgcuccccgggcucuuggucacccgagaagcugccgccgagugaagccagggagccgcucuccggcagcgccgacuuucuuguucuccccgcgcuucccggaaagagcuccccggagcucugcggaggccgggguugccgcgggcggagggggaggggacgcggggcggccgggccgcgggaaggcgggcagcgcgcggacgccgggccaggaagcggcgcgaugcgagagaccgcggcggcgguggcggcggcgaggcacugagcccaggaggaaggagccgccgcggccgcagcgcgagcagccggcacggggacagccggccgcacaacggaucugcaggcgcggagcaaaaugcacccgccgcgccgcgcgguccugcagccccgccacggccccgcggcccgcacccccccggggcgacagugagccucucccgccaccaccgggggccgagcggagggcucucgggugggagagcgggaccagaucucgacagcuguucauuuccaggaagccaccgcagccagagcgaaaggggaccuucugccaccagcggggcaucagccagcggcgcgcauggauuuaugaagacacucaugcaagaagugggcaggacuuggacaaacuuuuccaccggcuccgcguccgccgcuccccgcgccucgucuccuuuccccuccucucccggcggccgccgcugcccgcgaugguggccgcgcugcugggcggcggcggcgaggcccgcggggggacagugccgggcgccuggcugugccugauggcgcugcugcagcugcugggcucggcgccgcggggaucggggcuggcgcacggccgccgccucaucugcuggcaggcgcugcugcagugccagggggagccggagugcagcuacgccuacaaccaguacgccgaggcgugcgcgccggugcuggcgcagcacggcgggggcgacgcgcccggggccgccgccgccgcuuucccggccucggccgccucuuucucgucgcgcuggcgcugcccgagucacugcaucucggcccucauucagcucaaccacacgcgccgcgggcccgcccuggaggacugugacugcgcgcaggacgagaacugcaaguccaccaagcgcgccauugagccgugccugccccggacgagcggcggcggcgcgggcggccccggcgcgggcggggucaugggcugcaccgaggcccggcggcgcugcgaccgcgacagccgcugcaaccuggcgcugagccgcuaccugaccuacugcggcaaagucuucaacgggcugcgcugcacggacgaaugccgcaccgucauugaggacaugcuggcuaugcccaaggcggcgcugcucaacgacugcgugugcgacggccucgagcggcccaucugcgagucggucaaggagaacauggcccgccugugcuucggcgccgagcugggcaacggccccggcagcagcggcucggacgggggccuggacgacuacuacgaugaggacuacgaugacgagcagcgcaccgggggcgcggguggugagcagccgcuggacgacgacgacggcgucccgcacccaccgcgcccgggcagcggcgcugcugcaucgggcggccgcggggaccugcccuaugggccugggcgcaggagcagcggcggcggcggccgcuuggcgccccggggcgccuggaccccacucgccuccaucuugcugcugcugcuugggccgcucuuuuagcccucgcgccccccgccguuggcugcgggagagcccgcgucccacucccgugcucgccucgaccccgcgccgggcaccuguggcuugggacagauagaagggaugguuggggauacuucccaaaacuuuuuccaagucaacuugguguagccgguuccccggccacgacucugggcacuuccccugaagcuccucuccggagcuugacuucuuggaccuccucccccgccccaauuccaagcuccagaaacucccaacucgucugccguccagaaagcuagcugcaguguucaggacguccgggaggaagcaagcaugugggggacagaacaguaguccuggacucgaaagggaaggugcugaccaguggggccuuagcaauuugaaggguugggaaggaggaauuauauuugcaaaggggcugucuauuagcauauuuccuuugagggggcaaaaaaaagugccaguaucgacuuuuacagauuguggccagugaggauauuauaauccuauguaaacagaaaagucccacuuaccgauucauucuuucacuguuuguaucugcgcccagaauucucagugacgugggggugaggguggguggcgauugccuuagagggaaccccuaaauugguuuuggauaaguuugagcccuugaccuuaauuucauugcuaccacucugaucucuuagcacauuucuuaggauuaaggguccaaaaaugcugaucuaagggguugccaugguguugaacaaugcaacuuuuuauuuaaaaaagcucugcacugccauguaugaaagucucuuuaugauguuuguuuuuuugucauuuuuguucuuuacaucaagaaauuuuauguuuaaauaugcggagaauguauauugccucugcuccuaucaggguugcuaaacccugguacaucguauauaaaauguauuaaaacugggguuuguuaccaguugcuguacuuuguauauagaauuuuuauaaauuguaugcuucagaaauaauuuauuuuuaaaaagaaauuaaaaguuuuaaacucacauccauauuacaccuuuccccccugaaauguauagaauccauuugucaucaggaaucaaaacccacaguccauugugaagugugcuauauuuagaacagucuuaaaauguacaguguauuuuauagaauugaaguuaacauucuuauuuucaagagaauuuauggacguuguagaaauguacaaaugcauuuccaaacugccuuaaacguuguauuuuuauagacauguuuuuuaaaaauccuaaguuuuuaaauaacuauggauuuguguauuuuuuuugguuauuuguuuuauuaaaacauguacaucaguaaagaguuuuaaacaauga

SEQ ID NO: 21507 - RNA, 1523396 nt, Homo sapiens
  misc_feature (391093)..(391093): n is a, c, g, or u
  misc_feature (476388)..(476388): n is a, c, g, or u
  misc_feature (1116858)..(1116858): n is a, c, g, or u
  misc_feature (1117087)..(1117088): n is a, c, g, or u
auauuuuaacuaccauuuuauuuccauccaggccaagggacaauuuaggaaagguucuauucugaguacauagccaaggaaguguggaaaggcuguugaugccauuguuuagaaguuagccugucauucaucaugauugaaacauaaccccaauggcuuccacaaguguaauaaaacgcuuugcaaaagguugcagaauugcaggauguaauaaaaucugcuuagcuucauuuccaaugccgcagaguucuagagaacgagacccauuuccuuaugccuugggauuuguucaaguuacuuucaugccugaaaaugacggaacauaaaaacagacauuuaguuagaaucaauaguaucuuuugagucauggcaauaaauaaaauauaaguuuguuuacugcuaaucuuuuagauugccauuagcauuuuacaagaggcccuguugauagggaugaauuauauaaaauagauggacugcagcccugcugaugccugcagucacucuggauucucacauuuccuguggucucuggcuacugcccuugucaccagaggucaguggcauggucucuuaagagugucuguuauagacacaaaucuuaccuagaaacaagccaauucaggucuguauuaauuaggugaggacaggaucccaaacagccauugucagaauugccugcugaccacuuguuaaaaacacagauuucugggcucugucuccuacaugaugacuuagcaggucuggauaaaggcccaggaaucuguguuucuuggcagguucuccacaucugaguuguucaaccccuggauguugaggugcugugcaggaggcagaaugagcuuugcuucaaggccaagacaccuuaaggucaaguaucuuaggccaggccuaaaacaauuuccacucauaaaaugggaacauagggagaaaguccuuuaaucuuauuuggcaagaaaaugaggaaaucccuuggugguauagugguaugguggcccagcuccacauccaggagagcaugggaaugcaucucagggcucugcccccuccacccccguuggagccuuagcuuccgggccuuaaucauugguaucaguaaaaugaguguggugaggaacugggcuagcugggacugcuaguuuggaggacauugaaagcagaguaucauaggaaagagaaaauuaaauaggagggaaaaaaaaugaggacuuccuggguuauauuuuauaaaauuugugaaagauugcaaaaagggugcuaggagauguuugggguagcuccugaggacuaagcucugauuuuuuaaaucuugcccaaauuccuccuaucuaaggggucuggggagucaugcccuacaaaccacaaauucucaucagauggguuuuauuuaauccuauauauuaugacuuacuuuccaguaugacucuggcauaacauuaugugauaaagaagaaaaucaaaauauuuuaccccaaaacauguuucuuugccauaucuugaaauggcccuguaaggccguccuuuguggggggaaaugugcaucuguaaagaaucucucuuaacguagcuagaucuuuuuauuccaagcccucccaauccugaggagauuaacugagagucuagcaucuuuuaaaagucugaauaggaacauuugucaucuguucuaagggcagccacuaugagacugagucuccacaaucuuuuaucuucaccugaacauuuccuuucuauuaaucccaggucuuuagacaaacucaaccaguugucaaccagaaaauguauaaauuuaccuauagccuggaagcuucccuccucaucccccacaccaauugucccgucuuuuugaaccaaaugaauguauuucucgaauguauuuugauugaugucucaugccucccuaaaauguauacaaccaagcuacaccccaaccaccuugggcauauguucucagggccuccugagggcugugucuugggccauggucacucaugucuggcucagaauaaaucuuuuuuaauauuuuagagaguuugacuuuuuguuaacacuaccgugggugugauacaugaggagauuuuugagaaacauugcugagaaacacaaauggacuucuccuacgucguuuucaagggauuucagugaagauuuaaauggcuuuucacguacuguuugcuguuuguagcuuugagugcagugcuacaggcacagaccugggaagcugagcugagaagacccagcucccugcucauuuccauucagaacccaaggugaguccauucaaccccaccuuggugaggacacaccagcacccacuucagccugugguauauggagauuuuucugugucuaguacuacacuuuucuuacaaauuaguaacaaagucagaggucaaaaggcaggagaucccuuuggaauucuaguuuaucccuucugggauccagaacacagaggccgaaucacuucugcuucuaaccugcaucaggaggccucauaucugagcucaggaucccuucccugcgggcccacugaggucuguaagugagggcuggagagugggguauagguaccagucaguuugcugccccggacaaggggaucugucucauuccuauauggcguugggaugauccacuauugugccagcaccauccaccuugucuggagauacaggucaucuucugaucauuuaucauggcccuuguccuugaauaauuauugacuuugagucagaagaaccugcgcaggccugaaaauggaugugcccuuucuuuuccucugucucacuugucuugggcagauuuaugucuuaggagaaguuucccucgguucuauuuuuggucuucugaacacuguggcccuguguuccuucccacccugacucuguccagcaccaacucuguaauuucugaaucucuguggaugccucuauccgucccugaggaggccucuauuagucuacuugcaaugcuucugugacuccucugucacagcuuuggccuggcuucuuaaagcucugucuucagccguuucauuuccccaacuagccuggaagauuaugggaagcagagucugccuuucauucucagguauacugggugagcauggcagacuuugaggagugaagguuugagucugaaguccacugcaucauuuaccagcugugugucucuaggcaaugugaacacaccucgugggggcuguggagagaacuagguggguuaauauacagacagcacuuaaggcccugucuagcacauuauuaugcucacucaaugagagccucuguuauuaucauuaucaucacuaauucuuuguguugcauugccagcaagacucaugagcgucaaagcaagugaaaagucgguacucagugacacugugggauucuaccucauuacuggaaagggugcaucugggcagugcaugugucuucccaucuucuaguuggauuccucucacaaugugucccucuucauauagcuaguuuccuuccauauugccuuuagaauagacaguggugcuguucaguguuaucugggcauagcaacaaaaggauuuacugaaaugcaauuaagccucugaggagguacaaaaagggcccugaaaacaggugaauggcuauuuccucaaggugcuuccaacccauuuugggaaauacuucacacagagugaagcaaggugguagauaacuaggggucaggugagcagucuagaauaugugggcuucuggaguucaggggacaaagagggcaggagcccagaaugccaaaaguuugaucucuaugaacauguaugcuuuucaauuuucaauuauuucuaaguuccuaaucaacauaguagcagauuaccugccccuuaccuccagcccuaaaagcaugcuugagaaauaguagguagcgaguacugugaaacucauuauaagggguuuguuuuguagaguggugaaugacggcagaaggggagcucuguugcuguggacaguagaggagauuuuuggagacggcagcuuugaauuuggaagaaaaaugaaaaugucuguuagaggaacuugagguuuuguguaagauuugcugaggguugugggcuguaacuuucucauccaucucugccugaaaccuacaggaaagucuuugagguuggcuaguguuuuauuguaugacuuagugggcacagagugaaagcagaaguaucaaaggggucccagcuugcguccgaagugaaccacccugacuucuccuugaacgugugggugucaucaggcccagucuugucuuuccccaccaccucugugugcauucaaggcaacacucaccuuuuuaccaagcguguaggugaagaaggcucccaccuguuacuccuuuccccuagacuuucacagaccuagaggaagacagccucuucugcuuugaagcuaagaaaauagaugaaugucugugucuucugugggugaaccuggaugggagcugccuauagucaaucuaacuuguuagggugaaaaaggaaggguugacaccacaaaaacucagcaggccuccgccuuccucuuguuucuuuaagguaguguuucucaacuuggcugcucauuggaaucaccugggaagguaaaaaaaccaaaaugcuaugcugccauccugcccccagagcuucucagcuaacuggucuggagcguggccugcgccucuggaggggaaucauugacugugagggugaugagcugcaagccugccuccacuuugacucugguacaaaauaugcucccaauacauugccccaagugcgccgaagcaauucagaugcaguagguuucaguugcaaauauucaacuugacuaagguugucuguuuuuaguacucauagcagaaccaugugaauaggacaguuguccuuugaggauguugcuccuugcccacgaggauuaauaaaauggccugcuuugauucuaugcaaggauugacacagacaugguuuuaaaaugaaguaaccacacuuaccaauaaaucagucuggagacacaaacauaaaacuccucuuuaacaacucucuucuuuuaaaguaccuguuguucauuccuagcaggcuagagauacaggcugaggcagccacagaaagucauucugcucacaccaaaaacaaggugagcaauuuuccaagggcaggcaccccugaccucugcuuuucagcuuuuucuuaauaaacuggucucagaaauuggaccacagaagcugcuggcggcaaucucuucuaguaaguggguaaagggaagcugagggagaaauggcaagggucagagagccacucugaugaguaucucugaggugaugcaauuauacuuccaucuagagauaggaagggguuacccccaagugcagcagccccaaacccagcagugugaaguuggacuuaggagaacagagcgacugcccagugagcuuuguaacucaaaacuauuccuccauggcacguuguacauguucaugaauaacacaacuuccugcagugagaaagugugaauuccuguuaagcagggucuguuuuccaauccacugugcuugccuccuugagggcacagaauggauaaaacagccccacacaccauguggccaguccccucaagaggagaggugcagacagacaucuguuuugcagugagguggagguucacugguaacugugguuuauagagcgaccacagacucagccuugucaguuuucccuuugaagggauaaacucaacaugaagaacagcaaacgcaagaaagaugaucccaaagcuugugcuugggagugagugaccgcagccugcagggcuuaccaucuccuggcaaaugaaacugcuuauacuuaggugcagaaccaggcaaauccacccuuagaaaacuuccacuaccacuggggcauuccuuugcugcccacuugaagccagcaaggcuucugucuucuguguuugcuccauuuacauccacuuccccgugccugugcauagccaggacgccccucucaacaacuuucuccucccgauggggcuuaugaaagacgggcuuuauuugucuuaaaaucuucagcugauauugcucuucucuacaacacaguugaaaugaaaaaggauuacuuuauauuuacuugcauuuuucgugagaaaaacuaauuuugagaaagaaagucccuacagugugaaacaguuucccuuccuucaaacccucugaagaggcaaaggcaaaccuaaaaggcauacaugcuuugucauugacuuucucugacagcugcuucuuaucauguuuuugagggugaccuucguccagcauauuccuuagcuguaaguugcacucuccuuuuauaaucgaauuuagagccaagcauggaccaggcuaccuuugauaauuaauggcucugugaguuugcugaguguguuauuuaauuaauggcgcuuguguuuggaguguguacaacucuguagcugaauaaaaggcuuauuugcugaauuauuacagacauauacccaaggauugucacacugagaauuugucgggguucgacacauuuaacagccuaaugggguuauuuuuuuucuuuuccaccauuuaaagguacugaauggguauaacucuguucuuuugccuuuuauauaagcucauacuaccaucugagaaaaucuguaggcuaauggauaaaagucuauuaccuggagcaggaccuuugagaaaaacaaaaagaugaaaccuuuaauacuauauuuugaguaugaaauugauguucaaauaaguuauagucuacuucaguuccucauaaauagguuaacuugaauuauguucaaguucuacuugggaucaaaagaucacggguugaaaccuggcaagaaaacacgguugaaagcuaguaagaacacagaguaucucacgugaccuugcuuuuccugagacuccagucccagaauaaaaugcguauugcggcaagacagauaugcacauauacaaaugccuucuaaauauccuguauggaagcaucaacaggugaaucucuauggacucaucucuauguguucaguaagagacugaaaauauaaaaggucugguuuuaagcugugucguuucuaggcuuugucauucugugugucugggcaaguuuuauacccucucugggcuauaguuuguuucuuugcaaagcaauagguugaaccaugugcucuuuaaacuccuuuccaacccaaagagacucaaagucucuaauuuuuccaaagagggauacaaaguccacuaucccagugauagaagaguuaguugauugcuuacuuuggcgaccugagguucauuuuuucccagaagggaccuuugaguaugggaaaagccauauccauaugcccugcaagagggcuaggaggcuaguccauucucuaaagcccagccguaugguccaggagacaagaacuacagccagggaccugcuuucuuccaucccacuggagacccccacugacggaaaacacugguuaaagcauagaaggaaaaaaaagcacuauuguagacuggguacuuaaggaaggccuuucugagcaggugacauuucagucaaauccugaauggaagaaggaaagaagggaggacgcuccaggcaucaggggacuagaagugcaagggcccugagaugggccuaguuugacauucuucaguaacaucaagguagcgggaaggcuggaacugagagccugaaggguugccauaggagaugagacugggcuugauucuaaguccuuuacugugcugugcaaggccucauguaaucaggcccuggcugacucuccaaaguguagaagagaagcaugaucuggcuuccauucaaaaggauugugauuuuaacccauuuucuauuuuaauguguucauucucuuguaugaccuugggugaguuugaggguauagauacauauuuuaagagucacagucaacagcugauguauaauauucuauauaaguuauauuuuuaacugcaauaucauaaagucuugcccagaaccaagaguuacuagguuuugcugaaaauguuuuucuuuuacauuguuguacuacuuuuacuuuccauugagucuuuuucuucaaaacgauuaaagaaauuaaaacuaaccacauacaagaucucccacuuuaaaauuuaaaaagugcccugauagauagauuuuuugagaggagaguaauagaacaaaacuuugauagggguauccaagagaaaugcugauucacuacauuagguauauuucuuuuuccaaacucaugacuccagaaucugcaggaaccacaagagauuggaugagaagcugggggcagaguucuaacagcagcccaagccuccacagugccaagaugggccaucugccugugagaagggaaagcuuccacuucucuuagcaaugacucuggcuuauuucuaauuuagcagaaaaaaaaaaaugauucaagcaauaucaugugcuucuauaucuucaaagcaauaccacaccaucaauuagcagcucagcguaccaacaguucuaaacuuuuugcgagcuucuuggaaacaagauguggagcuucagcagaagaaaauugguaagaacaucuaauuacauuaaaagucauuuuugccugucuuaaaggaaugaaaaugaucugccgguuuuuauagaccuucuugacccaaagauaucugcuggcagaaagagaauccucaauuggguucuuuuaaugcuuuaauuauuacaugaucuaucaucuuacgcacugacuuguacacuuugaaaaauccuuuaaauacggauuaaaauugauuggcuaaucccagaccuuaggguggagcuuggagggcauguaauugugugugugggcucaggggguuagacaggaaugacacagagucaacuacuucauagugggauaaggugagaaaucaauuuggucacagguacaguugacauuguacugccaacuugcacagaacucagucacacgcccacuuguucuugaaucaguaugauugcuucaacuucaccaucggcuccuacaaggcagggaugaacuucaccuagugugccuacaguguuuggcaucuccugccuuaaacuucuccaaaugaugagcaagaugacuuauaggaacuucaaaucuaccucaccccagucaagggcuucucucuauguucauagacuaaaugguagggaagaauucugauuggaugagcuggagucacaugcccagaacuguagguuuuggaugggauugacagcuccaaauucaaaugucuacuacacuccauccuguacucugcuuggaucucucgacaauuuuucaaauguuuuggaaucuaagagcuaacugcaaacucuugguggaaagcccuaucucuagagcaugugcucacugaaaggucuugcaugaagcccuugagaguccucacugaucccaagagugcaguaucuaaugcguuacaguccaagguugauuagccgugauucacuccugcucauggaaugcaguuucagcuuucagacacauacucagucuguaacuguugcugcauaaggaaacaagggauagcucuguuuccuaaaggguuaggaauaaggacuaggcacuacccagcucucauaaccacuucuagcaggugguugugacagcuggauaaagugauccaaagcacaagaaucaucaaaugcuggcucuuuuccugaaguuagugcagaagcuagaguaagguauaccuugcaccccagcugcaauggacaauucuugccuuugguuagcuagagcuuaugugagggaugauguuucuaaacagagagccaccauuuuuagugaaaagguaagugugggcuccagaggcagacugccuggacuugaacccugacucacaaaguauaaccugagagaccuuggggcaggcaagucacacagcugcuguaagccucaauuuucacaucugaaaaccagggcaauacuggaggguuguugugggguuuaauugaguaaagucuguaaagugcuugguauaacuugcccaugguaagcucgucaaaagugguuuuauuaagaauuauuaauaauauagccucuucucuguggugaucuccauugcucacuuccugaaauaacgauuuguuuggccagaguggccucuucaagucagggaggauggucaggaagaggagugccaccucccugauguacugguagugugucuguaaagauuauacacagcaauuacucuuuuuuuguuuaagccuguuaugaaauacuugaauauucagccagcaacaacaugucaaucucuuucuuuucuuccuuuuuuuuuuuuuuuuuuugccuaacugaaaaauuuucauuuaucugaugugcuaguccuuuugauggugaaauauaacacacauacagaaacaugcaggaaauauguacauggcuuacagaauuaauauaaagccaacacaugucuugccaacacccauggcgaggaacagaacaucgccaacccuuccacuuucccaccccacucacuccacguucccuuuccaaaucacgguucccuucuuucuucccccgcaaagguaaccacgggccugacuuucauggugagugcuuccuugcuuuccuuauaauuuuaccuucuaaaugaauguaucucuaagcacuguaauugaauuuugccuguuuuugaacuuuauguaaaugaaaucacacaguauguguucuuuuggguguuucuauuguuccauauucuugcaaacacuugauauugucaguccuuuuacauugugacuauucucguggguguguagugguacuuuacuguguuuuaagcuuauauuuauuucccugaugacuaaagauuauuggccauuucaauauccauuuuuuugugaagugccuguucaagucauuguguauuuucuaucgggcugcugacuucuuauuaaauauaauguguuuuucuuugcuuccuuuuucauuuuauauugucuucuggacacuaguccuuuguugauuauauauguggcaaguacuuuccccuccaccgcagcuugucuccucucucucucaaugguguauuuugacaaacagaaguucuuaauuugaauguaguccaauauaucaaucuuuuuuuucaguagugccuuuuguguccuguugcaaaagucuuucccuauagcaagauuaugaagauauccucuuauaauaucuucaaagccuuuaaaauuuuacacuucaugcuuugaacuacaaucuaccuggaacucucuuuugcauguggugugagguaggguuucuuuucauuaguuuucuacauggguauccaauuuuccaagaacuaucuauugaaaaaaaucuuccuuuucucauggcucuguagugucauuuuuaucauaaaucaaguguucauauaugccuggauuugcuucuauguccucuguuuuguucuaucagucuauuuaucuuuguaccaauaccaugcucucuuaacucuuauagccuuguaauaagucuugauauccuguagagugagccccuccaauccuucuaaucuuguuuuuucuaagucucuggcuacauuuccauacgcauuuuagaaucaacuugucgauuuuuaccaaaaccuaugggaauuuggaacugaguugcuguggguuuauagucaacuugaggaaaauucaaucuuuauauuaauaaaauugagucauuuacuucuccauuuauuuaauuucucuuuaaugacuuaauauuuuacauuuuuugucuauaagcuuacauaccuguaauuauuccuagguaucugauuuuugauguuaaaagcaaacuuuaaaacuuuucauuuucuaaccauuguagcugauacagagaaauuuaaaacauauauacacacacacacacacacacacacacacacacacacacacaccccuuagauucagaggccuugcuaaguuuacugauuaauucuacuuguuucucuauagauucuuuuggguuuucugcauauaucauauugucuacaaauaaugacaguuuuauuccuuuauuucuaauccuucuacaccuuuuguuuauuguucucaccuuucuacacuagcuaggacuucaaggacauugugaaauagaagcguuaauagugaauaucuuaucucauuuacaaucucagaugcauaguguucauuucauuccugaguauaaagucccuuccacuuguagcuuuccuagaccuuuugaauuuaaguuagauguguaauuugaucaauaauuuuauuugcaucuacuaagacgauccuaucauuuucuccuuuauuaacccagggaaagacaucauuugaaagucuaaugugaaaacaaaguuguauuagucaugaugucuuauccuuuucccaaaucguauaugugcgugcauguacaaucugucugucaucugucugauaucucuuagaauuuugacauuuguguuuccaagugcaauuagucuauagauuuccauucuguaauguucuugcaauguucauuuguaacauaaaucauacaacaaacuggacaauuaaagaguuucuuuuccccccccuucucuuuggcagaauuugaaugagauucuuauuuguuucucaaguacgugguagaauucaccaguaaagcuaucugggccugaaaauuucuuugugggaaggauuuuauuucagacucaguuuucuuuaauuagaauccaauuuuauucauauuuucuuuuucaccuugugucaguuugugcuaguuguauuuuugagaagcuugucuauuuaauucaaauuuucaaauguauugcucuaacauuccuuuuuaaugacuauaguaucuauacagaaguuugccuuuuucuuuuuaacauggguuuuuguuucuucacucuuuucaaagacccuacauuuggcuucauugauccuuucaauugcauuuguguuuucuauuuuauuacauuaugauuuauuguuauuuccucccucuuaauuuugugguucucuuuuuaacuucuccagaaagauguuuagcacauuaacuuacuuuuuuuauuuuuuuaauuuuaauucuuaauuuuuguggguucauaguaggugaauauauuuaugggaugcaugagauguuuugaugcaggcacgcaaugugaaauaagcacaucauagagaaugggguagcacaguaacuguugacuuuucuugaauaagggcauucaagucauaauuaaaacuaaauuacccucuaaacacaccuuuaguugcauccccaaguaugaguuuucuucagucaguucaaaauaguuuccaacuuccacuugauuucuucuuuagugcagugguacaaucuuggcucacuguagccucgaccucccaggcucaagccauccucccgcuucagccccacaagucgcugggacuacaggugcauaccaccauggcuggauaauuuuuguauuuuuaauagagacaggauuuugccauguugcccaggcuggucuugaacuccugagcucaggcaauccaccugccucagccucccaaagugcugggauuacaggugucagccaucacaccuggcccuuagaauucuuuuaguguaagucuauuggugacagauucucagcuuucaucagaaaaugcauguaucuuaccuucauucaugaagucauucauucauucauauuaacuggguauggaaaucuaacucaguaguucuuuuggcucucagacauauccuguggucuucugauuuucauuuuuuuguaguuguuguuuuuggucuaauuaugacuucuuugaaaagccagugauuuuuuuccuucuuaagucugaguuucucuuuguuuuugcuuuucugcaauuuuauuguaaugugucuaagcauggaaucuucacugaugcuuugauuuugcuguguuucggauuuuuggauugguagcuuuuccugguucugaaaaauugucagccaucgucucuuuaaaucuagauuccacugaaacucuguuuucucuccccauggaaauaugaauaaauaucuuucaacuuucucccuguauuuugucuucuguccucuuuucuacuuuuuccucuacucuaccucuucauguuucagucugguauuuucauauggcucaucuuugaauucacuaauucucuuucuggcugugaauaauguguugcuaaauucauucgaguucuagaauuuuuauuugguuauuuuucucaugaucugugucuuuucuuuguaauaaauucuagcucucugcuaaacuuaaaaaacaaucuugucuuuucucuccauaaauaaacauaguuaauuuaacaucuaugucugauaauuccaauuuccagguaaccugugguucugaucuuguuuguaucaauuuccgucuuaagcagcuugagcugcuaugacaaaauaucauagacuggguagcuuaaacaauagaaacuuauuucucauaguccuggaagcugggaacuccaacaucaaggugccagcaaggucgguucauucugaggccucuccucuuggcuuguggaugggccaccaucuugcugugugcucacgugaccccuucuuugaauaugcauaaagauagaaaucugaugucuuuucuuaucauugcaccuacuccacccugagggccccacccuugcgaccuuaucuaaaucuacuuaccuccugaaagccuaccuccuaauaccaucacauggggguuagggcuuaaaugaauuguggaaggacacaacauucaguccacaacaacuugucucaucacaggccuucuguguuuguguguguggggagggcacuguggcauugggggggacaaacauucacacauauacugagcauucuguuuggaaacaaaugugagaaauaauuucaggucuugguugguauuacuuucuuccagagaggauuuucuggcuucugccaggaguuuaauggacuagcaauuugagaucaccuuaauucaauuuccagucaugaguuucucaccugcccagaugauuugaaguugggcuguaguugguguaagggcucacucuuauuccaaggguauaacucucccagaucuuugaauucccacccagagguggagguuuagcaaggaaucuaccauuggaaaacugacuauugcuuuaucuccacuugccucucugaggcucacaaaugcccuuaauggaaaagcaaccucaaacauggggcucacuucuauggauuucugucuuccuuggcucuugguccuauaaucuuuugcuaccuuccuacuucuaacagauuuuuagaaaguucuguguagucuuucuaguugaacacagugggaggauugagucaaauuauuuggccuuuaguaacaaaagcagaagacacacuuuuuuuuuuuuuuuuuuuuuuuuuuuuuaguggucugaaaaccuccugcccuacagauuuaauucuuuaguuacugcuugaacuaauuucucauuaccugaauaucccuauaauuuaucaucuucaaaauauacuagaaaucagaaaaaaauaauguauuuauacuauugacauacugguuucccauuccauuauuuuguguuuuccuuauaauaacccugggauauaaguaaaaugcuuucucuaucauuauaauucagagauuaggaaauugagcacaaaagagcgacacguccagguucagagaguaaguguaguggcaaacguuggugggguuccacuuuaaauuauuuaaagauauuugcacugagaguagaaaccaaacugacaagacaauucagaugccauucuuaggagacugcagagugucuuuuuauacuuucagucggugguguauaugccuggugcuuaggacaggggauuggaaaacagguuucuuguugggagagagagaggcgcugggacauaauuuucaccaaacuguaauguucauuuuaucagucuuuuguuuuuaaagcacauuuuaaaaaguucuguguaaaacacaagacaaacauuugcucuggaggacacauuaccugccacuugacuuuuucuuuugauucgguaucauuuacaugaagcucuaguacaggggguaaccccaugauaggguuguaaaauccagugcagugagggcuggggagauaaaagaggagguggcagacauucguccccugaaggaguuggguauaagacaggaaaaguuuauucccaggauggcuuccuuagcacucucuuccccugucuuuguaugguuccugaccucuccaaaaaucauguucugccucaauuaucuguguaggcgaaaagaaggaaaaacagguuucuggaggaagaagaaguggcacacacauacauuuagucugggguguaauuuuaccccacuuacaccacugggacaaguggugacauuuuaauuaacaagauguucccuacuuagcucuauccucucuuuuccucauuguugggaggacuuuaguuuaauacauaagacacucacagucucaauugcccaccacucaugaugaauuugaggugguagaguacacugaacugcuucuuagauaaucagagaaguauuaaagccagaaggagcacaaucuagagcugacuuugcuaguguacccuguauugaugaucccgguuaaguauguacauaauacuugauugaugccccagcgugucaaaauaauggagcauuuauuauguaagaaguggcugagggacauuuuaggcacaggaccaaaugaauugcauaaauauuagcuauuaugaagcaguggggucaaagguuauaaaugugaauuuucauagccuuucuucauauuaaccuuccacacugucuagaagagucuucauucucacccuccuuucaggcagagacagacaaaaaggcaacacugaaaggagcacacuauggagaguggagagaagcaaguacaaaaagaaaagaaaugucuuaggagaagaaagauuuagaaaguuuuugcuauauaagaguaugcagauuaauaugcaguuauccauugcuggagaugaggauaaaaaugaugagggugacaaugacaagcuuuauuuuauuguauuacaauuugaugguauuaccauuuugcaagauguaaguaaguaaagccugaaacucuuaaaaaauuaucuuuggcuauuuagauuauacuuuucugaaaaggacucugugguaaugaaucaugugguuucaagauucacaugcguuaaaauuacuucaggacacuagucauuuuucaauuaccaguagaaguaaaucucaaaggaagaguucugcagauucuugagccaucaauggccuguaggaaaucuuuugaacaacuggguacauguuggagaaaguagggucuuguuaaaacauuuuaaaaauaacuaaacuaagccaaaaauccauuuuggauccaugggguagacugucucauagaauguuucuaaaaggagguuuuuaaaguguuguuggauggucccucuuuugaguugcuggaacauaaaucauuugagacauuugauuugaugguuuauaaaguuuccaugacucugugguuuauuauucccaauuuaggcacagggaguugguuuauauuuaucuaauccagguaauagaguauuuaauuuccugucacuaaaaccagauucuagaaauguaaucaucuaaauagaaugagaggagaggcagccagauccaacagaaauuggacuggagaagaaggggaaaaaaaaacaacugaaaucucccuucuggcuucuuuuaaaacaauggguccuuugucaggcaaagagcuuuuugaacacacuaagauaucuuuagccuuaaaagaaguaucuucucuuguaccuguagccuaaagaaaaucuauuuucauaacaaucugggaacggcugaaagaguuucauaauuguucugaaacuuggggauggcugaaacauuuacauugguacugagcuccucacaugggguuuaucuaguggguuuaagauuaaauuggugaugaagcugaauuuaaaauccaccuuucccccaagaaaauaugagaguacuaugaucagcuuccugggccuuucucauuagaggcuucugugcugacaguggaacaucucugaggugguugagauuugggguagauuucaaaagguacaauuuacagaccagaacaugugcuaaauaggcaaaccuguccuuucucaaucaccuugacuauccacaauuaugauauaagggugauccaguggcagaaauuauggugauuuuucaaaaacgccaguguugaaauuuugccuugacaguacaucuauaacuacuaauaaugcuguauugggcugacucaguugcuuugaaauugcauggucccauuaugaguaaaugagaggcaaccaauuaucuauaaaauaacgacgugcacagagaagagcuugaugaauuacaagugagcucugcugacacaacaggguguggaaaccugcccugcucugacuuuccaucagaauuaggggugaugcuugcauauuuuaacaacauaucccccucaauucuaauguggaaugggagaggggaggauggggagauggcaaaaucuuccccccuagucacuaggacacaugccauugcuuuaaaauuaaguagaaaaacugcuuggguguauaguggcagcaaauccaaguaucaauaccugcauaaagaauuaccauccuccaggaagaaggcaacauuagauaagaaaugcaggucuccugucaucuaaugugauuuagaacauagacuaaaagagccauugcaaaucccuugucccggaacucaguccaguguguagggagcaaaugcauaaauucaccuaugcagagagcagacgcugaauuccuggaacgaaaggauugccagccucaucaaggaucugucacauggugagugagacaacugcagcuucauucagcaacccuugggcuguugagcuccuugugcauggugaaggcaauaacccuuucucacuacugcucaagaaacugcaauucaaagucauuuucugguaggcaaaggauacagagagaagcuaaaacaccaaaaugcaggugcauauaacccuggaggguuauaugggaagauaaagagaguucuuuuacacaauuaaucugauguuggugucuugauggcuucaagaggcugaggagucaguacauaguuucagaauguuuaccuuuguuguccuaaugguacucuugcuaugcugaggauuaauucuuuauauguaaggaagauauagaaauaauacuuaccaaggaguugcuagguguauuaguuuguucucaugcugcuaauaaccacacacucaagacuggguaauuuauaaaggaaugagguuuaauggacucgcaaucauggaggaaggcaaaagaggagcaaagccacaucuuacauggcagcaggcaagacagcguauucaggggaaauguccuuuauaaaaccaucacuaucaaucaugagaacagcaugggaaagacccucccccuugauucaguuaccucccacugggucccucccaugacauguggggauuaugggagcuacaauucaagaugagauguggguggggaaacagccaaaucguauaacuagguauguccaccccaaacauuaagucaagaacaucuuuuuggucuuauagucuuuauucuuauauagggcaucucuggauauagguguucacauucuucuuugcaaccuguugguuuucaagacagacugucggcaagcaaaaugucagaggcaagcacugagauuugacccaucagcccuagggaagcugacucuuugguuuucccccaugcaccuugucuucuugauaugccugcagggguuggggggagguggguggguggaaaggaguacugguuuaggguugaagcaagucuaaagccagcuugcucuggguuuaagaucuggccuccacugcuguuucuccaaaguugggagucagucauauuccuguuuaagauaaucuuaagugaucuacauugaaucucucaguagguuauucucuuuaauccuucugaauaugccaaauggagaguuucgguuuggugcuagaauuaaaugccccucuaaugguggcuagccucacuuuuuaacacagagacugaaucucacuccuaguugcuaaggcaagcaacuaugcagagcuggaaaucaucagcauuguuuuucucuuauguuuauuuuuaugcuuaacuucuaauuacagguaguacuuguuuuucuuugaggcugaaauauaaaguuuaagauauauauacuaaaauucaaaaagugaaucaaguaaauaaugcucuaggugguccacaaagauaagaaaaaucaugacaaaaugggaaugaaugcaauuuggggaacacuguauucgcccaagugauguuuauuuaggcauguggucagaugguaaagaaaagaaagugggaggguagccuaggcaggauucagcaugaucugagaaucuugcaaguagaaccaaguugguuggggaaauccaggcccauuuugguuucugcuaccuggcuguagugugaccagggaggcaggugcugggcaggguuguauuaacaaggcagguaaggaagaaguccagcaggcgaggaggugggagguccucaaggcagaaauaggccaguagauaaggugaagaggcuaagaagacuauuuggaggguacaaggggagaugggacagggagaaggaaguggcuagagaggugagcucuuuuagcaaggagggcaguacacagacuaagagaauggccuuuagggugggacugccuggauucaaaucugagcuuugccacuuaccguuggccuugaacuaauaauacuuaacauccuuaagccuuaguuuucucaucacuugcaagacaggauaauaacagggucuacaucuuauaaauucuuagcaaguguguuggcuaguguuaucaauuccagggcugagcccuaucaugucugccucugugcauguugagaauugugcaguuuugcagagugagcaccaugaaugucuuuaaacuugcucugccuaagacuagcuugcugcugagggaauaaucacgaaagcuggagaaggccaagucuaucugaccuucagauuaacaauuuuuaaagucuagcuauguccaaauauuucauaauugcccuauuuacuaacacauuucagggguuucaugaaccacuuaauguauaaaaauucaauauguagacauuuuuuuugaaaagggaagaaauaagcagguggaccaauccaacgauugaauuuccuuuaaaaaaguaacuguaacuguaauagguuuguugccuaauucauggcaagucaauacaccgagacacaggguugcagcagagaaggaaguuuaaucauaaggcugccgaauaaggagacagggggaaaccucaaaucugccugucugagccguuuaggucuagguauuuuaagggaguuggagugaccgaggugggggaucacugguugaagaauacaggauggugagaugaagaaacugcauuuucaugcugauucaguuccucuuggggagaggcggggggcggucuucaaacugguuggcaauagcucuuuugcuggaauucaggaucugaaaaacaucuuaagccauuuuuaaacaaacaaaggccuuaugauucuaacaucagaaaucuucucuguaggaacaaugaggaggcaaaugguuagcaucuggugcucugggacuuuugguuacgaagaagugggccaaagugcagccugauuaaugcuuaauuacaacuauauuucuguccagaacccagcaucuaauucuuguuaacccugugaggaugguuucaauagaauguuuccauuguccuuaaagggagguauaguuagucccauuauacuccagguaaugaugacagucuuggcaaaaucuuaggacccuaaguuguuugccaccucacaaccuauauuauccguccuagucuuaguuaccacaucugacugcugggaagacugagggugauuuguuuggucugugcacaaaaccuuuaaagagaaauacacauguuaguuaacuuaaaaauccacagguacuguggcaauaguuuguguaacaaguuaggguaaauaucuuucugguaagauguacaagggaagucaauuuaccuggaagacaggaggugucaggccuccaggcaagacagaagcaaaaacugacaaaacaaagccuacaggaaauuuggguaauaaguuugaaucuucuuaaaguucuuaaagugucuagaaaaagcauucuaagacaaaacuccuacaauucagcaagccuugggaaaaaggcuaaagcuuucuagccucuaccugaaaauacccacugcauagaaaacccaggagaaaaaauucaaccuaggcagucaagucugagguauugucaccccauuuaaauuugaacagggcacucuaaaaugacauacuggccuucauaagaggaacagaaagagguuuguagucaugcccauaggccuauguucuuagguaaacuaaacuagcuugauccuuaaaaaacgagagagagauggugaacaguggaaaagguucaaaauaaaauaugaaagacagccucuguuauagcacuugccauauccccccaggcaacugagugcagagcugacaaacuuaugacaugggagaaugaaauaagcuuucuagaaugcaaggaucugaguacaacaccauauuugaacaacaauagggggcaagguagucugggucuuuaacuauuuagaauacucuaaaaagagggcuggggagagaaaggccaagugcacauauauuuaaagcuauccaguaaagacuuacuuacauuucaaggugaaaucagaauacaaugaauguguuuucuagcuaaaaaucaugaucacuaagugguugauacaauuuuuuccaaucaauugcuaacagcauuuauucacuaauuuuguuuuuuauuugugucugaucuacuucugcaacuuauaacaugaacauauuuauucacaggucagaugaagaauugccuaauuuuaauuuggaauuaucuaauucuaaaaacaaaaaagaaacuauuuauaggagaggaucuguaacugggguccaugggaguuuauuaacagguuugccagaaaaaaauacaagauaccaguuaaauuugaauuucagauaaacaaguaauuuuuuuagucuagauauaugccaguauugcaugguaacccuauauuuauaaacaaauuucagagagauagauacauuucucucucucucucuccuguuuuuuugaaacugagucuugcucugucacccaggcuggaaugcaguggcaugaucucagcucacugcaaccucugccucccagguucaagcaguucuccugccucagcuucccaaguaguugggauuauaggcaugagccacuguaccuggccuucuuuaacacuuuuuguuuacaggccaaacaucacccucagucauuccagcagucuacuaugugaacugagacuaggagggauaauauagauugccagauagaucuaggcaugagcucguuagacacugcauaaaaauuuggaguagaagcauuuugacaaggaaauuggcuauagcuaucuuucuaccagagucuuaaaccuaugaucucucaacaguuagucaucauuaagacaaagauuaauucuaucaagccuugacuuuucccuguggccugagcuuccuaggagccgaacauaaagggaaacaugaagggcaauuuaccaaauagcaacugaagagaagaguccacucagugaaagcagaggaguuugcccgggggcguguuagggaggcagagaaagcugguuuacagggcuuugcagacagacuugagccuaagggccaugucacaccuuuaaguuaaguugggguugaccuuuuaaacaagaaguugugcaugacagaaggucugcuuugugaacauuggauucuggaggagcaccaccgcaggaaagacuggagaaaggugguggugggcugggggcacuggcuuggaagaagagagugaagaggcaggagaguuggaagagacugggaggcugggaauacaguacucaagggccaggguuuucuccccuccagcucuuuguccuuugcagccaccacccaaggaugcuggugaagguguuuuugugcauccccauucugagagugcagccucuuuccugaggcccacgggagggucuggguaaugacgaaaugcagucuuuaccugugucacugaaaguagacccgcagagcugcggcuucugcugccauuuccuccucugaucuccaagaggcaggaaaguccuccuugucauguuucuggagcuuuggagaaaaaaaaaggaagaggcucuuucaugggcccuugggaucuccuugaacaaauuucggggggcugggggagacugaacaaaauuugcaaauuagaggccaguagguguaucuuuuaauuguuucaguugcuacaacuugcaaauaggcuuuauacaagaauccacauuuaaaauaaucagaucauuugccaucuuguaaucaucuacugaggcugaggggggugaugauaugauauaggucuguguccuugcccauaucucaugucaaauuagaauccccagugucagagguggggccugguggcaagugacuggaccaucaaggcagaauuccccauuggugcuguucucaugauagugaguuauugggggaccuuauuguuuaaaaguguguagcaccucccuccacucucucuuccuccugcuccagccacagaagacgugccugcuuucccuuccgccaugauugaaagguuccugaggccuccccaaccaugcuuucuguacagccugagaaaccaggagccaauuaaacugcuguuccuuauaaauuacccagccccggguaguuccuuauagcacuguaagaauggacuaauacaggugaucacagauugggaugaagugggggaauggggagcauuugccauucccagaaucucccccacacucuucuaauuuucuuauguuuaacaggcaucauucauuuauuuuacuuccuggauuuugaaggcauugaguuugccaccaacccauaauccccuccuucaagguggccugugguuuaccuccuacucucuuugguuuagacucucuugcaugagcucugagcaguuuuguucagugaaccaaauuuaugauaaugacacaagggccaugagaacugaguaaguaauaaguauuuccauuaaaagaggguucaagcagggaaacaguaaaaaagagauuaaaugagaaaacaacuuacaaaaaauuaacaauuugucucaaaauuaacacuugaaucauuuaaauuccuccucagauuacaggcauauuuaaaaaauuguguguaugucucagauuuacauauagagugaauacaauuucaauucuaucagagaggauguucucagaacucucuuccuuagaaaugcucaauuuucucccuuaaccuccuauuaugauucaauuucauuaacuaaauuuauuguuccuguguguggcucuauacauuguaaaaugccgcagguuauccguucauucuucaugggaaugcacaguguaguauuuuguguuauguguuaaaagucauuugggauugagacaauuuaauagcaccaaugauagcuagcauuuaugaugugaaaggcgcacauuauuucuuugauauacauuauuucguuuaauccuuacaauaacucauaaaacugacgcuacuuaaccccauguuacuguggaggaaacugaguucugaggaaguucauaccccgguccaaagaucacccagcuagguagugggguaggugccaguauuauccccaacaacuuuugccuuuuuauucauccugagggaucuacagugucccuaaagagcaucccacagauacuguuccacuccauuuugaaaaaggucaacuuaacgauuaaaauaucgacuuuuuaaaaguugauccuuuaaaaauaauuuugccaacucagcaaaaagucuaucaacuaauaaaugacuuuugcuaucucaggccccaaacucuaaaucuaaccuagaggccucuacccuggcagcuugcagcagauggagaaauuuccccauuuauugcagcucaacauugauacagaaggcaaaacagugagggaaccauagccucgcacucccgcugagcuguauuuccacuccugguaaguaaguuugagccuaaaugaggcucauuagcauauaaccgggccacagauacauuuaugagggucauggaucuucccuucagaauuuggcugccagcacgcugauuuuacauuuugccauguagauuuaauucuccuuagugaaagaaaaccacauuaagaagucauuuccuuucuugcagaggcaaacaugcugcaguugcuacaggcaaggcaaacgggauugcuauucuucuacucaagaacuaauuuucauuuugauacuaccuugacgucuguuauaaauccaucuuaucuuauaacaauucaauaggaugacaaagagauaugcaaagcccaggaaauauggccuucccacuucugcuacugccauuggaagacacagaaauaaagcauuaaguggccucaacaacacagaucauaccagaggaauccaaauaauuuagagccugugaauguuaaugccuuccugguuauuaggcaaccgucuguuauugucauaugccuuacagauggcaacauugugccaauccuuagaagaaguuuuugggaaauaauaggaaauaaauaaaacaaaaacuaaucaucuuugcaaaaacucuguuguaccuagcuuuuaaaaguuaugagauuucccuccuaaaagccccagauggaagcaugugguucuguuuagaacagcggcacucaacccugguugguugcccacuguaaucaucuaggaagcuuuaaaaaauaaaacccaccccagggauucugauuuaauuggucuggggcagccuggguuuggggauuuaaaacaaaacuucucagccaauucuaaggugcacuuacuguugagaaucacugcuuuuugggagaaguguguagauagagcccacacacauauagaaagaauccgcuugccuuuaagcacauugcuugugauccuaucaacaguacuacugcuguccuuugcaaaccuugcccuagaacugcuuuucuucuguuuaugcucuguccaugggaugucuggccuacaaggcuugucuuagcaacacuaacaugcggaugcaguucagcagccuuugaauguuuuuaaucucugcagaaauagggagccugggaaaggcccuggugggcaagacuuguguccuagaagauccauccaggugacuugaagacuaaaaaugcuacaguuuggaguaaaguuccauuucccuaaagcaacccaagaaccugguggcugcaacuucuugccuggcuaacggagagaaagcccuaaugaucuuaaauaguaguuuauccaaaaggcaguauuugccgugggugaacuuuaauggaggaguuucacuucugauaagccuucuagauuacuuuggcugcccacaggggagggcggugacuacuuguuaacacacaagacaguugcucugucucuguaaugccaggggccagaccuagcacuggaacacugaaccagacagacuccuuuauuguucuccuggggcacccagguagggagguuacacaccaaacggcugauucuuagugagaugggauuacaaaaugggaaggcugcuggauagagcuagccucauugcaaaggcuuuugaguaucaccuugguuucacaaagaaacguuaugaaaaacagugauggagggaaagagguuaucuacggaucauccaaaaauggcucuccaagaaggcgagaguuaguuaggucugagcuugaacaaugagaagaacaaaaguuccuuuaaucucuuugugucucaguuuuccccuuuguaaaaugggaguaggaaaaagaguggugagcagugccgugccugacacauaguuaagugguauuuaauauucccugcugcugcuacuacugucagucauuagcauuauuuuuaggcuaaauaacacugaccuaaugacagcgagcacuaaaaauuccacagagguuguuucuaggaguaaaaguauuuuucaucuccaugguuccccagugaucuguaucuuuuggaccuaacuaacuacuuuguagaaggauuaaaaguuaugaucagaauucagauccaaaacaacuuauuauaaugagacacucaaaucuggggaggaaauguaccuccuucagcucuaaagugacccucacuaaucccuaauccucagagcuguccuaaggagugaguaagguauuaaucgaggcuucucaugguaaaagcuaagguccuaugguaaaagaaugugguggaggucaaagguagucaauaccccaggaguaugguugccagauuuagcaaacaaaaauacaagacacucagugacuuguuuuaggauaaggaugucucauacaguauugagacgacauccugauaugaaacaaugauuuguuguuuaccugaaauacaaaguuaacugggauucuuguauuuuauuugacaacucaacauagcagaccccuuaaaaaggugucacaggaagaacuuggcuugcauuugguaacuagguuguucccaaaguugccuggcugugaauccuggaaaaaacagaggggaucaugugcaggaagauaaaauucaaggccaucauuuugugcacuccagggcuuauuauuauugcauggucuuauugcacggaaugcaguguaaaucaaccugcacuauuuuaauuccuuaguucaccaguucuaaggugcacauuuuuucauauuuuaacaucuuugaaaucaaaacauguccuauaaccaaaagugugucauaguuuaauuggcaguguuuuucuuucuuaguaguacauaaaauaacagcacuuccaacugacugugucugggauucagugcacuauauuucuccaucucuccuuucugcagguaagucacguaaguuaaaugugacucugcuugcucugaaaaugcucaacaccaacgcugauguauuacauacugguuuccuucugaugcaacaacaauagucaaaacgguuuucacagaagcuuuguucuuuagaggaaagugcacgccaaagugacaacguuugcaaaaacuugaaccaaagucuuuauucacauucaacagacugaagucugugauggccucuccaagcaaauucuauuucugcacagcuuugaaaagagauuuaaaacaaaaaaucuaucuucagucaucccacuuuaucugcuagaaaugguuuuuggggaagguaguguuaacaggauuucugacugaagaacugauacgugucgauuuugacacugugcucccuccugugcacugaguguguuaucacaagguauaugggguaaugaugaauucccugcuguauugcucaaaccgccuuugcuauugacaucuuuagaguucuguaauggaaugcaguaggaggaaugguucacaauaauuuaaauguuuuucagaauuuggaacgaaccuggaguaaaaugccaaauugucuucaaacgggggaaaacuacuuuaaugcucuucuuacagaagcaaacggcugaauauaaacuuggauguuuuuauaaaaacauauuucauuauuaucacuuuuauaaaacaacauacagaagcagagagcuuaaauaaaccauuucuuauggguugacgguucuguuuacacagggguuuauauaaagucucaaaaggaaaauaacuguauuguuuuuuuagaucugauccucucuuauuacuuucuauucaaccaaguuuugaugaacacaugauauauuccaggcucuguucuaggucuuaugaaagaugauacaaagauaaauaagcccaagaucuuugccuccucagguucaccaugcaauaaggcagacagauucaugcauagauaauuuaauacuggccuaacuaccgaacuagaaguuccaucaaaguguucuuggaguaucuggggcagggggagacaaaauaauucuugcuggaauucaggucugagauugacuuuuaaaaaucaaggacuuggacugggcuuaaaagaugguaaugagauuuugaagaaaggguaauucugggcaaugggaacagcuucguuaaacacaugaugcgaguaccaguuccccagcaaggcaacuuguacccauggucagcuucaccaacuaauuacagcacuguucccugaugaauccugaccuggcuucuaggcagcuacuaacaaacauguaucagaguuagcaagagagcugaaauuugccacuuugagaagccuuaacauuccauuguuuaaagauggaauaggcacgcacaacaggggucuaaaagauggucuccggcccuacaaaugcaaagcugcaaacagcuuugaaucuuacugagagaaacuuauucccuuuucagugaucuuucagucccucugacuguucaagaauaaagucucagcggacuaguacguccuugauaaggcaucaacaacaccucuaagagaaagagaagagccauccagacuggcuagaauauaauaagauuguuuuguuuagaucauauuuauuuuuagggacaucucucauuuaugacaaaucaugucaagucuccuuuuaaaguaaauuuaaguuaaacauaaaagaaucaauuuuaaaaauauaugaaaugaaauggugugaaaauauggcauuaacagcuugagaaauggccccuggggaaggaaguacaacugaggugggaaagggugacucaagaugugagggugaugcauuggccuuuaaugcuuguggguggcaguuucuacugggcugaguucuagaaagcuacauuuuucauggaugcaugggagucaaaauaauuucauguuauaagaacuccgucaaaaaaugguaugggggaugguagaacuuuggguagggcaggcuuuuaaaggaaggcuucacugaagauguagcauauaaguugaggugugaauaaugaguauuuaaguaaaggggcaggaaggaauauuucaagcagaaagaacagcaagugcagaccuucaaggaaguguggugguuggguaacaggcuggaagagugagagagaggacuuggggggauggcagaucauuugcacccugugggcagggcugagaaguuuggauuuuauuuuuggugugaugagaagauaggcaaggaaguaaaaggacuagaauaauugcucauaaagaauguccuggaaggauaaugaauuaaagggagaaagugauggcaacaaucagaagagaaaguuugggagagggggcucauuugccccauaggcuaguuagcgucauggccacuaagugagaggacuuggccccucacuauagauggaccuugucaucuggcagcuuucucccuggugcuugucuguaaagcacacagagauccuggcuucccugccaagauugcucugaacuagugugaaaaucacucaguuuuugcccaauauccauucugccucucuucuaucauucacuucucaaaguucccgagaagccuuccuggaccauucugauugagucauauuucacgauucuggaugcuuucaugcuucuggcaccucccuggcacuguccuuucaguacauguuuccugccagacauggagcuuccuuugucuaugugcugguuacugagcagacuggcgcccacgcuggacuuucuugguggcccaaugaaucaccaggugcuuucacuugaggcagaaaauggucuuggaccacaaaccucugccugccacuugugauaccuuagaacgcugaaguucuuugaauauuacuuaguagaaaaauauguucauugcuucccuucucuauccugugaacuggaccuuggacuaagcacuagacugugagauaucuaugugcaaacaaauuaccuucagguccuucuacuuacugugaaaguucaaaagcccaguuccuccuccuuuucugaacagaaauucaaguaaucaauggagcauuaaucauuugauuaguugccaaagcuuugacuuaagcauaacuuacuugaguaaaagcaaguauuuuuagugcugccuguggggccaaaaugcugaaauaagcucuuauauuaauuaguggcaucccauuuucaagggguauagaguguuggauguuuaagaauuuguaacccccaaaaguaaguauuaacuagaaaaucacagugcuggaaaauaauuaugccaaaccacuguacuauaacagaccccaauugcuuauccaauuauacauugaaguaucacauugucaagccgauugccaaagcggcaaaugagacuuugcuagcaucauaauuuggaccagauauuacuccacuaacuacacuaugaauagucuuuggaacaugcuauguacccuauauaaaccuccacgaaccaaggugggcauuucagguuuguuggaguacgcccaugccaucaaaaaaaaaaaaaaaaucacuggaauugauuagacaugaaaguucacaguuuuccauugaaagccuguuaggagcaucucagcaaagagcaacugcagcuccagguucugagcagaguugauuucaauuaaaauaucaaagguagucacuuccugucagggagaccaucaguaauucuauccucaaauguguaucugagaaaaacaaccccagacacugccuccuggaucugcaacacugcucccugauugauuggccaccauuuagagguaauuuuuuuuuuuuucgagacaaggucucacucugucuggaguguaguggccagcucacugcagccucaaccucccaggcuuaagugauccagccacuuccgccuccuaaagugccgggguuauaggcaugcaccacugugcucggccuagaacuuucuuacaacacaacaucaggacagcugaagaacaggagccuggaacugggcugugaggagcuacuaagggguugauauucuuaggacaccccauugcuaugauuuucuucucaaccuuguaagggauuggaacgaucuugcccaacaguugggucugauaugucagacgaaaaucccacuguggcaagagccugacucccaggguucaguagagaaauaauuugcacucgcccaguaguucuuugcuuuucaaguaauaguaagcccuaaacaauaucaaacuugguaaaaacaaaaucuuccugucuaguccccacauugcccagucagaguaacauccaucuucguauccucucggcuagcuguaucugauaccaguauaggaaucccccuucuucacccaguggaugccugaaaccagggauaguacugaacccuauguaugcucucuguuuucuucuacacauacacaaaccuaugauaaaguugaauguauaaaucagguacagguacagguuaagagauuaacaaccaagaauaaaauagaacaauuguaacaaugcacuguucacaauugcacaaacagaagaucccugcuugcagaggaucuuagcaauuuauuuuauuuuuuuuuuuucgagauggagucuugcucuguugcccaggcuggagugcaguggcaugaucucggcucacugcaaccucugucuccuggguacaagugauucuccugccucacccuucucaguagcugggacuacgggagugcaccaccacaccuggcuaguuuuuguagagaugggguuucaccauguuggccaggcuggucucgaacuccugaccucaugaccugcccgccucggccucccaaaguucugggauuguaggugugagccaccgcgcccuaccagcaauuucaucauauaauuuguuuuauuuccuuauuaagucaggaacuuucaccuuuucucuuaaauaccuuauguccucuuuuuggcauaucugaauugccagcaucacuacucuuaugcuuuggggcuguuauuaaggaaaaugaaggguuacuugggcauaagcacugugauuucaugacagucaaccugguaacagagauggcuacucagugacuaacaggcggguaguguagacaacauggcuacacuggacaaagggaggauccgcauccuggccaggacagagugggacggcgugcaauuuugucacacugcucagaacguuguacaaugaaaacuuaugaauuguuuauuucuagaauuuuucauuuaguaguuucagacuaugguaaacugugaaaagugaaacuggagauaagaggggacuacuguaguagguuuucaauaagcauuggucaaauacgucacuaaauuacacuuuuccucccaauauacuggcuaugcuagcucaucauccccauuuuccacauaaaacaaggaacuuaaaucacucaaccaauguaacauggauaacucagagugguauuuguuuggaugagacacacaaacacuggauccacuaguggauccagacaugcagcaaacuguaugucucauccaaacaaauuugcuguaugucuagugcucuucugauccacucuauaaauuccugggaacguucuuucaguuaacauaguugaaaacaugggugguaaaacagcauagaaagcaaaacuaacacugcaaauagggaucaaccucuaagcccggagggcccugcuggaaaaccucuucugaggggaaaauugcaucucagggcaguuuucaggaauuaaucgcugaucaccaacaccucaccccaggcgccaucauaucugaacccuucugguuuuucaguggguagaaaacuggugaggcaaaagggacuagagaucucugccaguuugauuuccucaggccucuguuucuaaaaacaugcucacugagaaaugaaaugaaacuccuucugaaaaggagguuugugaugaagcagacuucggagaaggaagcauuuauucaaaaagcaauuuccuuggccagucauguucuguaagccuuuuucccccccgccgguguuucagauauugguguuuaagcaagacuguucuccuuuaauccuagagugaugucaacccacaguacucagaacaaggaaugggaagaggcauagggccaauuucugccuuuguuggaaucuccugaacauuucauuuccuauuugcuucugcuacauauggcuucuuuuuucaaagguaccuugcagagucuucggaagcacaguguaggcaaggaaacucuccaaggagaaagaaaaaucugcacuacaagaugcuacgcaaacacacaacuaagagagggaggcaagcacacagcacgcaaccaauaaugcacagccacagaauccuucucaacacaacauugcaggcagcagcaacuggguugucaagauaaaaccuauuugaagaagcugaucuagcugggaccuuugaacaauccagauccccaagcauuuaaagcuuguuucucugcagaauucauucaauuauucaacaaauaugaacauguauucaguguauuuuauaguguaauaguaaucaagcuggacaagguagugccuuugggaggcuuacauucuaggagagaaggcaggcaguuagcaaguaaucaucuaucacugccuugggagggaauaaaagagggagcuaccugagacaauauggucagaaaagacugcucugaggaaaggacagucagcugaggaguggcaagugcaaacaccccaagggaagaaggaggcaucuguauggucugugcacuggcugaaggcaagugucugaaggcgagugaggaaguucucagauagaagguagaagaugagguggagaagugggaaaaucucccuucccuuuagcacuggaggcgaaagggcuagaagacgagagacugaaugauucuuucagucacaucacucuuuucaagcaccuacuuugugcuaggcgcagaagacuauuaaacaggcaaagcuguaauaaauccaaacucagugagcugaagguagaaaggccgucccagaacagcuggacccagcacugccucugaacaugggcaaugacacuuuggggcucaauguuugcuuacugggucucucacacacccuaacaucagcccugccuauaaugaacuuuccccagaaaagcaggugagcagcaagcuauuugcacauguggugacuaccauggagcagcaaggaugcaggcugaccucacagacuucuuucugaaugcauaccauauguuuggcagagcuaaaagagcuaucccagcaccaucuagccaggugcuuggcacuggaucucauaugcuggcagaugaaaaaugacuaauaugaaaaucuauauuccaacgguacucaccaguccacuggauuggucacgauuccuucuuucuacaauaggaucauucugcuucugauuacaaaacugcacccucugaagcugcuacucacccguuggaaguuacaugcccugugcagccuacaaauccauuaaguucugauggagcuauuccaacgcccuucaaagaaccuggcccaugugaguugcacaaacaaauuggagccaaccuuucccaaaugccucucucuauuucauuuaaaaacccucuuuaaugaagacauaaagccuugaaugcaucugaaacgcuaugcuuaccaugcaugacagcagaucgucacagaggauuucaaaugcuuuuuuuuuucuaaccagaauacuugaaagaaacugagauuuccuuguuaugaguucaacuguucauuuuauaugcccuauaauugaccauucuccagaagucagcauaggcaacagagauguaaggcaacugcaaacacacacacacacacacacacacacacacacacacacacacacacacacacacacagcuuuggcacagugaaaaauuaaaaugcaaugccaggcuugggacuauuuugaagccucaggcuaggaaagcaauacccucaccuuucucagcugccuacuauguaccuaaccuuccaauuauuuauggcugagaugcuuaagauguacuggagaaacagccauggcugagagauacacaaagcugaaauauuauagagaguuauaacuucaugaaugaaaaaccuauaaaaaucacuuaaggguccuaaucuuucaguuaaucucaccucagugccacucaaggguuuaaaggaguuucacugauugguuuuuaaaggacaacgauaaaaaugcuuugaaauaacuaauuauaauuucagguaucuauguaaagguccagacacaaauauuugaaaauggacuguuccuagaaucagggauugacacagaucuuuaaaacuuucuagcccaaacauccaugugacauuuguaucccuuuggccauauugcuuucaaggcuucaaugcucuaggaaagaggaucuuacugcaguacugcuagauuuagguggagaucaaaauuaccaauguuugaaagugauauuuuuacauuaacuugaucaagaguuagaacuuggacuuauuacucagacagucugauccuucauugacaagcugugcugagaaaccauucugugggcuaaagaggauauggacucccaggauugcucuggcauugcgguugagaagauauacuggaauaaccucuuuugaaaacaguuuagcauuaccuccuaaaguugacaucuacaacaauaugacugccagguauauuaccaagagaaauucucauauguguacaagaagacaugcaugagaauguucaaagaaacucugauuaaaauagauagaaucuaguaaugaccaacaucccaccagggaguagaugaauaaacccugauauguucacauaauuaaauaccauggcucaagcaaaacaaauguuugauagugacacacagcucauagggagaaaucuuaacaauauauuaguuuaaaaaaauucccuaaagacaauaaaaauauacacacuuuaggaauccauagagaugccuaaaacuauaugaaaagucacaaagcaauggugagcauagauugaggaugcuggacugacuccaugugaggagacaaggggaugguuuuuugugugggacuaucauacuguuagaugugggauaguagcaaaaucauagguuuuguucugggcaauggguuugcagauacucauuaacaucauuaaacauaacuacuuacacaacuaaagaaaaggaggcuaugauggaaaacaaagagaaaugaucauccuugagaggcauguaagauuacaacaucggaugaccgcaguuuuccucaagauaggaauccagcucccauuccaaaauguccaccaaaguugcaacauaguagcauuugccauauaaaaguacuggaguuauuaacuggauuccagaugucugaaacugauguaucccuucacugaaucccgacuaggaucuauuuuggguauagcacuucacacagguugcuguucuuaauuaaaacuucucugccuuaagagcuuuaugucugugagauagucauccaaauguucuccucuccauaaaugugcucuuauguuuuauuuucacagcaaaaugcuugcccagauuuuaauaaacauguccgcaguaguaauauacauuucgcaugcuuuccacauuucauaaucucuuuaguccuuuuguuuauguugauucccacaccaagaaggcuguuuggaaggcuuugcagcucugucuccauuucuucugccuaucauuggggaaugaaacagcacacugauugcuauuuggguaggaaacacagacaagacguugaaagaaguaaacuaauuuccaagcaauuuugcuccuuucucucuuuuugauugauuuuggcaauaacucaccccaguucauugacauuagaguaaagccuaguagccaauuuauugcuucaaaaucugugagaguuccuaauugguuaucagacugugucuaccagaugccaaaauuaaauuucuuuuaaaucaagaaaaaagugauuuucuggcaucccagaugcaaaacaaccccgauuaacuguucuuucacauugcaaauggcuauuugggccuuggguggagagaaaacucaucuacuuacaacaggagggggucagauucuggacucgauccuucagccaaaaugcagauaaaccacaaggaacaaauacuacucuaugaaaaauggagagcugggccgggcgcgguggcucacgccuguaaucccagcacuuucggaggcugaggcagguggaucaccugaggucaggaguucgagaccagccuggccaacauggugacacccuaucucuacuaaaaaugcaaaaauuagccagguggggugguggacaccuguaaucccaguuauucgggaggcugaggcaggagaauugcuugaacccgggaggugaauguugcagugagccgagauuguaucauugcacucuagccugggcaacagagugagacuuggucucaaaaagaaaaauggagugguguuccuggcugaaggagagaugcccucgguccaauguuggggaaauuuuugcucccggaaaguggaaacaucaaaggacuggagcccaacauuaaggauggaauaauuauguuguuguuauuguuauuuuuaauggagcucuauugagugcuugcugucugccuggcaaugugcucagugccaaguacaaacaugaucucauuuacucuucauaagaguaccuaccccauccauggugcugucauuuccauuuuuagaugaagaaguuaaggcuuagagaugugaucucauagcuaguaggcaguugggacuccagggucccacucccuuucugucuauucccccuccucauauaacaauacauagcauuugcuaagcaauacagacuaaauugaggcucuaacuuaacuuaaagcucuuuugcauacagaauguuauuugaugaacucuaggguagguagaggcacaauauuauuauccccauuuuauagagaagggaacaaaggcccagggagauucagugaauugcuugagucuucugccauguuggacuaaaagccucaguguugcucuacuaaaaaggucccucaacuaaauauaacagggguggccugcaucuagucucugaauuggaacaucacaacugacagagcuuauaucguggguucucuuauuuaaaaagcagaaauucuagguaaugguccagugcaauuucgacuccaucuccuaauccuuugacaucaaaugcucugguccugacuuacugguccuggacaugguuuucuuggcacaguagcaggccuuuaccauuuuaccugcaucucucaacccuuuguccuguuuccaucucaugugaguaggaguuauucuuuaaacaacugccuuguaucucacuaccagcccuuugcacauacuguucucccugcauggauggcauuucuuccccugauccaccagcacuggacuuagguggcccuccaagaugguuccauuucaggacacuuauuguacaugccuucuaauuuaucuuccacucuauagguuuccugggggcaaaaucaugucuuuucacaauagccaaucuuuucuuugacuucccagacaucaaugucauaugguucaaucuaauaccuuaaccaugaccuuauaaaaccaaagcuaggcacauaggagaggcucacuaaauacuucuugcccagauaaacuuaucacaguagauauucagaaggaugacauaguuguacccauccucaguccucaaauaagaguuuaauuauguuauguaaaccauaugauauacuagugaggcaggaacagauacacauuguaaaagagauccagaacaaaauaagauuucucuguggccuucgccaaucuuaaaauguaacuauauuuacugaaucaaacucuuacagcauaauaaacuuacuuacaaagaaucaggguagacagccuaaccuugaguaccucaagucuuugccccuggaucccacauaacaauauccuucccucuuuuaaggaaagcuggaaagaaaaccacucugccagcagaagggcaaauaaaagguaugucugugccugcacacagagguuggcauccuacccugauuugugacccauaauuaaugucaauuucauaauuucggaggauagaagaucaacaaggaagcugaccucuggcugucucacagcuaaucaucuuuugaggcggaaacuugagaggaaacagaaacgacaggcuggagcaccaggcuguggcucggaguguguuuugggugaucugccaagcagugagaacccauggucacgugcccucucugugcuggccccacagugacaccugcucacccuccauuggguaaggugggaaccugcaucccacccuguagaaggcuuggcuggacgccugcuagucucuacaaaguuccuucucauugugugcacucuucuacauggcuucuuaauuauguaugugcacaggcugugucgaauggaguugccuuugccucugcucaccacguauuacauuuuuaaucaguauauauaauuacuuaccgcaagcugccaggccagauuuucugagcauuagucuaauuaacuuaaacuugauaauuauguuucggauaccauagcaguacacacggaacggcagacuuugcugccagcuuauuugauuccaauaacguguuuucucaauacuggacuaguuuugauuuuuuuuuuuuuuuugaaaaaaauggccaucugauaauuacuuugguuucaaaauuuccccucagauaaacccauucugcuauuuaggacagcuucucaaaugauuuacacggauugaacuguuauaguauguuucuguguauuuuuacacacacaaaucuguuuuuacuaauauaaauucaaacugaggagaaaugacaguagaaggaauucugauggucaaaugacagaauuguccauguuucaacugcucuaugcauugccuuuuccauuucaauuuggguugaugaaaaaugagagacaaggaaaagcaaaacaaaacuaaacaaaacacagaaaaaugcccagacuuguaagggagaaaggucagcuucugguugaacgagggcaugauaaguucccacacuaauaaggcucaauucaccuagggcuuaccaugugccaggcacugcaaaaagcucuuuuuuguggacuaucucaucgaaucguccuaacaacccuaugugguaauuaguuauuacuauagguugaauugcauccuccugaaauauauguugaagcccuaauccacaaugucucagaauguaacuugguuuggaaauagggucuuuguagagguaaucagguuaaaagaagggcauuagggucagccuuaaucuaauaugacugguguccuuauacaaagggaaaauuuggacccagcagcugccaugcacgcaaagagauuaagugaagaugaaggcaaagauuggggugacggaucucuaagccauggaaugccaaagaucaucagcaaacucccagcagugaaguggacacacugaacagauucucccuuagagcccucaggaggaacagcucugcugacaccuucaccucgggcuuguaguugccagaacuguaaaacgacaaauuuccauuguuuaagccacccacccagguugugguacuugauuacggcagcccuagcccucuaauacauauacucugguuaccacuacuccccguuucacagaugccaaggcucagaaaagcuaugugauguguccaggucugcacagcugucaaguggcagggaaggaguccacaacaggccuuucggacucccaugcucaacccuugaccucacccaugccugugccacucugcuucugcccaggaggcugaaagaaucaauacaacaaaucccagaaguggaugaagcacuaugaacacuguaaugcuucuaagguaaaagucaagcuuagauggugccuguuuucacauuugcacaucgccucuuuuauuuaacacguaaaaugacugcuugaaauaccugcacucuaguuuuggagggcaacaacauggaauuuaaauuuucuuagggugaggguagcgggauuauuuuguucucuucucacauaagacaauaauggaccaaaaauaccacuuaccaauuacaaaagacaacaaauaacagagcacaacucaaugaaucgaauugcagaaggaagaacaggugggcuuucccaagaugucauaauagauggaaggagaacaagagagaaugaaccugcucuauaaaggccaaagacaggaaaugagaaucauucuggggaaaagauacaaccuuuauccaggaggaaaagcaugggaauaugauaauaauuuuuaaaaaagacaauucuccaagaauaucuccuggaauagauccaacggaaagcuugacaccagauaaagaagggaggucagguucauugagggccuauuacauuugggguauguuugagggugaaaccccccauagaguguugugaaguagaagcuaucgccucccacuuugcagauggggaaauaaaguucuaagcaauuaaauaauuacuaaagggcagcuacuccuuggcccagcaaaucacuggaaaugcugacauggaagaacagcaggaaggguuguccuaagaagaauuacuuuccuucuucagacuaguagugucucuaugucuguggggaacgugcacaagcucacacucaagacacagacuucucgucauaaaaaaauuucacaaauuaccucuaaguugcucuaaaacgggagugcuuaucauuuuuaggcaugucagcacuuuuuagaaucugaucaaagcuauguaugacuccuuucccuagaaaaaugugugcacacacauaaaugcauacacuuuacuugaaauuucuagaagguuuguacacccucagggauccaugagucacagcuuuaaagcccacaaaggauacaucugccuccaaggagcccagcaacuuuaugacacacuaaaacaaacacauaacaugcacucgcacaaccuugaccaggacagucccccuccacagucacuggcuuguaucuccauguuagcacacccaccuccaccacugagggggagcucugcugugcuucguugaucugcauucacuaaucuacauuccaggccccacauaaagcaaguauaaagugaauguuaagugaauuugaaguuagaagaccuggacuugagcucuaucacucccucugggucauguuguuucaucuccuugaaucucacuuuuaucacccacgcuauuaggcagaaaucaccccgguuugccucaccuuuucugaaggauugcugggaggaacauaugcagcaaugcagguggaagccauuuagaacaguaacagugaacacugacugugugcaaacacuguuuuaaacacuuuacauuuauucauuaaucuucaugaccaucuuaucaggguggcaguguuacuauccccauuucagacaugaggaagcugagcacagagaggucggggaacuggcccagguaggcacagggcugggaugcaaaugcaggcaggcuggugccaaggccagcucucguaaccacugugcauagugccucuucaggagaggcaaugccacaaaaaaugucuaaaauuauccuaacgagaaggcaaaagaacccugugagccuucuaugaacauuaguggaguuuggaggugugggguuugcagggcuuuagauuuagaccacccagaagagcucgauguuacauauaacugcaacuagcuugugcauccacaacuccaaauucagcccugugguggucagcgaauaucgagggagaaaagcagcagccucauguaggaaguguagggccagggcccccucucaaagcucauucacauguacuuacuuugacugccacaacgaacacauuuguaggcuuuccggcuuguggcuuaccugccugugaccacaaagcucauauguaccacaaguccucuuuuuccuacuucaaacaaacaaugcucaucucccuccucugaauuuuuuuguuugagaguuuccaccuuaagguuuucaagggguccacaauucaguuguaucuugaguggaaaucuuauucuguaaggccccugucuucauucucacacagucaaagcacacuagcugacaagcaggcuucgagcagagccaugauaaagcuucaagcccugccugcccagagcucacagccccggugggugacccggaaaauaagcaggcaccugcaaaaggccuguaaagugcugugaugaggaaaauaugggcaacugugggagucacagaaaggggguaccuaauccagcauggggagagggagacacuagaggguccaaaaagcugcguaucuucucugccuuuguauugucacaaaaaucuaggaguccucaugagcucaauguuaagugguugcaugcuuugacucacuuaaucgaaaauguuuuuaaaauccugcuuagaccuuuuuccucccacuguucccugaguuagcuccuucucacccucugggucucaauuuccaauguaauuaauucccucuuuucacgaagccuuccuggagcacccuacacugccuggcaucuccugugccaucuuccugcacuuucuuccuuucuucccagggaggcaggcuucaucuugaugucccggguguggacugcagaccaacaucaccuggcggcuuguuagaaaagcagaacauaaggccccaucccaaaugauuccucaauacuuuaaagcugccucgcccaggaccuuagccaucagccccaugugacuaccaggccccuguaaaacggcuugucugaacugagagguauugcagguguaaaguacauaccagauuuaggagacacugugaaaaagacuguaaaauaucucauuaauaauuauuucauguuaauuaccuacugaaauaauauuuaugauauuuuggauuaaauaaaauauuacaauuaauuuuaucuguuuuuuuaauauggcuacuauaaaacugauagucacaugugugguucccauuauguuuauuuuggacagggcugcccuacagcgugagaugcgcugguuuggauaaugaucaagaacaggcauuggcagacgacagccacugggucaaaucuggccaggugccugauuugguaaaggggcuuuuauuggaacacagucacacucacucauuuacugucuuuggcugcuuuugggcuacagcagcagagcuaaggauuugcgacagaaacugaauagccugaagagcuuaaaauauuuaccaucuggcccuuuuuagagaaaguaugcagaccccagucaagaacguucauuccagaacuggaccgauugacuuaaaaucacgucucuaccacuuuuuggugugugagguucggcaaguuaccucaccugccugugccucaguguuuguaucugaaaacagaagaugagcauacauaccuaacagaguuguuaugaagauuaaaugaguugauauaugugaacuuccuuaaauagugccucauccauaguagguucucaauaaauguuagccaccauuaauauuacugcuagcaguuaucacaaauuguaaugacacauuuuugcuuuaacuuuuuuuccugucugucuccccaucaaauuaaagaccuaggagaguggcaucauuuucugucuuguuccagcuguuuaagcacaguuaaacagcccacacgugagauucaauacauauuuguugcaugaaucaagugcagaggagggaaguaauuuuccuaaggcuccacggccagaaaguggccaggacuugaaugugguucuaucugcuugccaaacucaaauucuuaacuucucuugauacaccaaguguagucuauagaccagcgacaucagcaucacuugggagcuuguuaaaaaugccggagcuuaggcuucaucucagaccgacugaacuaaaaacucuauuuuaacaagaucgccaagaaauucauaggcacauuaagguuugagaagcacugcucugggcuauaauucccaguuucgacucaugugcuuauuuguucaacaagcaauuaauuuagcaucaaucauuccacagagccuuguguuuggacccccuaauuccagagcugaugauuucuauucaucccgaucagguccuggggguguuuaggguuugcaaugaacggcaaugugcugugucagaagugcccuuucuccuaccagguucaaaccacugcaaugcuggagugaccucucugcacagaaaucugcuuaacauuccuuacccgccuguagugaccaggccacaggcuccggcagaugcagaaggucugaaaaucuaguuguaaguaauuuuccucuaggugccuaccucagugaauugguucuccugugcauuuuauacaucaguggucgcaccacucaaacacacaauccauucccgaguuuaacagcucaggcaccuuccuuuuugauuuuauaaaugaaugcaaaucaucucccacucauauuauaaaccaauuaaaauucuccucacacuuuuaaaaaaacuuguuaccuggcucaaagauccuuagcucuuuucuuagaaacuggcccuuauguggccuguaugugaggaugaggguguuugaaauuagcaggaaaucuuagaaugguuuccccuuugucacagccagaaguuucagauuguggucaucagaugaacgcuuuaaaugagaaaaagacugauuagcauaauucuuaaaggucugaacucuacacucacagauggccucugagaggauggaugguacagaaaggagauuaggauaaaucuaauuaguuuggggguguucucauuucucaaguggugagcgauggagaagaagugauggauggacagauggagauaaugaagccccauuaaagccuuuuuugauucucauucuccaugauggagcacauuaucccauuaauguuucugugagcuaacacagccaaaguuuggcgcugucaccucgaaaaugaauucgaauugccugcccagcuccuuacauguguccacaggaguuaaaugagccugaaaacuguauuccugcugagaagcccauccuggcagcaugggcuggaagcccuccccuuugggaaugggccuuccuccuggcugguuucuaacagcacucaggccagagucccauagcuuuucugcuccgggguucuacaacuagaauuuccucugaaaugggcuguggcuugcacguauuuccaggguacugagacagaccgcugcuguucucuucaguggaggugacagcuacaagugcucaccaucacacucugauuagggaccugagggcaggguccaaaaacaaaaaguggcaagacaggcccaugacucagucacagagaugugacauaaauaauaauacaggacauugcacaggcuaugugcaaaguaagggccugacuggcuccacuagcucagagaacagugagacagugaugggccauccaggaaacagcagggaaaggggagagacuccucgggguuugaaaaaagaaccaugugcccccugaugacagcagccuccuaaauggaccccuugcuucuacucuugacucccuacaguccagcaucauuuaagaacauaaaccagaucaaaugauucuccccuucaauaauaaucagagcugacauuuauugagcacuuacuuaugugugcucagcgcugauccaagcacauugcauauauuauuucauuucacaacagcccuuugugguauuaauaucauccuuuuauuacagaugaggaaauuaaggcacaaacaggugaccuggcccaguaaguagcagaauuuauugacaagcucagguuucuugacuucagaacuccgauucuuaaccuauaacuccuguuccauguucauuccaugcccucccaccacacauggaauaaaaucuaaacuccucucugaccucauuuuguuccagugucucccaugcucacugugcucucgucacauucuucaagaacuccaagcacgguccaugucuaggcccugugcacuuguaguugccuuugucugcuuagaaaggauuucccuucucccauauccaccuucgaaaugucaggguggcccacgcuugauucucagcucucuuacuuuauucuacugcucuucccaaccagguggucucauucaaggccauggcuuuaaauacuaucuccuaugacucccacauuuauguuucuagccuggaacguuuaaugaguuccaaccaugcguguuuaauggcucaucuaaucuuuccucucgcauguguagugggcaccuauauuuaucacccaaagauaaaaaaaaaaccccugacuuguaacucuccuacccuacuucagucuguaaaguaaauagcacuaucauccagcugguuacucgagccaaaaaccagcaauucuucuuagcuucugagccuuugcacccaauccaugaacaaauucuaccugcuuccaaggcacaucccaaagggccuauuucucuccaccuccacuauaucaucucugauauaaaccacugugauaauuuugcuugcacuuuuaccucucuuuaauccagccagggagugacccuuuuaaaaguuaaaucagaucaugucauucccuugccuaauaccuucuaacucuaaugucaugcuaggcccugaagaccucuaggccaccgucugccucuuuaaccacaacuccucugccugcucaccaaugcuccgggcacacuggccucccuucuguuuccugaacaugccaugcucauccuggauguauggcuuuugcaaucacuauucacucugcuuagaaaacucucuaccccagguuuccccgggcuuacagcuucucauuuaguuaucaguugaaauguuaccuccuuggugaggccuuuucuaaccccucuaaccaaauucauaugcauaaauacuuucuuuaucauaccaaguuucauuuccuucucacucucugagaugucuguguguuuaauugguuuuuucugucucuccuacuagaguaaucucuuuggcggucugggucugaucugguuuguucaccccucuaucccccagugccuggaacuuuaucagggaucaauaaguaucuacugaaugaagagcaccauuuauuuagaagcucacaaaaugcuaauggaggagguaagauugaagacagaugauaaagcugggacuucaauccuauagucagugggaggggaauggauaaagaguaaaagugacgcaaacuuguagggagugggaggaagucuaaaaucuuccauuuguugaaugaccauaacccaggaggcccugguaauacacaggugaacaaaaccaaaauggccccuggccucauagagcuuguauuguagcauguaguuuaaacuuuuuuccccauuuuaggauggagcagggguaagcaaauguuuuacuguaaagggccagagaguaacuauuucuggcucuucaggccauauggucucugccacaaauacucugccacuguagugaaaaaggagccacagaucauacacagacuuggcuguguuccgauaaaacuuuauuuacaaagacaagcagcagguccaacuuggcaugugggccacaacuggacaaccccugggacagagacuucugucccuucuaaagaacuggggaguacuuuaggcuugucauguagagaaacaggcuuugaaucauaagaaccuuaagggucuuguggagaaaaacauagauuuauuauuuaccuuaaguuuucuaaagcgcuuagaaaacagugaguggaccuggagcugcugaccugggguuccugcuagucuuuuguuuuacuccuucccaugaaucaacuagcuuuuguaagaaaccucacaguuacauggauuugaauauacuuaaccugacaaagacuaacucaaaguggcuaaugccuauaccagaugguggaccugcccuuauuccacuguuagaaaggaagagaaugggcacuacugauuacuuguacugauuuaaguuuaagcuaauagcuuggcauuacccugacuucagccagggaagaaaaucacauccaaguuugcagacuccaugaaacauuggccauauauuuguuggcucauuagcuuggacauaaagacuuucuagaaagagaugccaucauuaggugccacucagacucuaggggugcuuuuggaaaccacugugaucagaaacguauauauuguuaagggaagagagagaguuguucuggacagguaccgagaggcagguuccaggaagcugaagccaacagaaucaaaccuuaacguacauaagccauuccugggcuuuguccauggguugccuuuguggugguugucugccugguuuccagggagccuucaauuagaauucugagcugagaugauuuauccugugugcuacauuagcuccauuugccauuaacauaaauaaggcuuuaguuacaugaggcaggcauaaaggguauguaugccuuccauucaugaaaacaucauuuuuucaaaacaccaguuucuucuuauaagcuaaguuacacuacccaaauauguaguaaucaguaauacagaacaauaaaaggccuugauacacugauccgggcauacgagguuaucaggaaauccucaagucagugucucuccccaugggaccaauccuguaccucuuuuuccuucaccuccauuuugacuugaaaugcaguagacaacagagccaguucagugccuugccaugcucccagcacuuagcacuguucgauaaauacaugagggauaaacaaauuguaaggaaacucccaucccaugagaggagaaggauucuaaagugcaugaccacacggacacacagguaacauccaucucuuugggaaaaggaguaaaauggacuuuccugaaacaacugcuaggcagaaggugggugaaagccacaagcauagccugccucauaguaguuccacgaaaguccauuuuaccccucuucccauagaaauggacacuaucuaugggucccuguguguggcugucuccugccaugucgcuggauuuucucaggaucccugacaaguagggauuuuuggucaaucuuucauagacacucuuaucuccucaaauggagacaccaucacuggcauugaaaugcuaaggugagaacucaccaagacacacuguagguaaaguuccagcucagcuuaggguuugauauguaacgggcccaauaaaugauagugauugguauuaggauugcuuuguucuuguuacagaugaagaaguagaaugucaguggauuacagugaacaguccaagcuacaaaauguguugcaacuggaauuugcauuccaugugucugguuccuucucuauguacaggaaugaaucaggagagcacacuggcucuaccuucuuccacucugacuucucagcuuuaaucccuggaguuccagggugguauggacugaaugugugugcccccaccacuuccccaaaauucauuaacaccacaauccaguuaagauauuuguuaguagggccuucgcagaggugauuaggguuagaugaggucaugaagguggagccccaggauggauuugugcccuuauaaggacaugaaggaccagagcucuuucucuccaccaugugaggauaccucaagaaggugaaccagaagcaggguccuaaccaacaccccgaccauguuagcgcccugauauuggacuuccagccuccagagccaugagaaauaaauguuucuguuuaacccguuuaguuuauauucucuuauagcagcuugaucuaaaacacagauaccucaagauggcuacaaauucuccucuaagugcuucagagaggauuagaagauaaauuauauaucuauuuuguuuucuaugcuaggccucuaugauauaauauaaauauaaucauuuguauuauaaacuagaauauaauacaaauaaaauuguauuauaaacuaccuuaaagaaaguccuccuuacacugaaccaaugcuaauguugguuaagccaauuucccuuagaaaaaggcauguaggaucuugaaggcauuggugggcugcauucccugcacugugagcaaggccugaccuagaaugaccuguaacaucaccccugucaugggucccaagcgcacagccaaaggucuucaaaacauauggguauccuuagcaaauaagagcauugcuaagugcaugauuaauaagccagaaaggcuauggcacuugacagacggaugaggcauuucagaaagauaagucaaagugcacugugaggugagugccucccuuaacuuucuuagcugugcuacucgguucauaaaccagggauuaaguccauuuucauuucaauuuuuuauuucaccuuuaagcaacuccuaaggcuuccaggagaauuuuguuugaccuuuagcuaaaguucaacuucuaccaaguuacgaauuuuggauggucccuaaaugaucacuuaagacagauuucacuauaauucaaagaaaggauaaucccuggcccaagaguucacaaaggaaggauucccaguggucccagagauggcaaaaguuauggauuucauccugcuaaugcauuuuagugauauuuucauugugcaacauuaauuaccaaugucagccuggaugcauuugcuggguauugaaaccacgacauuuuuuuaucucuaccuggucccagaugaagauuagcuuagugcuuccuuguguccuaggcccuagagaaaagaugcagccuacgggaugggguaaccuuggcaaguugccauuugcuucuaaaguuaugauagcaguguugaagccgucacugagacucuggugcucaagccaaguaggagcccuuugcuaucaugacauaugcucuagauuugcauuugucuaaaaucuagcuuuuaggagaccucucagagaugucucagggaggaacacucagaaaaugugaagaggagcaauggacagagacagagacuuccaauuuauagugaagaacagaccuuugaaguugacuuguuacauaaccugacuuaucuaccagaucugucugauuccuaaagaaguauaugaaaaucucucaauuuauauuucaaacuccugaccuucaggugauccacccgccucggccucccaaagugcuaggauuacagucaugagcuacugcgccuggccaucaauuuugucuaaucagaguuuuuuuucccuugaauuuuggauuuuguaguuaacuacuggguuguugugugccuguaauaaagauagaguuauuuuuguccacaaaaguugaaaacagagcugccaguugacaugaaaguacaacucauuuccauccacagccucuacauccauuaaauaaagagaaacucagugcucaucucacucaugaaucagaacaggauaucugcacaugccauuucucuaacuucccaaaugcagcaggaacaccucagccccgcucucucaguaucucaguggacuggaagcacguucauuuaagaggaagggcucauagcuuucugcagacaguucaauaccaugaugcauccgauucaguuucguccauucuauuucuuauugaucagcauaccucaggcuauuaguuuuauuaauuaaaugauaauuuuggggggugaguacacaaggagauaaaugucucacaaacagacuccaagcuugcaggcaggaggcaugcagugauuuacaaaguauuuaucuuucuggcauuuuuuuuucccccaggaaaaaguaaucaucacuaccaucuucuaaaaacagagaugcuuguuuucugggcaggcuuggaaacuagccaagacagcaggaagauugcuggaauuucaacacacuugcugugguaccauggugcuagugaccugcccuugcagauauaccuugacuccccacagaagucaccucaaagucucugcuauuuagcaaaucccuaggugucuggggaguagggguccagucuggggcugcugccucuucugauuggcugccuggcucugacucugaucccagaauacccagaggaauuuguuuccauccuccuggcccacaacucacacaaaccucuaauaguacacagguuauuaaaagcaaauaauagcugggcacaguggcucaugccuguaaucccagcacuuugggaggccaaggcgggaagaucacgaggucaagagaucgagaccauccuggccaacauggugaagccccuucucugcuaaaaauacaaaaauuagcugggggugguggcgcaugccuguagucucagcuacucgggaggcugaggcaggagaaucgcuugaacuccggagguguagguugcagugagaccaaaucaugccacugcacuccagccuggugacagagcgagacuugaucucacaaaaaacaaaacgaaacaaaacaagcaaauaauagugucccaauagaagcacuugcccuaccacagcccucucucucugccaucaccaggcacuuucugacauuuccaucuuucugacaggguuucucaaccucagucucuauugagguuuugggucagauaauucuuaguugagagaggugguccugugcauuguaggguguuuggcagcauccuuggucuccacccacuugauguggugagcacacaccuccccauccacaaacaucuccacacguugccaaauauccucugggggagcugauuugccacaacccccacaccccaccagugaaaaaccaaugucuugggacaaguggaaagugaugggggaaacugaaaccucccugacgcuuugguuccuguaaggaaccacaggagacuacaucauugucaccucucccugguuugcagacauuauuucugagucaugugaaugaacuagaaaccuuaaauaggaagucagaagggaagcuggggaggagaguggggaccgaguugaaagaugauauugacuauuuguacuuuucaauuagcacaggugcaacgcuucaggauucuuggccaaaaaaugauauaaaaaugauuggaccgaccugcucuuucuaggguaaaggucugugagucauaucacucagaaaacauuuuugagcaccuaugauaucccucauccagucaaucaagagauuuaacagauucuucuucucucccucccugcagccauucuucuaggucuugccacuauuuucuuccuccuggauucucccaagagccuauucucuaccuucuaccagccuuguuucucaguauccauucucucacugaaggugaguggucuuuuugaaaugcaaaucagauggugcuagucagagggugcuagucagccaucugcuagcuucccuggcuuuccauucuuuucggauaaaaucccaacuccuuaacaaggccuagaaagccauacauugccuuuguuauuucauuacuuacaacugugugguccaacuccacuggaccagucuugccugguuccucccagagugugggacacuaaccaccacuguguagguaggcacagaagguggcuuuacguagaacgcagucacgaccuuaaaaaauguugaaucacauagugauucuuuagguucaacauccuuuuucuuccuugugcucucuccuagagaaagucaguucggugcuccuuuguccuuccugcaccaaggcuuauugaucaaccuucuuguguuagaaaagaacaagccucaggcuccaacauagaaucuaguuggcauuuaauaauacuauuuuauuuuugauuguacuuacuuuuacaguuaccuuuuguauuagucuguucuggcacuacuauaaagaaauaccugagacaggguaguuuauaaagaaaagagguuuaguuggcccauaguucugcaggcuguacaggaagcaugaugcuggcaucauggggaggccucaggaagcuuccaaucaugguggaaggcaaaguggaagcagacaggucacauggcccgagcaacaagagagagagaggggaguugccgcacacuuuuaaacaaccagaucucaugagaacucacuaucacgaggauggcaucaaggggauucaugagaaaucugcccccaugacccaaucaccucccaccaggcccuacccuucaacacuagguauuacaauucgacaugagauuugguggggacacauauccgaaccauaucaccuauuuauggcauauuauaaauguuuccaguauaacauuccagaagugauuagugaugcaaucuugccuuuuuuuuuuuuuuugagauaguaucucacucugucucccaggcuggagugcaguggcacgaucuuggcucacugcaaccucugccuccaggguuuaagcaauucuccugccucaaccucccgaguagcuggguuuacaggcgugcaucaucauacccagcuaauuuuuguauuuuuugguagacgugggguuuuaccaugucggccaagcugguaauuccaagcugaacuccugaccucaagugauccgcccaccuuggccucccaaagugcugggauuacaggcgugagccacuacaccuggcagcaucuuuccuuuuucagugcauguauucagguagaaaaagaaaguuuacuugaagaaacauaaauaguaguagcaguaguuucuagacauggcaaauaccaggauuaaugcuugguauuugggaaacaaggaguuacuuaaauuugcagcaugcucucauaugccagacguccuucagccaggcuaagaagguggagugggcaggaguaggagacauuggauuguuccuuguaaucucucaugcaaucuuuggaguuugaugcagaugucaccccgccaaaauuugagucagugccccaccuaugcgcuccgcuaauaccuucaacaccccgcuuagaggaucugucauggcgccugugagcucugagaucaugucuguuguguucacuguuguuucugcagugucugacaugcagcauggcagaauaaacaagacaccagguaaauauaucuuggcuugaugggugaaauggggguaaggagggaaacuuaucauccuuuucagccaggucugggccacaccaaaagugaaaggcagaaugagaugccuagauaauccgugccaauaaagaugcugacccaccuccuccuggacaacagagacaaaagaguuaauaaugugaauuacuuggggugcagcuuccaucucccucaccacuuaaagugucagaauuugacccccacuggcuaaugcaaaaaacacacagaagcuggcaagacaugggcuugcuugucccuccucuuucuuucuaccuggagcuuuaccuuuacaaauuuguagcacuugaagguauguuucccuagccauuucuggaucauaacaauuccuuuuuccuacugacaaaaucugaaacuuagccggaagcacucucuugccagggaaagaacugugucagacgugcgaugcgugauaaaauacuacgguaauguggaauaaugcuuucaacuguugccagggugagcaugcaugcagaaugauggaaauugccugcaaauacaaaugguugcucuguggcucaucuguaaccucaauguaggaaagcggagauauucuuuucccuccuuugcaauuugcacagccucuuguuggaaacuauggagauuaugccauugaaaguaacugccauguuuacucaacacacaauuuuuacuaauacagucuccccauguagucaucugucuugugagguucccucaauacuccagcuguuccuguggcugcugcugcgaacaccucauugaagaaaucaaggugccaaacccaaaugcuuuaugugaggguguggaggucauuuuugcauugcugaaaaugacauccacuuucuaccuuagaaacaaaggcugcauaacugaaugggauucagugcaccccuacccccuucucaguggugaauucaaugggaauuaucagagggcuggucuguauaacuagaaaagccaaaauuguuggguguuuacuauguguuagguauuuugccuucuuuuaggugaaccucauaacaugcuauaucauaaauauuauccuccucauuuugguguugaaaaacugagagucagaaagguuaacuaacaugcucaauaucucccagauaauaagugaccaagccaggauuuagucccaggucuguaugacucuaaaucuugaauuauuuccaugacaaauaauguuaaacuaaagccagcauuuuucucuuugaguugugguuaaacuuucauuaucuguggccuuuaagcauuauuuguugguuuucacguacccauaacuaucaggauacaugaaccaaugggaagucacguccucaugaagagccaguagccuaaaugugaaauuucucaugcauaccagaagcacaaggggcaaaacacacacacacacacacacacacacacacacacacacacacacacacgucaaaggcuucucccucuuuaugaaaaguaaaaugccauuuucuuuuucuacaaagggaacaagauaauucauucacggaucucuugauuagcucaauuguucugagaugauaauaguuaccauggauuagguacuuacuacaugccaggaaucaagggaagcacuuugcaagaaggauaacauaauauuuauaacccaaugauguaggcacuacuauuagucccauuggacaaaugugaaaacugagguuuagagauuauguauccugccaaggucacucgguucaguugggauucaaaccuaggccucucuggcucugccuccauguucuuaccugcuauguuaucuuguuuucuacaaacccuuccuagcuaccaucuaugugcuggauaaauaagggaaucuuuuuaccguagagugaaaaugagaaguucugaggaagugacauaguguucuaggaagugcccuccuuuaagaacaaaguaggcugguuucucacugccaaucaaagugugacauuggcccuucuggggcucaccuuucuagucugcaaauugaugguagcaaaggacacaauguguaaggacccuuccugcccuaacguucugucauucuauuaaccacauuuuccccucucccaucauuucuccugggcuuugauuuucacuuuuucauggccaguagaagucacacauacccaaggcgaggcugcccuccucuagugaacugcaaucauuugaacauccugccucaauugaaucauccugacagcuaucccuauggcuggccagucaacucccaagcacuuccuggaaaugcagaugcuguauccagggcagaaaguacuuccccugucaucucacucccucucugggcuccagccccaaggccuuuuaggucuucagacuggcuccgugccacccuugcaccagugcacaugcuguuccucugccuggaacacauuuucuucccugccuccugugguuaggggccaggcagguuucccuaaacagggcuaaaggcaggcuacgauccucauucuagauuggcccucuccuauacaguacuucucugaauuggucccuauuuauucaguuggaucagugucuuagucuuccacuauacucacccuugugucccugcacccagcccagggccuggcucacaggaaccucucaaaaccuguugguagaagaauuugcacauuaaccugccacccacaucuguguucucuuauugaugagguacaagaaaggaagaugguaggccaauuuacagugggguuaugaggcuaggucuccucucagcccacuaaugucucagaaccacguucuuugcugaguucauauguuuuuuuuuuuuaccccaucuccaaacagcaaguaaucuugcagaucaaugccugagaccaaagagacuuaugaauguuaagaagauuaugcacauaaauguaccacuaugacagccccgcuaagaagaauagugauaucgcacugcgugcuaguuuaucaaccuuugcuacuuaaaaaauucacagccaauuuaauuaaaaauauaacagcucugaaagcugcuaaaaugacuaugacaacaaucuaucauuuuguaauagugcugaagauccauuagggacuuugcacuggaugccaacuuuuuaaagcccagauaguaggggcauuucauucugcacaauuaaugucacugcauuuaaaauauugacuaucuaugaagaagaaaauaccaaacaucuuuauaacccacauuuuuuauggucaaaacuugcuuagaaaggugcuuugaauuuauuuguuauaagcugcacauuucacguucagaaaauuaaaaugguuucuacugacuaacucauuuaaucauuuaguugauuuaaugaaaaacacuaugcauuuuucucuucuccguugcuaagauuaauacuuucuguucauuagcaaucaaauauugcaggaagguuuacaucuuauucucacuuaacucauugccuuuuauuuuuaaaaaauucuaauagaauugaaaugguaucuuuuaaaucaggaauuuuccucuugguaacucguuuugucuuguggaaaacacauggcuagccugugacauugaggcauuuaugucugaauuguuuuucuagucuuuuuaggggaugcauuauagggaggaaagggaguggacacuuuagaaaaauuaugaaucuaguuuucagggccccuaacucauuaauacaucagugacauucuagcauccuuugaaauucuguuaagaagggcccuuugauuuauuagugggauuuuaugagcuaccugggaaagugaacccauuaaaaauguuaacuguaagcaucuggcuuccauugaauaaagaaucgaagccaccacauaaaagugacucugcacaaacauggcacuccucucccaucacucccaaagcuucccauuguaaaugccacuucaucacagcagugccauuugcaguuguagucucaucucuguuauccacugcuauuuucaggaguguauaaaugagcagcgaaauuccucuccccuggaaaugccuguaagagcagauucuaaaaugggaacuuuuugugacaagauuggguacaaaauaguauaauuacuguaaauuguucaauaauagggccaguaguuuaaaagcagcauuuccagauuuccuuugcuuccauaccaaaaagcauuuucuugaaccccaauugcuucauaggaggaaauaauaaaaggcaggugauagcauuuuguacuuagcauagauacaaugguuuaaggacacggugcacugagucaagaccacuaagagguagagggcaaauuaaccauuuggacaguaggaaaaggaggcauuuuaagguggcaugcaaugagccagccagcuaauuauaguaagagcagcuucccuaacuuuuacuuucuauuucaagguguucauugcuucucucucucucucuuucucucucucucucucucucucuguguguguguguguauaaaucaucugucuucaucauugcauuauugauauugauugauuguaggaggagaaaacaagaauuuuuccauuuuauaguuaggaaaacugaaacacaggcaucagugugcuguaacccuacuauaaugcucuucucuuuuuacgcacuuaggaaaaggauaauuuuuuuuuaacauuugugcaauuauuuaauaugugucuccccaacacuguaauaucuaugagagccaaaucacuaccugucuuguucaucaucacagucccagcacuaacauagucccugcuauaugguugguaggugcuaaguaaacuuuuuuuuaaugaaugaaugaauauuauuuucugaggucauuccuauuggagcauuaguaaagcaggacaaaacuccaggucacauuccuguacuauuguugaacuucuauucacccuucaggacucuggugaaaugucagcaucuuugggaagccuuucugaguucucccugacuuugccugggcuccauuaaugcuucguacuuaggccuguuguguguuguuucuuuugcuuccuucucuucacggaacuacucuuucauguggguaauuauccuguuccucaggcuuuggaugggguugacuccauuucuaacuggccuugggauggguucauaauccagaucuggccucucagggaacccuauccuucuggccaugguuauuggcucagcaaugauccuguagcuuaacuugggccagcauggucugugcaaaguuuuuauaggcauuacugaagcagcggggguggggugggggaaacccacaaucuuucuaccauaagcuaguaggaugugagccuccggcugcugguguucgcauuaccuucccugaggagagguugccugagagaagcagagagacacaaagccccuaaugacauugcuugugccccuggauccagccgcgccugaaucaacaauacuauuagacuuuucaguuacaugagcuaauaaacucguucucauucucuuaaggcucuuaaggcagguugaguuggguuucuauaacuugcaaagggucucuaauuucucuauguugcagucuauugagcauguacuccaugaaaugugggugauucauuucuguauucccaaugcugaguauaggccuuguccuuaguaaaggcuuguugaauuaaaaaaacggugcaauucuagggcaaggacauuuccacaaggccagguauuuuggggaugacccugucaauaagggcuauguaucuuuuggaucaaacucucauagaagaaggaagaccucauaaagacacccagaaaguaggggcgccaaggucaaccagaagagagaaaauggccuucagccagucaaggaguagcuuacggcagcuaagaauaagacagugggagcugugcagccccagaauggauuucccaugccugguuuuaaucauggcuaugguagucuaugucuugguuuuaaucauggcuaugguagucuaugucuugguuuuaaucauggcuaugguagucuaugucuugguuuuaaucauggcuaugguauucugugucaaauggaaugacuaauccuaggugcuuuggaaauguuaaauuguucauaagucccuuagagcuuuguuucuccuuugaaccccauggaggguuuugggccucagaacagguauauuaaaccgucuccauuucaacugguaauugagggccucucaaagucuaccuagaagagaaugucuucuacuauagaaagaaacagaugaugcaaaauuuugauuuuuuaaccuaaaguuugguccugucuggcaaaacaauugaagaaacaugacuuuccaaucuauuuggaaggugaggguuccaaguacacccucacugugaucugaaaauugugaaaaucuguacuaaugagaagcuuaggaaucaccuagaccuggguuuaaauccuagauuugccacauuucugggguggugggguggacugacaggcccugaacagacaacgucuaugagcccuaguguuuucauguguaaaacaggacuauacugccucacaaagauuugaugacaauuaaaggaaauuacagauguuaaaugcuuaacaagaaucuaguacauaguaagagcucaauguauauuaacugucauuguggugacaacaaucaugauaauuucaagcuuuuauauccaauuuuguguuggaugcuucauuagguaggaaugaacaucucaaacauauuuguccaucuaucauuauuucuauauauguuguucacccaaccaucauaucaaauuccuguuccuuuaguuuggagguccuuauuuuuugggggggggggucaugaaccuccuugaaaaucugaugaaguaugggugaugugcuccucucugaagcuccaauagcaccucacagguuccaccuuaccccacuguaccuccauccgccugcacugugacugcuuguuuauuccuuuuuccaggcucugggaggucagggaguguaucugcccagaucaucauuuucuuuaccuugcuuagcucugugccuggcagagaauagguguuugauauucacugaaugcauaaaugaaaauugcaaagccuucccccugaccccuuaaaaauucaccuacacucaaguuuuugcaucuaauuucagacccugucugaggacuccagguaagaagcuacuauuaaugacuaccuauuguaggucauuaaaaaugcaguagggaaauuuucaggccaaauaaugaagcagccuguuuuucaggccaacuaaugaaacagccuuaccacaggccagaaagaaaguguagaucgucuucucaagagaggaaggacaaagucagaauugacacuguguucgugaugaaggcaaccuuuguccaggucccuuguuuuaccaaagacgacaagaggagccagccuugcccaaggucacauggccacugguaaagagacuugagccuccuggcuuccagaccagugcucaucaaacucaaaccuucccccucuuccccucucgcacugccuccccagaagcucaguccuugcgagaauucaaugaaaauuuccuuccaagcaugguccgaagacaauguaaggaaaugcaggauuuacaugacuuuggucaagugaggggacaggacuuuaaaccaaagaguugauuuaaaucuuuuaaaaccuacagagugaagggcuugccucauugccucauuugaaagaugaaaucauucugucuuuauuuuucauugaugggaguuuggcuuuggagggaaaaagaucuggcacuugagagcuggcccagugaggauagggguugucauuuucuccucacugaggcuuagcaaugccuuuagcuaaggcccggcccauguauccccaaaagugacaaagguacaguauuucacacaggaacacuuggggagcauuuuuccaugggacacggcgugagaauccauuaaucucacugccacauacucaggcuauuucucacaagcuuagccagacauuuggguuuuuuuaaaccaugaaaaaaagagccuuauccuccucaucauaccagauugcuccagcggauaaacaucagacaugguuuuuagagaaauaucacacgaucugagaacaucugcaauucucuagaacguaccguugucagaacuugacuuaaacgaaacaacagacaucagacuuucuuucagacguuuugcacugaagcuuuccauuauagcacgaaugccuccuucugaaauggcaccaauugaaaacgcaccaggacacgaacauuaccacaacucaaauucagauacucgcauguuauuaacaauggugcuaauuccuguuucagagaugaaacuuacagaggagauaccaguggguuuuccuccauugcuacuuuucauuugcuauggaggccacaaauucaagagaucacucauucuuaaauuaacaaaaguagccaccaccuggcaaaacaucaggcccugugcaggcgcuuuauaugcaccuuuauauguaucgccucuuuuaagccccucagugguccucggagacagcugcuguuaucuuccaugucauacaucagggcacugaggcccagagcccaagugauauuguaacagcacuuccugugugcuaagcacucuccaugcauuuuauuuauaguaucucauuaaaucucaccaaauccuuugaggucagagccaucauaagcuccaaucuacagcugaagaaacugagacagcucucaaagcuaggccuaguuuccuccaaaguucagucacauuuguuccauuugacaguaugagggaaggccuuuuuuugguuaagcguauagacucugcaguuaaaccuccuggacccuacccuuguuagcaguaugaucuuagauaagcacgaguuaacuuuaccauggcucaguuuccucaccuguaaaguggcauaauaauggaacuuacuuacuuaccucaaaggaugaagagaaugcaaugcaaagcauguagcauggggucuagcauacaguaaguucucaggcagucauuagcaguauuaaaaauaauacuggccaguggcucaugccuguaaucccagcaccgugggaggcugaggcaugcggauuacuugaggucaggaguucgagaccagccuggccaacauggugaaaccccgucucuauuaaaaauauaaaaauuagcuggccauuggugggugccuguagucccagcuacuagggaggcugaggcaggagaacugcuugaacccuggaggcagaggcugcagugagccgagauugugccauugcacuccagccugggugacagagcaagacccugucucgaaaaaaaaaaaauaccauaacauuuuuucuucuuauuuuuauauaaaauaaggcuguauucauaaaggauacagggauuaaagcaaaccaaaagagaagagugaggguaaguuuaauugugugauaaggauuuagguaagacagccuaggcaacauggcaaaaccucaucucuaccaaaaaauacaaaaaugagcugggcacgguggugggugccuauagucccagcuacucaggagacugaggugagaggaucaucacuugagcccaggaguuugaggcugcggugagcuaugauugcaccacuguacuccagccugggcaacagagcaaaacccggucucaaaaaacaaaaaauacaauuaauaaauaaaaaguaaaaaauucaggauuaagguaagaggugccccgcugugcagcacagagcuccaucggauuggaaaaaguggcugccaggggaugccuccccuuauuaguucagacaggcuuauguaccggucuccuugcgggaaguccugugcugcucagcguugauggaacacacaaugaacuuuuccuugcuuuugucucuaccagaacucgacugagugcgcccugcugugugguuuuaucccuggucuugggauagguuuccauggcuauaggaaagagguggagacagggaaugccaccuucugaguucaucagaauagaagugugcaccugcagcaagacaugauucucccuaauuugcuuucaagacaaaacugugucuacugauuggguagauauuguugaggcaagaugcgguaugucuagccuguguccaacacauauggcguuaggucauuccuuucaucuccucuaauggugcccaguacaaugagaaugaaaugcaaaucccuuacccuggcucugggccacccagacccauuugcgggucucuagcaacacccccagacccucuaucucucccuuggucacaagggcuuccuuuccucuuuaagguccuuacaccagcuccuccuuugccugugacacucuguuuccagguuuuucauguacguucuucuucuguugggucucuccucgaaugucagucuucaaagaggccuuccuugugacuccauaaaccacugcagcucucugauucacuuccuuacucugucuuguuuuucugucugcuaaaauagaacugauaauccucguccuccuucucucacagcauuucuuugaugagcaaaugagauucauguguaugugucuaugaagaugcuuuuauaacugugaguaaucaccagggaugcaaaggaggguucaauuucuaugucaguucacacuggguggguuuuucuggguuuuucugaagcacagcccugagaugaauuccaagacugcaguauucucagugacaaagggugcagcaaucccuuaaugaugucugacuugggagagggaauuagaggcgugggugucacauauuugcuaucugugccaaaaauaaagucauauauuaauagaagcccaaaaucaauaauuuacaaauagcuuccucaaacuuucaaugguacuucuggaaaagugagauuugaaauuuuacucuccuuccuuugcacucuaaaaauuuauuccccugauauuacuuuuauauuaaaaacuaauuagaaaacuucauagguuucaucauauauuuaacaucauugcuaaaguucuaacacuauuuuuggaaaucaucaaaagagaaaaguguaagacagacaaggaaaacagagaaguuuuccauguuuaauauuauaagucaccacaaaguauuauuuugauauuacaauuuuuuuuuuuuuuugagacagagucuugcucuguagcccaagcuggagugcaguggcacaaucucuacucacuguaaccuccgccuccuggguucaagcaauucucaugccucagcuucccaaauagcucagauuacgagugcccaccaccaugccuggcuaauuuuuguauuuuuaguagagaugggguuuuacuauguuggccaggcuggucucaaacuccugacuucaugugauccgaccaccuuggccucccaaaauguugggauuacagguuugagccacugugccuggucuuaacaaauuuuaaaaauagugauaggcaaauacaucuaaugaaacuagaguauuauuugucauuucuuuggaugaaccaaugcauguaaggaggauguaguucuggguuucuccuguuucaucacacaguaacccaccguggcucucuccuccaugccgauauuauauaauugucaaggcauugagacagauuuuaauucauuuaauaauuaggucaauaaaaaccauuauugcugacagugccauuaaaaguccauaaugucaccuucaugggggaaaaacuaauauaguuccguuggauuuuuuccgugaaauuaauaugauagcauuucagugggugucuuaaauagcuuaaauagacauuuuuauuaacagaacuaaucauagaauuaaaacaaaugaaaaucguuacauuugcugugaugagguauccauguucacaggauuuuaucagccucauuccugugaagaaccugaacauuuacuaccacaagaacaguauauucaacuugccuggagcacugcuuagggucccaaagaggcugcccauuuguguuuuggugauuuccucuucaacaccauggcuccauuucucagagccacccuacugggaaacaugccagaaccauaaccuccuaaaccaaaaaccuucuucauguccccuuuuuggcugguaguauuucaucuagaauaucuaagacaguauuucagcucagaaaaauacuaaagcagaagggguugcaccuacgccgcccagcaauguuuuaucaccucuccuuccucagcuuaaucacuaacgguagauagaucuuaacaugaacuaagguaaacucuaguauagugcuauacgauuuagguaaauucucacuagaagagcaagauagcaggaggaaagaagauuauaccaagaguuuccucucagacacaugaaugcuaugguucugugaguuauucaaaugugcaagucacuguguauggcugcaucauugcugcuuggguaccuacaacucuucauaaucagauauaccaggauucacaagaauucagggguggucaauauugaucaaaggccaaggccacagauguagcuagcacauuauacacugacagaacgcuugcuaauguacacaaagaaguagcggcuggagccugugaggcugugcaaacaguauaggcuuuggguuugggaagacccgcauuagaucuuaguaacuugguucccaacaggaugaccaugggcagguuagcucccuucaguuuucaguuucagcaucuggaaaauggauugaugaaguccacaguuguuugacucugugguuuuuaggaugguucgaaagagauuucagaugaaacauaucuaacaaacacuguggcuggcagagaguaagggcuauucuucagaggaaagagucaucucaguuggcauuggacguauuuaaaauaugauugggaggguagccucugcuaaccuccagccacguuggugaacucucagaaagccuugugcaugcccagacaugcugaaucuaaacaaaccaaagggaagcugcacuucuccacugauuacucccuuuccugcccuuuggaagauucuagaaacacuaggaaaucuacuuaaauauuuuuuaacucaguuuuaaacaacaucucucagaaaauaccauucuuaguagaauaaaccuucuuugaaggcguacauagacuuacauaugugauauuugcaaccaaucagcauuuugggugacugggcaggucuugggaagugggaggcacaguaaaaaugaaagacuuuguuugaccucccugaguucuaagcaagauguggugccugagaaagcuuaugcagguccuacugggcaagacuauaaagccaagcgcaacagagaaaaaaauaccuuagggcacggacguuugguuucucaaggccugugauggggaaggcccugaaacuccccuaacagggauggaagaaaucuguggauauuuuguucaugagaaguagaggaaaaggggaggggagaaaguggaaacagcaacgugucuggaaaccagcuggcaccugugccuugaaguaaauaaauuggguaaagaaauaugauagcuagauaguccuagaaaugaacauccugaaaucaucccauaaacuuuauuuuggagggggauagggaagagaagagacccuuucuuccauuuauuucauuuaguuggugauauuauugggcauuaacuugggauucacuauuccuguggcaaguacuuaccuuugcugaaauuaccaaauauucucugaaacagacucuuaucagaaaauugaucuauaauacauaacggugucuugcaagaaaaaagucccuugugggggcgauuuuuuaaaaugguucacugcaggccuuucacaaucacauggaaauuuggagauugcucagauauugugggaagaggagaaagggaacaaagagagacauaauacuugagacuuuacaggcuccuaccauuuucuagucuauucgacaagagcagcagagguucauaucaaggaagugaaaaccauucaggaauacaaaaauuguuuacaaaaaacagccugugcuuugcauucuuuucuguuacuucgacaauugccaagaaguguaacugugcuugcucgguauuauuuaaauuaaauuaucaaaugcaaaugcuaaauaugaaccucucagcaaagcacuggguuauaaugccauguccucuauucagacuaaaagcugauuacugguucuggaguuacaaacaugucagacaauaauuuaauugcuuugcagguagaggaauaugcagcguucuuguucucauucuggaacucaacacgacucuuuaauacaacauaaugaucauaaacacacacaaagucuucgccucacaccugcuuuaugguaaaaagaagcuauugcaaauuucugcaaagcucaaagaaugaggcagugccagauuuuuuaaucacuaagcaaaacagguuucucaccaaguggcccgggcuuuuacuccugguucagagaguuacaagacacauuuucaaaaugaguuuaaagcuauaaugaauuucaggugcaaaggaccaccgucuaacagcuaauuugcuuccugucuucaacugagcuguuaaccauaggcagccagcaugugcaccccuuucuugggccacuggugaagacagaugucacaaucaauacucauuaacucugggaucaguguguaucuuccucaggaagagaaagggggucuuaaauguaacuaggaggacuuuguaagcauuuucugagcauugcaguggcugaguguuaaaccacaacaggacaggagugcaggagggggagagaagaaaggggagggugagagagggaagggaagaagaaaagaggccacauuucgugaucuccucugucucuggagcucuuuuuuaucagcucgugaaauucccaaggauccugaucaucucccccuucccagcucaucgcaaagaguuguuguacauuucuuugcaauuggguagggaaagaucuugaaagguggauccaacuugaacauuagacuuuugugaaacaugauacagaaauuguaguguugcagagcuguaccugcucauuugcugacuaugaugacccaacauuuauugagcacuguaugccaggccugugcuaccucaaugcuucaccuggaguaccuuauuuaauccuuauggcaaucccauaacccuauaggaagcagucauccuuuuauauaugaugcacauaaaacugucugaaaugauuugcaccuaauguaaugaugguaggcuuaaaugcuuucauuuuuguacuuugcuguguuuuaacaaguuuuugugauggauuuguucuuguuuuugcaaaaucaagaauaacuuaaaaauaaaagacuggaugccaauacaaaucucccaagauguuaaccuugguuaauucugggugaugagaacguagaugauuguuauuuccuucuuuguacauuucugaauguuuaguuucccuauauaagugaaaauauagacuuuaaaaaagaaaaacaaaagaagaagcccuucacuagugccacagugugaggagaaugaagccuaagccuaaauuuuauuaaacagcagggugacccaaugcucuguaucaaugcuagauacaccaccaagcauucgcuacgcauaaucccaccagcuccuuccaacaacucugggagguaggugucaccacccucacuguacagacaagcagagugagguuucgaguggguaaaggaccagcacuugaggucacucggguaucuggccuccacuuacccuucuggccugaggcuccauggcaugcccucugaccuuugcucauacccuggucuccagccgccugaguccuugucuuuuucugaccacaaccucaaagucccuagguccauaccuaauguucacacucucucauuuacuuggaaagccauuuuccagacuacacccauucuuccaaacguguaucaaauacucccccuuccacaaagauucucugagucaccucagccuuaguguauucaccuugguguaguauaugccacaggcugccacauggcaggugccaggccagcucaggcacacugaaugcucuguauggcuuaugcaguguuuaaaagauuuaaaaaauaauuagacuuguauuaaaaaaaaaaaauguguaccuaguggcucagguuccccuacccugcuuggcaauaauuaacuguagccaaagcgucugcccuauucagacagaagccugugugugcucuaguucccaacaguuuccuuuuaauacuccuucuuauccuuggcccauuucucuuaauucauuguugucaggccucugagcccaagcuaauccaucauauccccugugaccugcacguauacauccagauggccugaaguaacugaagaaucacaaaagaagugaaaauggccuguuccugccuuaacugaugacauuaccuugugaaauuccuucuccugacucagaagcucccccacugagcaccuugugacccccgccccugcccaccagagaacaacccccuuugacugugauuuuccauuacccacccaaauccuguaaaacggccccaccccaucugccuuccuugacucucuuuuuggacucagcccgccugcacccaggugauuaaaaagcuuuauugcucacauaaagccuauugguuugguggucucuucacauggacacgcgugacaauuguuuuaugugcccagcacaucacagguguucauugagggccagaaacuagucacuucacuacugcuauaauccuagggagagagaaugguggucugaauuacaagcagugagaauagagaaaagauauuccaaagaaucuguccucugaaauuaggggcuuuauuuauuuauuggaacacuuucuaucuugaacuguagugauacggguauacaucuuaccuauucuacuugacugacugcaucccccugaagacacgugucaggugccaugccugcccugugauauccccagcgcugccuagcugaauggugcauacauaccaggcacgggaugaauguugguugacugaucauucauuuuaauccugaaaccuggcguuuauguuuccgcuacauuuaaaagcuggcaaaacacaucuccuucccucccacucacucaauuaaaagcucaguacauuaauuaucugaauuaaagucaagagucugagauaucccucccaauuuauaaagacagggacgagguaaauuuuuuucccaaguuguagggacagaaagaagacuaaagaaugaggaccuuacaggcgagcacggggccagcgaaggauucuguuuuaagaucaucuccuggugcucauuagugcuguugcucuucaccugggugagcgggcuugcuuccauggagaagagaccuccgccagcuccugcugcauuaacggucuccgaaugugauuuggcggcagcacgggucucauuagagugggggaugugcaaaggcagaaggccucacuuugagaaaacacuuugcguaugaacaaagguggaaagaugucaggcuuuuaaagggaaccugcaucucgcuccucacuuagcaaagucaucaggagauucugcuaaguaaagaaguucuggaccuuuucaagcuauuaaaggugacccaacaaagcaaaauggcuuuguuccccaaauuucuuuuugucaguugccuugaacaaccaagccugaacgaaacagccuaagggagauugccagguaauaauaaaucccuauuugcuucaguaaaggacaucucaaagaagggauaaaauaaaaaauaucagaauuaaagaggcacaaaaaacccugaacauccggggcauguagaugcucgguagcaaugaauguauuagguuggugcaaaaguaauagcgauuuucgccauuacuuucaauggcaaaaacugcaauuacuucugcgccaacauaauacuuggggccugguucucagggguagggcuuccagcauuuuaaguagcagucugccaucaggcaagaugugcauauucaucauugauguggcuugaucaugacauauucuguuuucuugagcaaggaaagaacucagcaacaucucgcagagcgaccaucagguuauguccuugucucugguucauuugaggagaguaggaaauuaugaaacccacaagaagaguuuauggcuccuccucacacuccuacacuuaaauccaggaagagacugccaggcgucggucaaguuugaagauauuuaauggacuaugcauuaucuacacugccccauuucaaggucaauagcugucugucucuuuaucccauaaggcuagguuuucccuugaagaagaagguacugcuguuacugguagagggugccuauguucuuggcaucuugaagaacuggacaaaaugcgcaaacaaagcaaggaaagaaugaagcaacaaaagcagagauuuauugaaaaugaaaguacacuccacagggugggagugggcccgagcauaggggcucaagggccccguuacagaauuuuugggggucuaaauagccucuagagguuuccauugguuacuggguguaugcccuauguaaaugaagaggaugaaguaaaguuaugaagucauuuacuuggcguaugcccuauggagaggauagccccugucauagcucaagugugaaucagccuuauguucccugccugcagacccuauuuuccugucucacugccacuugggucuccugagaaggcccuuugcugacucugccuucugggaacuggcaagucaggugaucucuggagcugccccacgguagaaagugcagagcgaacagccgaggacugucaugcacuaagcauuuggggaaaccacccuuucucccagguuggugggcucucucgagacagguaccuguacuuacuugguauuggagugcucuaaucuuagagucuaguguaggcuucaggggagagggagcuaaggcggccauucuguuugcuuuguuuccaggccuuggguuugucucuagagggagaaagaguccuccucugucuagcuugaagcagugggaggcuguauggggcacggaauaagaaacucaaagugucccuuuccggcguguccugcucugugggcacuuacuccuucagagcuugugaagacagagauaaaggucagucaagcccaggaccagguguugggauuguucuuauccccaaguuuucuaauuucacuaggaauauuaaaggcaauuuaaugcaaucugcauuuuaaagauaaaagugauggaguucaggacaugcuuccccaaaauauggcaccuuggcauagugaauauuuucagcuaaaggaaugugagaagguaacagaaguaggaaggucuuucugacuguucgcucccuguuuguccuugcggcagguuagaagacccucauuggagaggugcccugaagaaaggaauguucuuaucucugaagacaaagggucacagagaagaaucugaacaaaacucugugcuaaguguccccaguuuauugccauuagacuacauccuuuuugaccuagaagcuccaccuucaaaguuuuuagguagccaugaccagucuaacuguagaaauggaauggaacauuggaaagacuguaaacuuggagcucuaagaacuagguucaguuuccuccacuuaucagcuuuguggccagagucaaauuuugccucucugugccucaguuaccuuacuacaaaauuaggacuauucugaggcuucaaugaggguuaaccauguacugagcaugaugcuggguaugcuacucuguagacacuacuucucuccccucuccucuuuggugacuuuuaaagaucauggggaagcugggcgcgguggcucaugccuguaaucacagcacuuugagaggccgaggcgggcagaucacgaggucaggagaucgagaccguccuggcuaacacggugaaaccccgucucugcuaaaaauacaaaaauuuagccgggugugguggcgggcgccuguagucccagcuacuccggaggcugaggcaggagaauggcgugaacccaggaggcggagcuugcagugagccgagaucacaccgcugcacuccagccugggagacagcgagaaucugucucaaaaaaaaaaaaaagaucauggggaauaaucuacaugaaaauggauguuguaaagccuaggacauuacauguguuauguggcaagagggguaaaugguagaguuaauuuuuaggccucucuuaagccucacaaugguucuaauuuuguaauaagguaacugaggcacagggagacaaacacuugacuauggccacaaagcugauaaauggaagaaacugaaccuaguucuuagagcucuaaauuuauacucuuuccaaugcuucguuccacuucuacaguuagacuggucauggcuaccucaaaaccuugaauguggagcuucuagauccccagcggcaauucccaucaaggagaauuuugccugcuugacucucuccuaccauccacagucauuguuacugcaagugaguuaaagcaguugagcaaaucauauauauauauauggguacaggguuuauauauauauauacauauauauguauacauauauauguguauauauauguauauacauauguauauauguguauauacauauguauauacauauauauguguaucuccccaguguaugggguuagaaugcagcuguggaacauggggguguccucuuagugacucaaaccaaauuaucacuggagaaacaaugagaacaacaaaaucaaaugcaaaccaccaaaauacaaguguaguccucauaucaagaaaaagauaagggaaagaucuucagaaagccccucuauuaauuauuuagucucagcucagacaguuccagaaacagaacagugauaaacaggaccauugccauacuucuggagaugaggaaaacaccagaauagaaaucuucagugggcuaguaugggacucuggcugugaucccucucuuauccaaaauucugcuaagggacuugccugagaacacacacagauuucucuaugagagcaaaauaagagauauauacauagguuagauaaugcaaugaagaucaaaaauuacauuuuggaauguuguauuccaucuuauggggcagcauuuaaucaggauccuagugcaaucuuccaucuggagccccaaauccaaugucacacauugcggguuggggugcggaagaucuagcuuaacccuagugaggaagauguccugccugguuaacuuccagcucaguggguauuaguagcauagcagggaugccaaacaggaacacacuauggggugucaucagcaagaauaagguccagagcuaugugguggguuagaagucugaaagucagaaaaggcuuuggaagcccucuugucuuccauuuuacaggugaagaaacugaggcugaaugauuuguuuaccauucagguuacacagagaguuaaagucaggacccagaccuuccaagucccaggccaaagcaggugauuauucuguagcaugugcuguccauauuccucggcagcaguauaucccagcagcagcauaauuucagaaaaggaaugagaaaaggggauauauccauuggaggguacccaggaucagggguuucaaagaugcacaauucugggacacagggugaguagucaugagaaguggagauauggggugggggugcgugaugguuuccgcaaacacaggagaaagaaacauuaacaacgugggccguggaaaaggaauuaaacuuguuugguuucauggagcagguagauaacuaguggguggaucggaagaaagcaauuuauaugucuguggugaaacauacacacauaacguaaaauccaccauuuagccauuuuaaaguauaucguucaguggcauuuagugcauucaacaguguugugcaaacaucaccgcuaccuaguuucagaacauuuucauuaucccgaagggaaacccugcacccauuaagugguaacuccccuuuccccuacccccccagucccuggcaaccacuuaucugcuuucugucucuaucaauuugccuauuauggauauuucauagaaauggaaucauacaauauguggccuuuagugucuggggaagcagaugcuuuuuuaacauaaugaaaauugcaggaugaagagugugguuugaaagggggcuugguaaugacuuaggaugcuugaauucaggccaaggcuagaaguccacaugguagggauauugcggaggggccucugaacaagaagugggcuugaaaggcuggcucuucagggcuuuucugaccuggagauggaggcccucucugacaagccccugggacuaucucccuuuuuccccacaaccccaccucugccagugaugaccagucucuacccuacgguaaaacucagguccaaccacguccacuccuuuugcuaauuuccccucuuuucauucuccucccaccuccgggucuguugacacuugcuugccaauuugccugacacacugcagacaaucuucucacucaagcauguuugaccugaacauacagcuuucugcugagcugaucuggaguuucaguuggccguuugggcagccagacaugaauuaagaacagggauaaacaaggauggcuugagcuuuaacuacaccgauuuggcccaauaggcucggggauaaucuauaagaccuaacagcugagggcaauaaaauuagcuacaaagggacugcgggguagaaacaaugucuucugauacuucacacaacacacacucacacacaaaagacaccaaaaacucuccgacagaagccuuacaacagcuuagaggagaggcauugugcuugaaaaacuauauuuuaaaaagcagagaggaaacccacggugacugaaguaucauuuucccgguggugaucauggauuucaucccaagaccuggaaaucauguuagaacuacaguaucagcccagcuuugugucuagggcuuaaacuugaaauguuguuuacauaaauaguuaaggaacacauacuggguugaagagugugcucuccaaaaaugcauguccaccuagagccucagaaugugaccuuauuuggaaagaggucuugggagauguuauuagucaagaugaggucauacuggauuagaaugggcccuaaauuccgugacugguguccuuauaaggacaucaacggagggcagaaggccaugugaagacaaagcggacacuagagugaaucugcuguaagccaaagaaggccaaagauugcggaaaggaaggauucuuccccagaacuuucagagagagcaugauucugcugacacuuuaguuuuggacauccagcaucuugaacugggagggaaugcauuuugguuguuuuaugccacucauguugugccaauuuguuacagcaguccuaggaagcuaacauaauacacucccaauucccucuucuuuuauacaauuguacaacccuauuugaaacauggaaaaggcucuuaguucucacaaaaaaaucucauuauauuuggaguucaacuucugaacacggguuuagaaacaaauagggucugauuucacugauuuucaaagggcuuucuuuguaaugacugggguuuguuuuauuuguuugcuuguuuccaggagaagagaagauuggccucagacacuuccgucuucagaccugugccucuccuuugaggaucccuuccccgaagcugccaaggagaaccuucccucacauuguuccuccuuuguuccccgcucuccuuuuccaggcugagagaccuggggccuuggaagcaagcacacgcuggcugagcugugauuccuccauguugauuauaauuuuuaucacauuauaugggaucccucuggugguuacuaggggauacgucaguuuugagagauuggaaccuaaccaaagaagcuucaaaucuagaggauaaggggacucagaguuuacaagucacagcaagcagaugcuggucugcuuuaggugccucuuacggggauugugagagggcuccuggggccugaggagggucuucugaggugugaaaggcuguacugguggucccugaaagccaucgucauuugugugaggaggaguacuggaggagcugucuuaccacaugaaaaacagcauggagcaucccagccacaucaaaggcacgguuugagccuugggcuguagaggcucagagagagugacaaauaagacccuggugagagaccaauggggacaguauuuccagacuuuggcaugaaacagauuucugagcaccucaugaaaugucugcaagggcagcuccucagagugacccucccaaaucaaucaaagcuggcccccuaucuuaauuaugacuuacaaauagaagcaugcaccuggcuggaugcaguuugccacaugguuuacaauagcgguagaauaagaaauaacuuaccaaacgaguacauuuucuuggcuggcuggggcacucagaguugacacugguaaggcuccauuaaaaugccuuuauguucugauauacacagauguguuaauuuauagcauauucaucagaagacauaaauuaauugcucucugaugaauuuuauaacaccuccuuuaugccucuccacccucccccuccaaaguacacugaaaaggucaacagcacuaucgaaugcagcacacuucaacuuccuuccaagcuuauaauuaaagcuaauuaguagcuuugguaauuagcgcauguaagcuuucugcuuucugaauuaauaagacugagucagguuuugagccaaguagacuuuucacucacugguucugauucuugaacuguguuuggcugguuaauuuaaaacaugucuguugaaaguggaauacuagaaagaaaacauacuugugauggucugcucucaagccagugugauuuaugaacaggccaaaguggaacuguugucacaagagaaaaucagaaugcucuggguuuccaauaacugaccagucucaaccucucagugugaaaugaguugugcccaguuacuaugucacauggacacaacacaacgucaaggaugcccuugcacacuuaugucacccucucauaacacaucuguacuaagcacaucaaauccucuuuauuuuaggagaaugcagaggcaauggcaguggggugccaagauauaacuaacugcucauuuugauucaaauaaaaaucaaagaggagaaaaaucauuagucaaaucagcuucugcuuuuguguagacaaagugauucuccaaauagcuucguguuucuuuuuuuagccagcaugugggcauccugcaugcccagacagaauuaaaagugcauguuuuaaaaucaagaaaucaaaucuauauucuauuaaaagaaaaaaugugauuuguuuucagacuuuagaaacaguugggauaaaaauuuccacgggugagcucauuugcuuuuucuuuucccauacuaaucucagaaaauuuauuuuuguuuuuuaaagaaagaaaggaaggaagaaaaagaaaaucacuuagugauuuacuggacuccuuauaaguccaggacaaugguggggguugcucacagcgcuaguaauuuugauacauaaagaaaaggaaacagucacugcugcagagagaggaauauauaagacagcucugggucacuagaguaaaugguuuucauuuuaauggcgcacuuacugccacugugauagccacauuuggaucuguaaggggcaguuaauacuauucaagagcaaggcacauuuggucuuguggauggcugugauugugaaggugacaagggguuauggauucccacagccucacaggcccagcugaauaggaagccuugugcccccuuggcagcucauccuaccccguggcagcucauccuaccuagguggauacacuccaguaagaucuauacacagugguucucaacugggggagauucugcccccaggggauacuuggcaauguuuggcacaguuuugauugucauaacuggugggagaggguagaugcuacuggcaucuagugagcagagacuaggaauguugccaaacgaucagccaugcacacgacagucacuccucaacaaagaugaucuggccccacaggauacuagugccaaugucauggaacccugauacagaaggucuaaacagggucugaggcccuccuugucuuugaggaagaguuaaauguuagcuuuccagauugacucuggacugaucuuggccuuauacaagucagaaagaagugagugauagcucacccacaggggcuagaucugagucagacuggaagaagucggcacacucaggguaacggcagcugccuaaaagccaagcgcugggcauuuuuauguugcagcuaaggccagcaugcugcauuauggaugagcucaugugccauggcaaacaguuuaagaacgaugcuuauauuuaaugaauccuaaaugguuuauuacagagggucaaguuucugcuuccugugggaauuugacauuuaugaaaaugcacgcacauuaauuauucaguggagacguccuuccuauggaaauucacuuuccuguacacucgacaggacuacauucccugucugcaugggcuacuuuguuguuaauccucuaagcauuaauuaaauaaaauuugcaaccgagccaggaugcaucuacccucaaauguuaugcaaaagacaguuaaaugcuguuugauuuuuccugcuaguagccaaucauuacccauagcuauuuauguucuuccuuuuguucuuuaaagcauaaaccugguaucucuucccacugagaagaaaacuacgcucaguaauuaaauuacaccacauuaaacuuacuuaaguucaccagcagggaaaauuccgugccccuggguuuaacaguaaguccuaaucacgcuugcaagccauaucuuuucugugaguuguuauaguuuucauuccuggaauuccauuaaaaaugguaaugucauuacuccuguuacugcucaaaaccaacagcauaauccugaauuuuaauuaguaauuacaauuaaucauuauuucauuaaugaaauguuuaguugguaauugucuuugagcaccuuacucccuaggcuuauaagcauuucauaacaucuaauuuguugccuguuucugaugaaguggcacugucaaccuuauuuuauguuaacacuuugauggggcucugcaucccaggccugcaccaccggcugcauauuuacaccuuggaaauguguggcuucuggcucucgauaagguucgccugaggacguacccucgcauucuuuccugccagcuuaagaaggcgacuguuugugcucccagagagcacagcaugugaagagagaaauaauaauuccuggaacgcuuacuuaauaauaaaucugggauccaaauucauggauuuuugagaggggauagagcaaggauuuggagguagucuuuggaacaggaagguugauuuuaaaagagcuuaaagaauuaagaauaagcugggaggguugucaagaauuuaacacgaggcaagauuuuuguugauccuuuugcaauagcaaagauauucuuauuuauuaggaugguuuuuuaggggugaggggaagcuugucuuccccaccaaaaggucagggacccaaguaugccuugcacacaguuguauuccuagcuccuggugcgggguugggcauacacgugacucaauaaacagcuagauaagucauuguuccugcauggccuaugguuaggcuaugaaggggguaacugagguacaagaguuaauggugguuuggugaugguagcagggugugggaugcuaggagaugccaaaucagugggcuggugugcucacaaaugaccugaugucauaguugucugucacugacaauucuaaaaggacggauucauccgacugcccucuauguaaaaaaauuuacacauacacacacacacacacacacacacacacacccgacggugaauuauucagggaggagaaagccugcuauccuuggcaaauuaaacaaggaggauuugagcaaagaaaagaugugcugcuguuauuucaaggaaguauucacagcuucagaauuaaaacugagauggaacaacaucagacuuguuggaaaaugcuccgcgucugugguguauuucagacaaguuagucagaaaauucaaaauaucuggaagaaauaaaugacggccaacaguuugguguuggccaccaggugccagagcacguauggucuuggccuaaggugagugaaagacagguuucugggucaagacagguguuuccaaauggcaauuuuugaggcugcugacauuuuacaaaauaaaagaaugugauaaagcuuaaguuuuugguuguauuuuauaaaugucuauauuuaagaaguucaugcuuuagcacacauaagacauucaacaagucauuuggaaauaacaucaaaugucgaaauuugagacccuuuauaauuaggaguggaggaccaaguggacuccaucccuuguccccacauagguccuauuucuuuccuaggccacacagcuuuuaaacauaauauuucuccccuauuauccuucaguauuuauagagcauccggccugugcuaggagcuugaaaagacagucccucucucauggagcucccaauauagaggcccuuucccuuuggacuuucuucuacuggaaauugccuuuucuuguguaguucccuuugcugacucugcuuguccuccuguucucacaaaggcuaccaugcagugggggaauaaauaugaaaaaaaauauaagaucauugcacugcagagugaaggagcaaaucccuuaacagucaugaguacacauuccagcucaugagcauaaagccacacuauucauagaaaugggugauacugauuguacacuuaccaugugugaauauugugcuuaguauaucacauggauuacaucacuucaccugcuucggagaaccuggauugagcauaauggaaauuaagaguuggcccaucccuagauccacaucuguuaccugcuuugcuggcugccugggaaugaggucuugucugucuguuuuuuguuuuuuuaacuucagcuuuggccuggagcugcagcccaggccacuauggaaggaaagggaauguagccuuuauaaaaucaucuauagccuggugggaaugucaacuaguacaaccacuauggaaaacaguguggagauuccuuaaauaacuaaaaggggaauuaccauuugauccagcaaucccacugcuggguaucuaccuagaggaaaagaugucauuauaugaaaaaaaauacuugcacacacauguuuauagcagaauaauucgcaauugcaaaaauguggaaucaacccaaaugucuaucagucaauaaguggauaaagaaauugugguauauauauauacaauggacuacuacucagccauaaaaaggaaugaaugaauuaauggcauucgcagcaaccuggaugagauuggagacuauuguucuaagugaaguaacucaggaaugaaaaaccgaacacuguauguccucacuuauaagugggagcuaagcuaugaagacacaaaggcauaaaaaugacacaguggacucuggggacucaagggaaaagagugggaggggggugagggaugaaagacuacacaucggguacaguguacacuacuuggguggugugugcaccaaaaucucacaaaucaccacuaaagaacuuauucauguaaccaaauacugccuguuccccaauaaccuauagaaauaaaaaaaaaauuuaaaucagcuagagccaagcagaaauaauaaggaaagugaauuccaagaaaaaguauggaauucucuucaaagcauaacagaaaauguuuugccauuucugguuguugucaugaagcaaaaaaacccacuugcccacuuggcaugucuuaccugacaaaaacuacaaagaaaggccugcccaggguuucugcaaguccuggaucugggaggcugugucucacagagagugacagccaagacugaauaacugugagacugugggcaagcuggugaguucuucugugccucaaguuccucuauguaaauggggacagugauccuugcucuugggcuuguugggaggauuccauggaaugauaugugacaccuggcacacaguguacacucaguuaucaucacauaugucaucuucaauaugauuuuugccaauuagauguggacuuuuugcguucauuaaaaauuuaaacaaacaauaauaacaacaaucacagugaguuuggguuuauaauacuguggauuucuuccuuggcaugauuggagauaaaagaaggaacauuccaugugaugcugugaggucccaggaaaggugugacagagaauccugagucaugcuuaccugucauuacuagugggaaugagagccaucugggaugaccuaagugcauauuguuugcagacagugauaggugcucagggagcaggaaaguggagcaugaacucacaauagaagguaggagcagagacaaucaaguccuauccuaccagaucaacugagagauuucuauucccuaaaguuccacagucuuuguaccccucucaccaugucaacuuugcucuccuugaacgaucuuauccccucucuugaaccauacucccuguuuuucucacauuuacguccccuucaggauauggcaaauugucuuaugcucaggaaacauuugcugaaugaauccucuggagaucuucagaaaaucagcauauuccaaaugaagugacugagacuuaagcaagagacccagggugggauggacagacucuugaauagcaucuugaucuagaccaguauaaacucgugggaccuaaacaaaaguggaccuuuguucagugaagaagauucccagggagcagguagaagcagauggagcuaacuccagauacaggcugugcucuccgcagaccccagcgucuucguagauaggagguuuagcagaugguguuuuugcauuaaguuucuaaauuaccaucuauaagauccucuguuuucuaaaaacuaguugccuuaaggcuuuaagauuuuaauguaauuuuaauguuuguguguguuguuaguguaccuguuucucagguuugcuaucccagauagguuauuugcuaagaucagaagaaaaucaauuggcaaaagaacaugcucacauguuacauguuauuaccaguuggaacaagagccaucugggauguaagacuauccaccaaacggguguguggaacugucccuuggcauugcacaggaggaccacuuuuaguaugauuuccugugcuguggcuaugacaucagggaggcugaggcaggaucacuugaggccgggaggucggggcugcauaaugaguucugaucgugccacuguacuccacccugggagacagagcaacacccgucacuaaaaaaaaaaaaaaaaaagaaagaaagaaagaaaagaaaaaagaaaaagaagaacaaauucagaagcuacaauaggaauaguucagaaaccauccuccagccuuuuaaaggcacagaagagcuuuguuucacauucguuucggcuuccaaagcaacuagucaagucaguuucaccuguuuuauucacaacaguuaucucuccaauccagauuccuucuuuaaaaaaagggaagaaaaaacauucucauauuucuuguuuugcuagcaagaaaugagcugcagaacacuuucagagauccacuagcuguuuuccuuaagcugaggcugagagcuucaggggcacuccaaagaaagaaagaaaggaaagauaaaacaaaggacgagaggcuggggggaagaaagagaggaagggagggagaaacuauagagaccacuguguggacacccacaacuucugguucugaggcuggugggaaaggaauuugcaauagaagaggaggggaacugagaggagagcacuguauuaagagcuuauaggaauucuaaaaagaaaaaaaaaggaggccuuugauccauuccaaagagggaggcagaaaacuucaaagcagaauaacaguccccugcacucugcccuacucuaaguacccggagcauucauuaugaaucagcccaccuccccucggcccacguggggcugugcaagccagacacgcaauucagacccacagcuuguucagccuccccgagaacacagcgugugcaagguuugggaauggaaauauagcagggugcccacuccuaagugggguuaauucacggauguggaaggaaucucuaccuuucgcagagacugcuagaaacaccagcuucccuucuuucucuucaaaggaagaugguguuuuuuucuccuuaauccugagucauuuacaguaagauacacguaaauaauaguccaggagguaaaaugugaucuacacagucucuaccucaaaaauaaguuuuuugggggacuuguuuaccauuccgaaugugacccggcagcccuuuacaaaaaguaacauuugcuuuuauuagauacagcagaucuauuucugugagcaccgcagauguaacugggauucauuuuuacuggaugucucagaagaccgggccgacugccagcucuccuggacacaggaaguuacagggugcggucacuucugcucacccauuucuccuucaacagcgcagaucacaugcacagaguucuuaggagacaggucuuccccaaggcaaaggcacacagaaaugcuuuccuucccagcugccccuugaugaaagaaacuaaacaccucuucagcauggauaugacacuagcccucggcuucuuauuuuuugcaaugacuacucugugucagagucaguaaaaaucgcaaugcagagaagagagauaaaaagaaacauccuggagaauucuccugguuauuuuuaaaauauugucucuguugacuugaagugguguagaaacaguuccauaugcuguguuucuuuuuuccuguugcaucuuauaguuuaaacauagaucuuuuaucggauacaacuucuguuaacaauauggccuacuggguuagcaaagaaaccguucuuuucuuacaguucuggauuuggggagguugcucacauuuaacuguggaaagcauuaugcucuuauggucuuugccaauucuuuucuguaacacaaaccuaaauuacauaccaauuucucgagguucuugccuaguuuggaccaaauuaggucccacaaauuccugaucuuagcaacugugucucucaguuauuuuccgugagacaauauguuugucuguacuucauauugcuuuguggagacaauuaccagugcuauaucccuauuuuucuuuuucuugaaaaaaaauuuaauuuuuagaaauuauuuguauaggaaaaauguuaaaauagaaauaagaauauaaccucuuugaccacccugcuccaguccugguccccucccuggagguagccguauuagcagacaggcucguguucuuccagacauuuuucuguauauuugcacacaucuaaauacauagucauaugucuuguuuuuguuguuaccaucauuauacaaauggaaucauaccauagaacagaugccucauaauuuauuuaccuauuccucuauuaauggaugcuacggucugaauguaucucuucaaaauucauguuggaacuuaagacccaaugugacaguauuaagaggagccuuuggggaagugauuaagacaugggggcucuacccucaugaauggacuuagugccuauauaaaagacacugaagcaagcacucuggucccuucucccuuccaccaugugaggacacaguguuugucucuuucuuccugugaggacacaacaagaagacuccaugccagaagcagagggcaagcccucaccagaaacccaauccgcuggcaccuugaucuuggacuucccaggcuccagaacuaugacuaauaaacuucuuuuuuaaauuacccaggcuaagguauuuuauuguagaaacaggaauggacuaagacaaugaauauauaccuugccuguuaauuugcugagaaccaagguuucauuuucaacauuuacuagcuaaucuagccuagagaaguacaaagaacccaggacuuggauuuuaguccaacaauacuacuaauguccagguaaucuucggcaaaugaucauccucuuugggccaacauauccucagcugucagaccagugggcauguacagugaacaacuuaguaccagguacuacaacaacuuacacaugccuaggccccagggcaccauggugauucugauucaaagcuagggcuaagauuggcuacccuuagcaaagaagaguuacugauguguaggugagaaaaaugucucacgauuuagaacaggaugggacaaacuacaucccaugaaccaaaucagaccugccaccuauuauuauaaauaaaguuuuauuggaacacagcaaugcucguuuguuuauauauugucuuuggcugcuuuagugcuaaaguggcagagcugaguaguuucaacagagaucucaugacucacaaagccuaacauauuugucacuggguaccuugcaaauguuugcagaccucugcuuuggaaagaucccuauggucacacagaggguggggaaggaagacaauuuagaguggugguggugaugggggucugagucagggcaagagaaaagaacaaugugcgagacacaacacaggcagaagcacagaaguugugacugacugaauggauaaaaguaugagaaacagaaguuaccaguuucauauuuccaacuuggaggcuugggugauugucauuaaccaagaugagugucaugaaaggaaagaagauguuuaugggaaggugaguaagauucgaauuagggacuuucugaauucaaagugcagauaaagguguccaggaagcaguuggaaauaugagucuaauauucaggagagagguggggcuggaggucaagcuugagcgccaccaucuuggagaugagagcagguuucaggugagcagaccagaccaaagagggaaaaacauagaggcaagauauuugaggaagaaauucugagaaaccccaacaguuaaaggacuggcaaaggaauaaaccugagaaggagcaaucagaagaguagaagaaaacaaacaugauaauauuugugaaagcagaagcaacugauguuggcuuuuauaagaggucuuuguugggcucaugucgggguaaagagugcucugaggauuuggugccucuugucaguguccugugguggcuuccauagaaaacacuccacacccauuaucugcaaggagacagcugcaguuuugccucuucaugugguuuccucaaacccacccccugggaaaugcaauaugauucucucacagagcagaugggaugcuaacuggaaucaccucugccuugcagaguucucccucaguugcuccaacagugccugguaguguaaacaagacuggcuuaccagugcagcauucaauaccagugcuuacccagcagccauucaaccaguccugcugaugccccaccaugugccagccaccaaagcaucuagugccaagauuacaacuguuuccuucugcuccugguucuuagaguuuuuuuuuaaaaaaaauauauaaaugaucugcauuuagugauauauuuauuuuuaauuuuuuuauuuccauagguuuuugggggaacaagugguauucgguuacaugagcaaguucuucaguggugauuugugagauuuuggugcacccaacaccugaacaguauacacugaacccaauuugagucuuuuaucccucacccccaccaaugcuuucccccgagucuccaaaguccauuguauuauucuuaugccuuugcauccucauagcuuagcucccacauaugacugagaacauacaauguuugguuuucuauuccugaguuacuucacuuagaauaauaguccccaguuccauccagguugcugugaaugccauuaauuuguuccuuuuuauagccaagcaguauuccauuguauacauauaccacaauuucuuuauccacuuguugacugaugggcauuugggcuguccauauuuuugcaauugugaauugugcugcuaugaacaugugugugcaaguaccuuuuuuguauaaugacuucuuuuccucuggguagauacccagcagugggacugcuggaucaaaugguaguuccauuuuuaguucuuuaaggaauuuccacacuguuuuccauagugguuauacuaguuuccauucccaucagcaguguagagguguucccuuuucacagcauccacgccaacaucuauuacuuucugauuuuuuuuuaucauggccauucuugcaggaguaagguaguaucauauugugguuuugauuugcauuucccugaucauuagugauaucgagcauuuuuucauauauuuuuugaccauuuguacauugucuguugagaauugucuauuuacauccuuagcccacuuuuugaugggauuguuuguuuuuuucuugcuaauuuauuugaguuccuuauagauucuggauguucgucuuuugucagauauauagauugucaagauuuucucacacucuguggguugucuauuuagucugcugacuguuccuuuugcuguguagaagcucuuuaguuuaauuaagucccaccuauuuaucuuuguuuuuguugcauuugcuuuuggguucuuggucauaaagucugccuaagccaaugucuagaaggguuuuuucugauauuaucuuccagaacuuuuauucuuucaggucguagauuuaaguccuugauucauguucuguugauuuuuguauaaggugagagaugaggauccaguuuuauucuccuacgugugacuugccaauuaucccagcaccauuuguugaauaggaugucuuuuccccauuucuguuuuuguuugcuuuguugaagaucaauugacuguaaguauuuggguuuauuucuugguucacuauucuguuccauuggucuaugugccuauuuuuaaccaugcuguuuuggugacuauggccuuauaguauaguucaaagucaaguaaugugaugccuccagauuuguucuuuuugcuuagucuugcuuuggcuaugugggcucuuuuugguuccauaugaauuuuagaauuguuuucucuaauucugugaagaaugauggugguauuuuuaugggaauugcauugaauuuguagacugcuuuaggcaguauggucauuuucacaauauugauucuacucaauaucccugaagaacacagaugcaaaauccuuaagaaaauacuugcuaacugaauccaacagcacaucaaaaagauaauccaccaugaucaaguggguuucauaccagggauacagggaugguuucacauacacaagucaauaaaugugauacaccacaaaaacagaauuaaaaaaaaaaucacaugaucaucucaaaagaugcagacaaagcauuugacaaaauccagcauugcuuuaugauuaaaacccucagcaaaaucggcauauaaggggcauaccucaaugucauaacagccaucuaugacaaacccacagccaacauaauacugcacagggaaaaguugaaagcauucccucugagaaacggaacaagacaaggaugcccucugucaccacuucuauucaacacaguacuggaaguccuagccagaguaaucagacaagagagagaaauaaagggcauccaaaucgguaaagaggaagucaaacugucgcuguuugcugaugauaugaucauauaccuaggaaacccuaaagacucauccaaaaagcuucagaacugauaagugaauucaacaaaguuucaagauagaaauuaacguacacaaaucaguagcucugcuauacacugacagcaaccuaguugagaaucaaaucaagagcucaaccccuuuuacaauuccugcaaaaaauaaaauacuucagaauauaccuaaccaagaggugaaagaguguacaaggaaaacuacaaaacacugcugaaagaacucuuagacuuucucuaucccuauauuuggaaagaagguuggaggagggguacagaaggacggagggagguagagagaguguuaaagaagaaggaaagggguaaaaaagaaugggaauagaggcauggacuagaaacuaauuagauggugaggcagagaccuugcauugcguaucuuacaugcacuggcuuggcagccuugagaacugauguguauauugaaagcaacagcacaugcuagguguccagcauaauaccugacauauauuaagaacucaauacaugucuguuauaauaauauuuuugaguauccagaggaacuaggccagccuuugaauugauaggcccuuugguaauuuucauacagccauguagcaaaacuuauauuaaauaaauugggggaauuucauauuauacuacauuccuuuugcauucucacuggcaggaguauuuagccuggaugaaacuugauacuucaaaaagaaucacuugcuaaagggagaagugagccccaccuucuguuaggaagauguggugaguacaucaauauuacaaagauucaguguguuaaaucaauauguucaaaguaguuuaaauguccaauacugguuuccaacuucuaacuuuucucuauccucucucucggccucuuuucaaccauuccuuccuuaauccuuccacccaucccucuccuaacccccaccauuguagacuaauuucuuuugguuaucuuucuaagccuuugcacacuuuucccuauugacgagcuuugcuguuaggauucuccagcuacuucugcaaagagguuuucaaaggacuuuugaaaaugcagcacuguguauguuuugguaaaauaaagcaaacauuuugugugguuggguuuguuguuugaaguguugcagucucccucuggggccuccuacugucuucugacuagcaccucaacagcaucccuuccugcugauuugcagaggguuugauucuuuuucaauagugcauaaugcugcugucuuauugccuguuugcuuuaguucauauuucuucuccagauggauuuucuaugaagaucaucccuauuuguuugaucuuuaauuucagaccuugucauuuucuuuucgaguaugcuuuuuuauggauguuucuuuuggcagaaccacuuccuaugagccucaguguguguuaauggcacuuucauuuauuaucauagacaauuucaauuucuagagggauaguugaguucuguugugguucaaaggagaaauaaauccucuugcaacuuuggcuauuuuauuucacuucacuuuuggccucagaggacgagagagaagcugagaacauuagccacaucuguccaugaagauuucuccaauaucaauuugcucccacaccugauguacugaauacucagaaaaaugcucaggcuauaaaaccaugucuaaggcacagacaguuuaagaucaggcuuugaaugaaggccucaguuuaucuuacacauuacugaagcccauucuauagaagacuaauaguuuccacaggugucuuggguggagaagggaaaaaagucaauggacugagauacuauuggucucaggaaucauuugcccaaucuacccuaggccaagcuuugaaggacaggccaucugaauucacugagugacugaaucccagcacaggaaauguugauauucuuauugauucuuuaauggccauuuuauauccaaccauccagccauccaucuaugcauuuauccaucauuuauaguaaugucccuaaggcugcuuucuugcuaaaaauaaggaauauugacagcugaaacucacuuuauuauucugccacaguuuuaagcaucccugcaaacacgacuucuuuaacgaucuccaguuuaauuccacaguaugguucccuaucugcauuauucucuccuacucugaucaucuuauuuauuuauuuagacccagggucucacucugacacccaggccggagugcaguggugcagucuuggcucacugcagccuuggccucuggggcucaggugauucucccaccucagccuccugaguagcugggacuacaguugcgcaccaccacgcccagcuaauuuuuuuguagagaugggguuucaccauguuggaucacccuacuuuaaaauuguaauauaguucccuuuuccagcaacuuccauuugguuuaaccuguucuuuauuuuuucuuugcacuuuucaccuccuagccuaauauauauuguacuuauuuacuauguuuacaguuuguuuauuggcugcuucaagaacauaagcuccucucaccaucuacucacuguauucuaagugugaggcauaugguggguauuugguaaguauguguaaggcuucuuggggaaaugacccuucagugccuuuauucaauacucaagaguguuucucagccccuaaccuggcauuguaggagacacaaugugcgcgagugcgcgcgagucucauacacgggagucucagcgugugucucauacaugcugcuggauguguggcaugccuggccccugcccaccaauugccaguagugaccuuaucaucaauguaacaauuaaaaacaccccaggacauuuccaaauuccucauauggcuccaguaaggcuuugcuugauaauuacugcaagucuuagaauaaaaccauuuuuuuacacuguguuuccacuuggcaaauaauuaguccaccuuauggcauccuaagggcacucucagagauaauacacuuucuuuuuuauaugccucccucaacagauuucaaaauccucucacacaauuaaagacagugauauuuaaugguaaaacucagcugucaaugaugccuucuaugucagucauuaacaagccaguaaaccaauauuuacuaagagcuuuugagccugacuucaugccaugcaguguccauuuuauagcacaaaugguaccccacccacuaaggcugugccuguguuaccugcggucagcaucucaucuaauccuuccucacauuuuagcaaaaaccaggcccugcagucaaagaacaaguuugacugauuucuuuucacuggacuggucaguuauucaaccaugauggacaaacugcugaguuaaauuggaauaacacaggccaagagaaucacauuuaaagucagagauggcaaaaauaacagacauuucuaugacagaacaucaacaaauaauuacugauugucuacuggauacaaaguacugugguauagggcaccagaaggugugguuaacaugacaucaauugucauucugcugggugacaaugaaauauguauaggaauguauacuaauauucagauaaaugcagauacugcgagcagcuaugcuaagugcuuuacaggcacauaucacuuaaucauuaacaugaauaccauagguaucccuauuuuauagaagaggaagcugaagcacagggcaguaaagggacaaggucacucagucgggaauuaguggggcaacaguuuaaauucagguuucucucaugccaaagggucuuaaccacugugugauaaaucaaauaguuuucaguugucugaaauuuucaguuuucauuuacuuugguuguguaggcacaaacacaagaagaucuacagauaauguauauuuuuuaacuuccuuuaaauuaaugcauguuggauugcucucuaccauuugccccaucuaagucuuuguaguuggaauccaucguucucugcaaauuugacauuugaucauaaauugcucaucucgagaugaauuacaacaccucacauuaaagaggcacuuagggagacauuucuauuccauuucaagagacuuauauaagaacccuuuuugaucuuuccuaaaauuaaaaugaaaagccacauuuuggcaacauuauggaauaauacaaauguucaauucuguggaaaaagguagagacaugacugaucauuugauauuuaaggcaaagaaauagugguuuuauuugauuuuucauuuugaacucugucagacugugauccuuuuuucuaucuucauaguuuuuaaaaaauaaucaucagaaacaagaaacaaagagaaagcaguaaaacacauuuucuuugccuccaggauugaagacauuuuccccuuggcauguaccuacuaaguaggaaaaccuagaaugaaaguuacuguguugcuucaguaacuucuaagaaaucaauauaauuuugguuuucugcuauaacucucaaagcauauuugauguaucucuuagucauugacaacuuucuuuauacucugaagcaaaguuaucccagccaaguguauguggcugcggaugauaaaguauggcuauuugaaguuugcuucuucuuaaagagaaaugcaaaguucccagaaagacgcuagauacaacgguucacauacacuucacaaggcacuugccuaacuucuuggaccaaauuacauuaaaucuuugagccaagaaaauuaacucaccacucauugaaaaacaguauuucagccaugucauaucuuugguuaaggcagacuuaacgggaaaaucucuuuccaauaugauaugugauuccuuuacaaguacacaguuuguuaaguuuuauacuuuuuuaagaaguagagguuuuuuguuuuuguuuuuuuaaccaaugguacucucucuguguguguguguguguguguguguguauccuaccaaauuccuuaguuaauaagcaagacaaauuuauucacagaacucauuuuguauuauguaaauuuuccaagaaaaaaaagaaaaucuuaauuuguguuucaaagccucucuaguuuaagcacaaugacuuugaagaaacaaccaaaaaaaagauaaaauguggaugcagaaugauguuuauuuuacauguauaugguacacauuggguaccaaaagaaagucaugguuaauuacaauaaucacucuaguuuggccaaauaacauggaacuaacgacaugaauuucaacuauggauaguaauauuaaguggguugaaguaaucucuacacaauuaauuuuuucuagugccuuggccucugaaaacuuaucuuuggucuauauggaucuaugugcaucuaauuaaagguucauauuugcaaugcaggguuuuaguuaagggagguuaaacaugagauuuccuuagagcgccucaguguucaugggccucuauauucucauaucucugcaccagcaguaggaggaugugagagcccagggagcccucgaacuucaaaauuagaucugugggagaaaacauguaaaucucagccagaagaaucuaugccuccuuuuucucccaugcugccuuacucauagcacugauagcaugcaugaucuguuagccuucacuauccuugcagaggaacuggauucggugguauggaaaagacauauacuauuccaugaauauccaugugcucugcuccauuuccuguucccuugcagauaagugagcauacucugaccaguucuggccaagggacucugaaugaaaaugcuaccuuaaaggccaaaguauuuaagagccagcacaugacucuccagcucucucuuauucugucucagugauacagaggcugcaggcccaggugucagaauuauacaauacagaaaauagaucucuuauaagggaguuuguaagaaaauuggcccuagagagccaccagucccuuaaaagaguuuauaugacagccugggcaacauagggagaccccauaucuacaaaaauaaaaaaaaaauuagcucgugccuauagucccaguuacuugggaggcugagguuggaggguggcuugagcucaggagguugaggcuguagugagccaugaucacaccacugcacuccagccugggugacagagacccugucucaaaaacaaagcaaaacaaaacaaccccccccucaaaaguuuacauuaguggcaaauaaacuuuguuaugcugggaagauauuaccaagaauagcuuaguuuacugugacaauuuaaaucaacugcuaagauaaccaaaguaaucagaagcuauaacaggacauaaaugcugaguacaaauauuuauuuuuguaccuccucuauuggagaaaaucuagaaaauaaauucaauauauauuccaaaggaaaaaggaggaaagucuaggaaguuuuucauuugggauaaaagccaggaauaaauauaugacuuucauuggaacauuuucaggcacucagagauucagagauauccuuaaugcuaaguagauguauaauuagcucccuguuuagggacuccaaaaugugccaugucaaaacugucuccugaaaauguugcuuugcgauuccaaaagcaaucagagguuguugaaaaaucuuugggauuuugcagugugcaguuuuccccaacaggccuaacauuaaucauuauaggaaaaacauucaaacucccccauucuuucauagucuagucuaaacauucaaugcaauaucauaauucugcagacauaaauucccucauuaucugugggccaggucaaccacagcacagccagccaccuagcagacccaugagcagggccuuuugcaaagguguagcacuggcccucaaaaagacuuacaguuaagcacuccaggaggcugcaauugugcacagcagccaaccugucuaauugggucauuuuuucacugggugauuuauauagaauguggacucaaggcugacugcucuucgaacaguaugacugcuuuugucugacuguaccaaugaagcaggaugggguugcugguauuuaagaccaggcauucuggucccaaagaaacauugcuuugggcuguaguucuguguuauugcaagaagcauaguauccgauguuaccagugugggcucaguuacuucaucuguaaaaugggaggcuauaaccccaccuaccucuuaggguucucgugaagaugugcuugagaagagcugaaacagugugccugacacagagaaagcauucaaugaaugugaaccauuuaugcuauacagcauuauuacugauaugaaguauuagugauacauuauugauauaauuaucaucaacauuaucugugaugcuggugauaugaugaugaugaugaugaugaugacaguaauaaucauuuucugagugcuugccaugugcuugccagucuacuaagugccuaauguggauuacuuagugaauccucagggcaacuauugagacuauuaucuccuuuugaugaaugaagacacugagucuuagaaagguuaagaagcuugaucaaagaaguaauaaagcugaaauagaagccaagcaguuugacuuccgagccugugcccuuaguuacuacccucuaccccagcauugacacaaacacaaccacagcuuuuauuaguuguccuuauaaugacuuagccucaugcgauaagacugucugucccagauagagccacaaguuacuuaacauaucucagugucagcagccacaaccugcuagguaacuacaacuccaaagugcccugccuccugaaugagauggaaaaucaguggaauagggaauggggguucugcuuggaaauaaccuguaaccagaccaguuaagguggaaagggguggcugugaaaaaugaaaacaauaaaacaaaacaaaaugccaaaaagcagggugauauagagaggguuuaaaggguauugcuccccuuucacuccuagccugggauucaauuuguggccaaaagcugaugguaaguguguguguauugcagccauagucagcagagcaaauggggacucucaacuacugguccuacuuccccuaaggagcuggguaguuaacauguuaucccugcaccugaguaaauuaacccauuacuccuuacccagugauccacuugcccccccaugaugugcacuguagggaguucaugcuguuuagcucagaaauucuaaguucacauggaguccaguuuuccuggauuguaccuuaagugguugauuguuggagccacuucauaucuauauuuaaguuagacuauugaguacugucccucaguuucaggagccaugggagcaaaucgaggggcaaaaguuacuucuggaucuucccaaucauuucucaaccauugagucacagccugugacaccagacgucuuuaacuuaacuccaaccucauugugcuagguucuguuuucuccucaauuauuuuuuuuucuugcucuaagaaaaggauaauacaccccuaccuuaucuguaacauccagccacauugucuggcuugguuaugugacuuucuuugcccaaaggacuauaagcagauaagaaauauccaugucuacauagaaucuuuaaaugagguugcaaggcuuaacuuucugcauuuuuguccucugcauugugaauagcauggccccgaugagggcuucucugcuucagccuaggucuuggaauaagagaugcacagaauagagccaagaagaagugcugccaaccacagacucauaaaugagaaauaaauauuuguuuauuuggggguuguuuguuacugcagccgaggcuaauacacaaauuuuucaauaagaacucagccucagcuuacaucaugugcgcaagugaaucuggggaugcuaggggcuaucuucccuaucauugagugaaagacuauuuauguauuaagccaacaggcaaggacagaaucaagaaauguuguaaaaguaagagcuccgaguccuuugagccccugaauccagcugugccugaagacuuaaugcuacauguuaugauuaugugagccaagacauuucuuuuacuuuagcuaguuuggauuagguuucuaaucugguuuaaaugaauacugacuuauaucaggucuccucacucuuuugcaaugauaucugagcacaagcauauaugacauauuaaguaauaguaaucacauggggguaaguuacacugggguauaaaucauuguaauugaauaagccugucauggguugaacuggguuccuucuccacccccagcuucaaauggauauguugaaguccuaaucacuacuaccucaauaugugacauuauuuggaaauggcauugaggaugcaauuaguucagaugaggccauacugaaauagggugggcuccuaaacuuauauaauugaugugcuuauaagaagacagccacaugaaguuugagauacacauaaugucuugugaccaugaagacagagauuggagugaugcagcuacaagccaaggaacaucaaagaucgcuggcaaacuaccagaagcuauaaaccaaaggcaaggaaggauuccucuacaggcuacagagagagcaugacccuaccaacaccacaacuucagacuucuagucuccagaacuaugaaacaauaaauuucuaauuuuuuaagacaccuaguuuguaauauuuuguuaugguggcccuaggaaacuaauacaaagcccaucaggugaauuuuuaccaacagaucccauggaaaacuucugauggaaaucacuauuauacucaugaaggucauugacaggguuuggcucuguguccccacccaaucucaucucgaauuguaaucuccacauguugagggagagaccuggugggaggugauuggaucagggggacaguuuccuccaugcuguucuugugauagugaguucucaagagaucugauggcuuaaguguauggcacuucccacuuugugcucucucuccugccaccuugugaagaaggugccugcaucuccuuugccuuccaccaugacuauaaguuuccugaggccuccccagccaugaggaauggugaguccacuaaaccucuuuacuuauaaacuauuccagucucacauaauucuuuauagcagugugaaaaugaacuaauacagcuauauugccauaucuauguccacacaauauccagagacacagaaaggaaaaaggaggcagcacaaugcaauggucaugcacauuggcugaaagaucaggaagaccugaauucaaguccuaguuuguucauuuacuuuaggugauuucugacuccaguguucuccuguacaucacagaaaaauccauuguuucauucaugauguuuuaugagaguuaaacgagguaguggaugggaggugcuuuacacugugccuggcagaguauauuuguuaaacaauagauagauagauuagcuaaauagacagacagacagauagguaacuuagacauauagauagaugauagagagagagagacagagagacagacagacacuuugggcgacuaucaaaauauuauaaacugguuggcuuauaaaaaacaaacauuuacuucucacacuucuggaggcuagaaauccaagaucagagugcuaguauggucaguuccuggugagaacccucuuccagguuguagauugucaacuuuuuacuguauccucacgugguggaaaaagaggaaguuagcucucugacaucuucuuauaagggcacuaaucccauuccugaggggcccuauccucauggcuuaaucacuuaucaaaggucccaccuucaaacaccaucacaauggagauuauauuucaacauaugaauuuugaaggacacaaacauucagucuauaacagauagacagauauacacacauaaaaauauaucaaugcauaagucuauagauaugaaggucuguaucuuuccugccuauauaaaauuuaaucaaaucauuagcaguuaaauagugaauuuucaacacauucccaaauaguuuuaacuuacuuaauauguuguguuggugguaauuuucuuguuguuguuuuuuaaacugaacuugauugaccugauuuuauguagauaugcaaagauaccacuuacucaugcagaccuuguuguguaaauaacccaaucuucugucuuugcaaagacaaucuuucccuaagaguuauaaucuccucucaacacaucgauuauauggaucaaaggcccucugacuuauaucagccugggccaaaauagucauuaccaaagauuuuccacuuucccucuuuaauagacuaagcuuuagaauuuggguaaugguuuggaugucaaacaaaaccugagaacuuguuuagguucagaagaaagugagagugauaauauuccuuucuucaucaauggagcuuucuacccuuucccgccuauuaugucuaauguuauugugcaccaaaaaugaagcucuccuaaucuucauuuaccuucauaauaaagagagucuuugugcgaaccauuucuacuauacugcaaagacacaaagaagaaggccuuuaugcugaagcuacaauuuguugacauuuuuauggauaugaaccugaauugucaugagugagcuuguucuaggaguagauguguccgaguuuucacacaugaaagacuggguccugaccuaccaagaggcaguaaauggaauacucugaggauuaaagacauuacucucaauaugucuuccccauaagccuaagauuccaauuuagugcuacgagaaucaccccucuguauuacaauaugcauugagaagacucucuuugagguguguuagaaagaaauaccaacacacuugaagaccacuagcucauuaaguugauuaguuccuugccagccuauaaugaaauucuaagaucuggagggaauugaauacuggaugauuaaguuuuggccaagcgguacauuacuaaagaaauagggaggagaaaagggggagcccuagucgcuuaagaguaaaucaaggggacacaaauaaucuaggaggggaugguucccaaauggccccaggaaguccuguugggaugggcacccagauuuuuaaccauuuucccucacuccccauaguaccuuaaaucaagaauauccaugaauguuacuaaaugcagcaugcccaagauggaguccuccccaugaguuuacaaagaagacucaagucaagaagacuugauggacuaggagguacuacuuaaaugggaaggaaaaaguuucuugcuagaugcugcaggagacuagaagaugaguagauauucugugauccucucaaaauuucacagguugagcuccuuugcacgauuccauacuguuaggcugggcauucuuauccuuugugacugcugcacaaggaagaaaaugagccacacuaucccuucaaacgcugagagcugguuugacacauuugugcugguuuggauaacuaaguaggagacccaggacauaaguggcagcuggcuggcaaggaugucagaugcagaaguacccagaaaaccuacucaggguguuuucuuccuuuccugguccccuccuguuacaggaaggcugaccucugcacaugccauaugagcuuggcccugcgguuugccuucugccaaagaagucccugauauaaaauggaacuucagaaccuugccuuuuuaggagugucauuagaaaucaaaucaguaugggcugaacaggcucaaggacugcugcuuuaguguggcagcugaaguccaaauuuuugagaguaauugggcccaggcuguuaacaggugcagccacuuccuacuagggagaaagaaugccugccauguguguuacacauggccucagaaggaagccaccugucaagagaaaugcagacacugggcuggaggggcccgaacagugaugcaagucugagugaugacuaaaugaggccccugcaaaggcagaauggcccaggauuguaauuaagacacuuucuuaccuucgcaugguaagauuugacuuguuauagugcuauuucuaguccuaaacucacuauacgucuaugcuaucauuucuaaauuauauuccauucaacacuaguauuuggagaaacacaguuaauuuucugugagaaaaaaaagaguucaguuuuuuggauuugcuuaggagacacuucuuuguacaggcuccaucuggcaauucucagaacacauuauucuauuaucuaaaaauggcugaguaguccuggaguauagaagccugauuaauuuuaagucaccuuucccugaaccaauacagucaucccuugguaucuaugggaaauugguuccaggaccucccucagaugccaaaaugcacggauguucaggucgcugauauaaaaugucauaguauuugcauauaaccuaugcacaucuucacauaucguucaaaucauuucuagauuauguauaauaccuaauacaauauaaaugcuacguaaauaguuauacuuuauuguuuagggaauaaugacaaggaaagaaaagccugcacuuguucaguacaaacacaauuccccccaccccccaaauauuuccaauccuccauugauugaacccauggauauggagggccaacuguaaacauuuucauuagaucuuuuauaaaaaugucccauggaauccuauuugagaaauucaggauuacacaaguaaacaaaaguugagagaacugguuuucucuaucaaauugggcaaaggucuucucugcccuugucauuauguggauacguuuuucuaugaggagcacuauagcacaguggugaagggaauggguuuggacuuggacugcuuggguuggaauacugccuccagcauccauuaccuauaggacucugggcaaguuacaaaaccucucugcacuguuuucugcaauguaaaaugguggugguguggggggguggugugggaauaauaguaauaucugccccagaagguuguggacagaugaagucagacagccuuuguaaagagccuagaacagugccuaguacccuguaagccuggggcaaauguuagcugcagucauugccaccaucaccaucaucuugccaucaucucccauccucucucucagaaucagauuccagaagucauuuugucuccauuuuccucacugcucuccacagucauucacucucgcugucccacuccugcuuuugaaaagccuccaccccucuagccuucauaacuagcacaggccuuccucgcuccaggcugaaauauuacagcuuuccccuagcuagguucccugaccccagucccacucucuacccaaacaaccugcccucaaugcccagacaaaccugccugaaacccugcuguguucuuggccccauucugcuacaauguuucugccuucauugucuagauggcagaguucaagguuaccuuggguugcaacccucucacaaacuaauucaaaccuguuuuccaaaccacauuuauucccucacccccagcuacuguuccugcuguucuucccacuuggaaugucguuccuagccucugcauagacucaaauuccaaguagauuccagaacccaucucagcuugugucuucuucccaaggccuuccugaucccuccaucucuuacucuggcaugggacacuagcaucugcucuacuguggaguggcagguuuagagggcuuagguuuagagaccugggcucauaugccagcuccaaaaugagcaagcggugagaguuuugauccaguuguguaaccccucugugucucagguuccuuaucugagacuggagauugauaaugcucucucuccaaagggauagcaugaaacucaagcaaaaguacuuguacacauucagauuuuuuuccagucuuccuguguguuuuuugaggagcccuagauuuggcaaaggugccuuugaaggcggaaguaggaaacugaagcgggcuagguugucagaccuccagccccugccucuacacuucaaccagagcugcgcuaccuugaucaauuauauuuauauauuugggaucugggugaccuuuacuuaggaaaaaaaagagaucuauuccacaaaagaaagaauaagaaaaccaucucaucucccagcugggcgcgguagcucauguccccaaucccagcauuuugggaggccgaggcagguggaucacuugaggucaggaauuugagaccagccuggccaacauggugaaaccccaucucuacuaaaaaugcaaaaaaauagcagggcguggugguacaugccuguaaucccaccuacucaggaggcugagacaggaaaaucgcuugaacccgggaugcagagguugcagugagcugagaucaugccauugcacuccaacaugggcaacagagcgagacuucauuuucaaaaaaaaaaaaacaaaaagaaaagaaaaaagaaaaccaccucuuaucauuaguaccauacaggcuuuccauaauuauuucacuauuucacaacaguacagcuggucuccccagauacauuguaaccuccuugggagaaaggacugagucaucuuuaaguauguauuuucccuaguuaaauauguuguacccgguaaguacuuaaauacuuguugaugaagcagcucugccuuacugcccaccgguuccuccagagaucacacuuuuauaagguuaagcccaucaagaaguuccuuuuccacuucccugagcaggcagccauggcuucuuuaucuccuuucacucucuucugggaagaucuacuucaaucccagugccauuaucucucucuaccaaacacugcucagagaauagccucugagaccuguuuccuuaccaggauucagaggaucacagauacuagagaugaaggagaaaaaaaauaaaucuaucagggcaucauguccucuccuugugcaaaacgguuaaguccugaacauuuucuaaauauuugucaggccugguauuaaaggcuugaagugacaaggucccucaagggagaaguuggcauuaaaccucacucuuaaagaugacuucuuuuacugacuuuucaguuucauguuucaccacugaaucucacuucucacuuuuaguuaaaucccuucuaaguagccaggcuacagugagugggggcuacagaaaagccacaggaggagucagaagaggguagagcugucacucugugggcuauguuucccucugacuacagguaaucaaaaaggaugggcaaggugaaaucuugacaucucacuugaacagaaguacucccccauucuugcagauuccccaucauucccauucagagagccaaaaugcaacuguguaauuauaagauaaugucuuauuuuuguggccccacugagguuaccaacucagacaccuauaggggcccuuugauaaggauggcaaacccacuuccuucagcauauugccagcucacaggaaggugcaucaugucaccagauuaucccccuuuaaaaaaaaaaaaaaaagaaagaaaccaucuaucaaaauuucaaugaggaaucucuucauuuuugaauguuggcaaugaauucaaauuaucuuuaacccauuguaaaggcacagcugacaccagucccuucuguaggagauuucuucuccuucugaaauccaucgccaauucauaagcaagcacgcaggaauggacaaugcuguauguuuauuacauuuauaauuuuguguguagaagccuugccucaauccucaaaaugcagacaccuaugcugcagucuuuugcgugguuacaucacucaacguccccaguacauauguucagaaaaauggucagguccucagggaauaguuaaaacugugcaggacuagacuacuuagguuuauaucccugccucagugcuugacagcucugggaccuugggcaccucaguuuucucaucuauauaauggugaugauaauaacagcccugggcucauaggguuguugugagguuuaaaugacauagcaggguguacaucauuuagcaaauacacuaggagcuuaauaaaugucauuuggaagcugcuucacauuuccacauucuauuaaaacacccaggaaccaauggugcccucacuucaucucuagauuuugcuaaagaguugguuuaauuuucgccaugucuucggguuucauuuuuaccucugaaggucaaguuggcuugcuacauucuuggcagaguccauagccccuuugaugguagaaaaugauauaaaugaaaaggucagaugaucuugccuggguuaccugucauucuggaagaucacagcuguaugcuaaacuagaucuagguaugugugugggguggggcugaagucuacacccauauugugguaggcacagauauguaccacccagguugcccuucaaggagggacuuggccucccaacuguaagguggauagugauuagcaagcacuguucagccauuagcuacuugagaaugggccucagcuccagugagcugcuucccuaaagaccauacauuucuugggcagcuuucauuuccuacagagugaggcaggugugacaagaugcugcuguuuccauucaucacggaacaauccagauaggcaauaaugaacccagggcuccccacuggcuugggugaagcuuuggagggccuaccucaaaguccagcuucuaccuugcccacuccuguuucugccccuuccuuucacagguguugaugccuaauaaacaucuuguacuccagaguccaucucagcacugcagcccaagaacccaacccaugacacacggguguacugaugcacacacacacuccugaaacccagacaauccuuuaaaacuaucuuuuuaauaaacagaaaccagccaaguuugauuauaaagaaaaccaaucgugcauugagaccuaugggauuagcagggucagggguaucuauagaguugggaaggauuaccacugauauuuucuuccaauuucuuuuauugugguagaauacacauaaucuaaaauuuacuaucuuggcuauuuuuagguguacaguccagugacaauaaguacauuuacauugugggcuacaauugccaccaaccaugugcagaacucuuuuucgucuuguaaaacugaaauucuauacccauuaaauaacaacuccccauucucccuccccccagcuucuggcaacuaccauucuacuuucuguccaugaggguugacaaaucuagauaacucauguaaguggaaucauacaguauuugucuuuuagugacuggcuuauugcacuuagcacaauguccuccagauucauccauaucauagcacuuaucaggauuuccccuuuuucaagguugaauaauauuuuauugcauguauauaacacauuugauuuauucaaucauguuucaauggauacugaguugcuucuacuucuuggcuauuaugaauaauggugcuaugaaugugggugaacaugggcguacaaacaucuguuccaguuccugcuuucaauuauuucagguguaugcccagaagugggauugcuggaucauaugguaauccuguuuuuaauuuugugagaaacugccacacuguuuuccacagcagcuguaccauuuuacacucccaccaacagugcacaugaguuccaauuucuccauaucuuugccaacacuucacucuuuuuugauagcagccaacuuaauggguaugcagugauaucucauuguaauuucauuugcauuucucuagugauuagugaugcugagcaucuuuucaacuguuuauuggacacuuguacaucuucucuggagaagugucuauucuaguccuuugcgcauuuuugaaucagugauuuuuguuguuguugcugaguuuuaggaauuaucuauauauuaugaauauuaaucuauuaucagauauaugauuugcaaauauuuuuucucacucuguggguugccuuuuuacuauacugauggugucuuuugauguacaaaaauguuuuucauuuaaguccaauucaucuauuuuuccuuuugaugcccgugucucuggugucauauccgauaaauaauugccaaauaaaauaucaugaggcuuuugcucuaaauuuuauucuaagaguuuuauaguuuuaguucuuaaaguuaggucggagacucauuuuaaauuuuuauaugguguaagguaaggaauguaccuaacauuaauuguauucuuuugcacuuggauacagaguuuuccuagcggcauuuauuggaaagacugucuuuuccuccauuuaaucaucuuggcacucuugucaaaaaucauuugaccacauaugugaagguuuacuuuuggacuccucuauccucuauucuauuccauugauguauaaaucuaucuuuaugccaauaccacauugcuuugacuccuacaguuuacaguaaguuuuguaaucauaaaguaugaguccuccagguuuguucuuuuccaggauuucuuuggccaucuaggguccuuucaauuacauaugaauuucaggauggcuuuuuguaugucagcaaaaaaagcaucguuggaauugucacagggauuguguuaagucuauagaucgcuuuguauaguauugaaaacaauauuaaaucuucuaauccauaaacauaagauguguuuucauugauugauaccuucuuucagaaauguuuuacaguuuucacuguacaaguuuuucacuucuuugguuaagcuaauuccuaaguauuuuauucuuuuuaauucucaauuuucuuuucagauuguuguuaguggauaaaaaugcaauguauuuuuguuuguugacuuugugucuuauugcuuuguugaauucauuuauuacuccuuacagauuuuuuuuuuugguggaaucuuuaggguuuucuacauguaaguucauaucaucuguaauacaguuuguauguuguccccuucaaaucugauguugaaaugcaauccccaauguuggagaugaguccuagugggaggugacugggucauggaagcagaacucuaauggcuuggugcuguccucaugauaaugaguguguucucaugagaucuguuuguuuaaaaguguguggaaccucccacacccuccuucucuuuugcuuccgcucuggccaugugacaugccugcucaugcuucacugucugccaugaguaaaagcucucugacaccuccccagaagccaaacagauauuggcaccaugcuugugugacuuucagaacugugaaccaauuaaaccucauuucuuuauaaauuacucugucucagguauucuuuuauagcaauggaagaauagccuaauacaaucugcaaacagauauaauuuaauuucuucauuuucaauuuggaugccuuuauuuuucugguugaauuuuucuggcuaggacuuuaaguacuauguugaauacaaguggugaaaaugggcauacuuuccuuguucuugaucauagaggcaaaucuuucagucuuucgucacugaacaugauguucaauguggguuuuuuauauguggcucuuaucauguugggguaguuucuuacuuuuccuaguuuguugagugugugugucugugugugucuguguguguguguuuaaaccacaaagggcuugaaauguggcagaugcucuuucugcaucaacugagaugauaauguguuucuuccucuucuugcucugcugugauguauuguauugguugauuuuuguguauagaaccauccauacacuccaagaauaaaucucgcuuggucaugauguauaauucuuuuaauauaccggugaguuugguuugcuaguauuucguugaagauuuuuguagcaauguuuauaagggauauuggucuguaguuuuuuugcaaugucuuuguaucaagguaaugcuggcuucauagaaugaggaaguguucccuuuuauuuaauuuuuuugaaaaguuugaaaaagaucgguuuaguuguuuaaauuuuugguacuauucaccagcaaagucauaaggucuggggcuucccuuugcuaggagauuacugaucacugauuuaaucuccuuacuaguuuuaggucuauucaguguucaugacuuagucucauagguuuuguguuucuaggaauuuguccauuucaccugaacuauccaaugugcuggcaugcaauuguuuauauuacuugcuuauaauccauuuuauuucuguagacuugauagcaauguccucacuuucauuucugauuuuauuaauuuuagacuucugguuuuuuuucuuagucuagcuaaaauuuugucaauuuuguugauaauuucaaaaaucacuuuuuccccugauuuucuaguuuuuccuugauuucuauuauuuuucuguucuccaucucauuuaucuuugcucuaaucuuuauucuuuccuucuguuagcuuugggguuagugcguuauuuuucuaguuucuaaguuguaagcuuagacauuugucuuauuuuuaaauauaaguauuuguagcuauaaaauuuccccuuaguacuguuuucauuacuuccauauguuuggauauguuguguuuuuguuuucauuugucuuuuaaguauuaucuaauuccccuuguguuuucuuauuuaauccaguuguugcuuaagauuguguuauucaauuuucacaaauuuuugaauuuuucaguuuuccuucuguuacugauuucuaaugccauccuauugugaucagagaagacacucuguacaaugucugucuuuuaaaauuuacugagacuucauuuguggccuugcauauggucuauccuggaaaaugucucacguguacuugagaagaauguguaugcuguuguuagguagaguguuuggcauguaucuguuagauccagcugguuuacuguuuuguucaaguccucuguuuucuuacuuaacuucugucuuuugucucuuugcuagcauuuuuuauuuaaagucuauuuuuucugauauuaguauagccaacucugcucuguuuugguuuacuauuuacauggaauauccuuuucuguccuuuuacuuuuaaccuauuugcaucacugguucuaaaguaagucugugaagacaguauauaguuggauuaugauuuuuuaaaaccauuuugucaaccucugucuauugacuaggcuguuuaauccauuuacauuuaaaguaauuacuguuaaggagagguuugauucugucauuuugugacuuguuuucuauaugccuuauagguuuauuuugucccucauuuccuguauuccugucuucuuuuguguuugguugauuucuuguuuugauaaugaaaugauuaaauuccuuuucgauuuuuucuguauauucuuuagcuguugucuuugugguuaccauggaaauuauauuuaacauccugaaguuauuacacuguaauuugaauuuaugccagcuuaacuucuauaacauauaaaaacugugcuacuuuaacaacauuauacccuccccuuucuguuguugaugucauaaaauuacaucuauauaucuugacuuccucaaaacaucaacuaauaauuuuuauccauuagucucuuaaauuauauagaaaacaaaacauggaguuauaaaccaaaguuauaauaauauugauuuuuagaccaauauauuuuaaaaauccguuauucucuuaauucauauagaaacaaaaaguggaauuacauaccauguuaaaauaacacuagcuuuucuacuuacaaauauauuuaccaauacaaagaccuuuauuucuuuauauagcuucaaguuacugucuagcaucaccucauuuuaaccuucuggacucccuuuagcauuucuugaagggcagaucuaguucuaauaaauuuucucagguuuuaucugggaaugccuuaauuucuucuucacuccuuuacuucuuuugcaguacaguuuuguuggauacgugauuauuggcugacaguuuuuuuucuuuuaccacuuugaauaucugagccuucuggccuguaaagcuucuaaugaaaaaaucugcugauaaucuuagugaggaucccuagugcaugacaaaucucuucucuucugcugcuuucaaaauucucucuuugucucugacuuucaauaguaguauuuauaauguguuuuggugugagucuuucaggcucacccuauuuguauuuuggugagcuuuuugauguucauauucaugucauucaacaaauuugggaaguuuuuauucauuauuucuucaaauaaucucucugccccuuucugucucccucuuuuccuucuggggcucucacaaugcauacguugguucacuugaugguguaccacaggucccuuaggcucuguucaucuuucuucaacuuuuuuuuucucucuguuccucagacuuaauuuucauugaccuaucuuuaaauucauuaauucuuucuucugccugucaaaaucugccuuugaguucuagugaauuucucaugucagucauuauauuuuucagcuuuacaauuuauuuuugguuucuuugcaucacucucucuuuauugauguugcccuuuugaucagacauuauuuucuugacuuuccccaauuauuccuuuaguuuuuuugaucaucucuaugauagguaguuuaaguaucuggcuaauggauccaucauuaggucuuuucagcucaguguccauugguuuauuuauuuauuuucccuuuaaugcuuaauacguuccuguugcucuauaugccuuguaauuuuauuuuuguugaaaacuggacauaugaaucgaauaauaugauaauucuugaaaucagauucucccccuuugcuaggguugcugguauuuguuuucauguuuuugauuguuguaggccaacucuauagcaaggaucacucugagguauaaacuuaaagucuuuucugagccagugccuugccuggaacaugcacaguagcuaucuaaagucucccacauauguaguugcuuuugaauguccuaguuuucaauaucugggucccaaaaagggaaagaagaaaaauuaagggaagcgaaaaaaggcaucagcccuuuaaauucccuaggagucacuucagcuagagaggaagguacaacaauaauggcuaccaccucuuuuuuguaccucugugauugaaaacggcaaucaguaaucagaauacagaucccaauauuugcaggauagaguccuuuuugcccaccguggcucccacaagccaugugcaaaccaggaguacaugcacagcugccugccauggggcugaaagauggggaauggguaguuauuacugugcuaagaacugaaauugauugaaauuaaucacaauuugugccccuuucccuggaauauucaggccuucaguggacuccagaguuccaaaauagcuacaacagacagauucugccaaugcaauuguuaucuauguggaaauacagauuucucaagcuucauacucuauaaucuucccaucaauuauauuuuaauauaccuauguuuauagggaaagaaugccaaaaagauuuaaaaaaaucacagaccuuuaauagcucuuuggggauuuuugagcaauuucaguaaucuucuaaaauaauauuuagaauaucuucuaaaauaauagagaucuuagaaauuauaaagacaaaaaagauuauuuguguugacauucaauacuuuuucuucugaaauucccaaaguacuuacauuuaggauauauuagauaaauuagguaacgcaaugggaagguaagcuauucuaaguuuuccagccuuguuauuauccaguaauaaugccauucaacuugcuggcacuuagauugucugaggaaccuuuccaaauauggugucauauaaaugccauuguaaagcucuaccagaauagcauuaucagauucuuccuucaaugcccaguaacaauaaaacacuuggggaaaaagaucucauuucagagucccugucucucauccuucacucuugaguauucagcugcaucugucauucuuuguuuuuauauuucuguuuauucaaauaucacaugauccuaaaacagaauaaauccugucaucaugcaaauuccauuuaggacaguacucucauauaugaggucagguucauaucccuuuauaggcaaucaagcuaauguauauaguuguuuguuaagaaauaagauucucggccaggcucaguggcucaugccuguaaucucagcacuuugggaggccaaggcaggcagaucacuugaggccaggaguuugagaccagccuggccaacauggugaaagcccauggcuccauuaaaaauacaaaaauuagacagguguuguggugcacgucuguaaucccagcuacucaggaggcugaggcaugagaaucacuugagccuggcagguggagguugcagugagcugagaucaugcuacugcgcuccagccugggugacagaaugagacucugucacagaaaaaaaaaagaugagauucucccauuauuaaaugcauaugaaaaagaucaaauaaugcaugcgauaugaguuguguccaaaccacaaucucauggaggcaaaauuaucaagacuucaauccgauugguggcuugcaaacuacccuaggccuccaacccacaaauauauacagccuccaacccacaaauauaaacagacacagaugaaaucuggaugcuaggaauucguuuccuaaacuuuccaacagcacguaccugagggacuguauggaagagaugaaacaagagacauguuuaggaggaaggagcuaguuguuuaccaauuaaugacgaacuaucuaaaacuucuuugcucucuaaaaguaagacuuguaauguuuucagaaauaaauauggguuauucuuaaucagguauauuauaagaguagcuuauagaaggagauaugcauuguuucugcagugaaggaaaaagcauaauuuaauuuuugacaaaaucagaaauauuauaagguauauguucagcugcagaagcuauaauaccuuugacuuuaguucuuuaaaauaaauuauagauacacaacuauaugcacuaacagccuaaaaguaagucaugcuggguuuuuuuccauacaauuuuaauuagguauauuuuuuccaauguguuuugaaaugaucugcuaggaccaaaugcuaacaugaaauucccugcaugcugguaguuaauuuaauaaaaauuagaaaggugaagcccuguucccuagagggagaaggucuuaacacaaaacauucauuauuuccacauaaauugcaaaaaguaaagaugcuggauuuaaaaucuaagcaggaagaaacugucaacuuucauuaucaguggacaaauguuuuaauuugcaauauucccuagcaacuuuuugaacagacaacuuuaccucuuuaccaacaucuacuuuaauuccuaauuugcagcugcauaaguacuauguugggcccaaagcuuuggguauaucucuuagagguaauggaauccuuguuguuuucuggcacugccucauuaaaaugaaacucagacucaggguaacccugaaaaaccuaagcccuccaauaaaaaaugugguauaucccugcacuuaaauuacgcaggagaagugaaggcugguacaucacacacagaagagaagcuaaaggucaagcuauuagaguuaaugagccgauacaagcucaggcucucuaaccagagagguuagggacagaauacauggccaccccaaggaacuuuauuuaagauaucaauuaaaaaugagucaccucucuucucagcuccugcacucaacacugacacugggaacaaugacugaaggacucacacaugucugagaaaaggcaccuugugggugugacuugccacaaaagcaagagucuuucugcauuuguaaauguguugguaaggcaacaaaaagaauacuacugugcaaggggagguagagguggugauccuggcaaccuaaaagccugauuguauguucuaauccauucugaugucaccaaagcuccccuucgagggaauaaccuggauuauggccaauacuuucuacuucuaauagucuuccaguuucauuguucacaagggguugguaaacaaaaaucaaugaaaagagcagggucuucucuauuuuggauuuggacacugaugaugaagcugugauauucugauccaggacucaauggcuccuccuggaucuucuaacaaggucaaucuggcugaguuccagacagucagcugauggucucauaugaggaaucuaaaguugaugaagauggugguaguagagugguguaauccucauagcucaaaaacgaucagagcucauuaauuauuaacuaacuagaacuuuuauggcucauuagcuacugguuaaaugucagguaaaauguaauauuuaauagaaaauguuaagauuagaaauaugcagagcauuucuuaugugccagaccuaugcuaaguauuucauauccauuauuguacuugauccuuacaacucccaugcaagggaccuauguuuaucucaauuuaacagagaagaaggcaaagugugaaaaacuaaguaacuugucuuaaguuaaacagcuaauggagugguagacuugagcuucaaacccagguuuagccaacuccaagcccauucaauuaucacuugauacacacccaaccuauguaauacuuagcuuuguucuuagucauuguugcaaagcucauuucaccccucagucaggcuuauuacauucauucguguucucaagagacaagagggucuugcccaaaacuacagaauaucacuaucacaaguugccauucccacuagaauuuaccuugauccccagugaugcuacaugcauuauuauguuaguuucuucuuggagguguuauuuuuaaacugcaagauuaaagcuccuacaagcuucugacaacaugaaaaucagacacgacuuugcagucuuuuuaaaacaaacuaguaagaaggucccaauuaagagaaaaagaguagucacacauaccuguagaacugauuguaauuuacccuuucaucuugcucuaaaacacauuccuugagucucaguuuaguagagauaagauucacccagucgggggauauuaguucuuccuggauauuuuaauuaaacuguuacauugaguaguucugaaaaucacauauaaucauucaagguaugguggaguucuguucuccagcauauggcucuccacccagccacauuccaucuccuuagguaaacuagcuggaggccuucaguguaagcucuuuaauuuuuaaacucuuggguggugcuuuguucuucggguagagaguagagcaagagaacgaauuaccaaacaguaauauuacccccaucgacaagcgggugguguuuauaucacacauacuauauaccaagaaaugcgccacaccuuuuacaugaauacucauuuuaaaacaguaaagacuuuauauuuagagaaguuuuagguuuacagcaaaacugauaguaagguacggagauagcccacauauccccugccccacauauguugccucccauauuaacuuccccccaccagacugguacauuuguuacaauuugugaaccuacaaggacauaucacccaaaguccauaguuuacaagaggauucagucuugguguuguacauucuauggguuuggguaaauguauaauggcauguauccaccauuacaguaucauauagaguaguuucauuguccuaaaagauccucugugauccgccuauucaucccucccucccuccuaauccuuggcaaccacugaucuuuuuauuaucuccauaauuuugccuuuuccagaauuccauauagucagaaucauggagcaugcagccucuuuagguaggcuucuuucacuuaguaauauacauuuaaguuuccgccaugucucuucauggauugauagcuaauuuguuuuuggcacugaaucagaaacccuuguugggauguaccacaguguauuuauccauucacccacugaagaauuucuugguggcuuccauguuuuggcaauuaaggauaagacugcuaugaacauucauguguagauuuuuguguggcuauguuuucaacuccuuugaguaaauaucaaggaauacaacugcuggaucauguuguaagagcauguaguuuuguaagaaaucgccaaacuguauuccaaagaggcuguaauauguugcauucccaacagaaaugaaugagaguuccuguugcuucacauccucucuagcauuuggcauugucaguguucugauuugggcucuucuaauaaguguguggugguaucucacuguuugaacacucauuuuugaaauauccacauaggcuauuaugaucuucauuuuacaguucaagaagcugaaacucaaagaauguagauauuucaaacuggccauuguaagcuagagccaagauucaaacucaaguuuggugaauuucauagccuauacuuucuaucauugagguacaucuuguuuucucaguuguauuaugugauuugcaaguccuaugaauaauauauuuaaauuauaccaacaugaaaacuaaguguaaucuucagucaauaaaauauccacuaaauacuucaaaauaugaaacuggaagcuuaucuaaaugaacuaauucuuuaauaucaccaugaaaggaugauguuuuaaauuaagaagugaagaauuuauaguuuccagauugagaauaauuuccacaaauuuuuauuuucaucauauucuauugugggugugcaugugugugugugacagacacauaugcagacacagagauauggggacacacacauagacacuuuccaucucaugccauguuggaacuucccagagacaguuaaaauuagcuagcuaauuuccauaaacuaucaaaauaaaauuauacuuauugagagucuagaguuccugucaugaagacuuagcaguuaaaaagcauggaagucauggaaucucagugcuccuucguugcaauccacacuccugcuacaauuagaaucccaccaauagauaaagucaucaggagcuaauuaguccacguguaaaaaauaaaaauaagacaaagaacagacuucuaaaaaaaacaaaaacaaacaaaaaacaacaacaaaucauuugaaccauuggguacuucgaguacaugaaaauugugaaguaaauuaauuagcuuugcauugauugguaucaaaagucguuagcccugcacugcaaggaaauccccagaagccuaaggugcaugaaagaaaaaggcugggaaggaaaucaaucucugcucuucaacgcugaugcuuuaaagggucccugcuguauaacucgcccggaagcauuccagggggaagaacccacagauuuauaucugccacacgugucacugaacacaaauacgucugauaaauaauugaagcucgguauugugcuuacgucgcaugugcaaaaaaacagggacaggaaggcaaagaggucaaguuucccaucugacuuuccaaugagcaucccaaucaucacuuaggucauuauucuaccucgugaagugucagaacucauugucuuagggaauccaggugcuggcaucacauauuuagcaaaucucauuucccucucucucacaccgcagagcacucucuaguccaagcacagugcagggcagaauccagagcuuauuuuauuuaauccucacaauuuugugauuuuuacagaugaaaaaacugaggucuggggaauagaauuguuuuucacaggcacaaagcugguaauugguagaucugggauuugaaccgagguccaggaaacucuagagcccauauuauugccauacuaggcucccucucuaaauaacuuucucauuaagugagcagagagagaggagccagacugcccugaggccuuugguauuaauaggaggcuaagaagcucaugcagcuaagucucuuuauccaacggcacaucccuggaaggagaaaaugggcucuguuggaauccuuccacugacaggaagcucucuaccucacauaacuacagaccugauuacuaaaaagacuuugguuugccuuuccaaaacucauauccagugaucacaauuguggccucugaagcaguuugauucaauacuaauugcacucaguacuuggaucuaucauaacuguaacauuaaacaauguuuuccccucgcaggguucuuuugaggauacagugaguauuaaaaugggcugguacauaguaagaauuugcccaauguuaauuauaaaaauuuuccugauauuacuugguaaguuauucuguuaaauggaauaaacacccaugaaugccacauauaaaccaacagcuuugacccucauaaugacccccaucuauccauguuguccucccccauuuaucuucuugucuccaaggucauuauguuccugagugccagguucaucuuucuucuuacaggguuuuauugcauguauaauugguccuaacaugcuuuauaaucuaagcuguuuuaaauuuuauaaaaaggauuccauccuuauuuaaucuuaugcuauccucacaaacuuauuuucccccacuugauauuuuacuaugaagaaauuaaaaguuaccuacaacugaauaauaaugaaaugcuacauauuaaaaucuguacuuauaauagaagauagccucaauguuaauaaggugucaaucuuaaguauacaaaaacugaacaaaauaaguucauauuuagcaaaagaaaaaccacaauaaauaugagcacaaauugaugaaauagaaaaauauuuucuagaaaagaucaaaaaagucaaaaguagauucuuugauaaaauaauuaauagauaaaccuuuuuuuguuuuuuuuuuuugagacggagucuugcccugucgcucagucuggagugcaguggcacuaacuuggcucacugcaagcucugccucccggguucaugccauuuuccugccucagccucccaaguagcugggacuacaggcgcccgccaccacgcccggcuaauuuuuuuguauuuuuaguagagacgugguuucacuguguuagccaagauggucuugaucuccugacuucgugauccacccgccucggccucccaaagugcugggauuacaggugugagccaccacgcccagccaauagauaaaccuuugacaauaucgauuaaaagaggaagauguuuugaaugaaaaagugaauauuuauuacaacuaaaauaauaaauggcuauugucaacaacuaucugucaaaauuuuuaaaaauuuagaugaaauguauaaaugccuaaaaauuuauaacuaaccauaauggacccaagaaauaacaaaaaguuuauauagcccuauggcuauuaaauaaauuaagguaauuguuaaaauuuuuuuugcaaagaaaacaucacaccaggugauuuuacacgcaaauuuuucccaauguucaaggaagacaucauuccaauuuuaugcaaacucuuccauaugauagaaaaaaagagauuauuccccauagauucuguaaaucaguauaacccuguuacuaggaccaggcauaaaaaucacaagggaggaaaauuacagccuucucucacaaaggaauauagaugcagaccauucuucuuaguaguauacucaauuguaaggcauaacaaauuuuauuuccaauauacaaguagcaguguaacauuacagaaagauuucauuagcuuuggaauguaccauuuuucuagcuguauaauguagcaauguuaucuaauuucucuaagacucaguuuccuucuuugcaaaauggcuuuuuauaauaucuaucuaauucugugggaauuaaggaaguaaacaauauaaagcccuuagcucagagucuggaaguaacaguaagcaauaauaaguuacagcuucuauuuaucaaguacuuagcuccccggcugaguauuuuuuuuuuuuuuaacucuccuuuaauccccacaaccacccugaaugguggagauuaugcucaauuagugaauaaagaaacugagucaaguggaauuucaacaacucacccaaagucacauaaguugcaaaaagucacgcuaauguaacaaucgcagucucugaauacugaugccugggguccuuucaaauguggagcugauauuaccagcugcuaucggggacacagcacuuccucugaggggcacuggaguuccuuccacaaggcauggaauguguucaccuuuucaggggaagcaguuuucaaguugggguuugauuugugacaugugagauuaaauugcagcauuucuaauggaaaggcuucagagggcaggaaugagcgauacacugucauuucuccaucucugcgugaggaaccuuaagcacuaaugagaucagauaugucaccgcaacucucuccacucugccacagauuccaggucagaauauuuuuuuuuuuaaacauucuggccacuucacugccuaccugcaacucucuaccacguuccugacauauaagauuuaugauaauuuaccuuaggcagggcuuggaguuuuauuccaccagguuaucaaaaauguugccaauaaucucuuucauauuuucauaggacaagauuauacaaauaauauuccacccuauucuuucccuagagaaacuuacauaucgauuagacagggaggccuaacaaagauucaagagucaguuuguccuaugagcguggaaaacaccacuccuguuaaagauuacagagugacgucacuuaugacuaugcugugcaaagugcuggguuuuuuuuuuuuuuuuuguauccuaaggggcuuuaugcuugucuuuguacuauuggugccuugggaaggaaaacaagaaugcauuucucaacauuuaugucugcagcgauacugggaacugugaaugcuaacauauuuuuaaagagcucugauagagagaaaccagguggugaaagaagguagugaacaagccuggauacagaaagguuuagaguagaacuuacgggcgccaccugcugguccccugacaccacugcccagagcuuccaguuccccuaauuggagucucagcuuuauggccaguuggcucagcugaauauuauuaaaugauuucugucuucaacuaugcuuagacacagccuuggagacaaguaaguaaugcagagagaguaaaagggagugaguagaugucaaagaaugguuugcccauucaacauaugugugacugcugugaaagguguaugggaguuucccacaucaucuaucagcaaaaagacauaaauggugaucuuccuuccuuuucccaccuucuuuuuuuuuuuuuuuuuuuuuuuuugagauggagugcuggagugcaguggagcgaucucggcucacuccaaccuccaccuccuggguuccagugauucucuugccucagccucccaaguagcugggauuacaggcgcccgccacuacgccuggcuaauuuuuuguauuuuuaguauagacgggguuucaccauguuggccacgauggucucaaacuccugaccuugugauucaccugccucggccucccaaagugcugggauuacaggugugagccaucgugcccagccuuuucccuuucuuucuuggagagaaaugauagcaucugaggaggcaggagcgaggggugucuuguggagguggguagugauggcagccugcucuguaacugaacaugcagggcaacguggggagaggggugcugcauggaugggggcagugguguuucuagugugugaggaagcagagcagaggaugagauguacgcagguggugggcagugaaggcuaauauugaacaaaugaguauauauauuaaggauaaugggaaccaaguuucugucagagaagguauuuauaaauguggaagggggaaaagacuuagauuugaauugaagauacugauaugaauucauguggcuuauguguaaacauauacacauacccagauauggaaauaauaauaaguguguguuuguguggacuuauauguacauauuuccuagcucuguguugacugggucucaaagcauugacaucacaggaacaauaagcaugcuaagcacccagaucuugauuucuaaaaucauucuacacggacaggaaccagagcugcuuggagaaguggcugauuccaaggcuggacagggacaguauaagaugauccuggagcaucuuuuuuguaccagaauauaaagaaaugcucaaagaaugauggggagaucuggcaaguaccaacuggaccaggugaucaaguggggauacggucagugugguugccuucugaugugauaugcugagaagagcucagcagcguuuuuguggaauuccugccaagauggcauggaagaauacaugacuugagucuaauaaugaagaaacaguggaagcuccagagaaagagucauccuacaggaaaaaaagaccuauacucuuuaaggcaggaaaacacgagacagggaaagaauaaaaauccauuccaggcugggugcuguggcucacgccuguaaucccagcacuuugggaggcugaggcggguggaucaccugagguuaggaguucaagcccagccuggccaacauggugaaacuccgucucuacuaaaaauacaaaaaauuagccaggcauggaggugugugccuguaaucccagcuacuccagaggcugaggcaggagaauugcuuagaagcugggaggcggagguugcagugagcugaagaucgcgucacugcacuccagccugggcgacagagggagacucugacucucaacaaacaaacaaacaaacaaaaccauuccagauuggaggaaacugaugaaaaauaauaauuaaaugcaguguauguuucuguauagcauccuggaccaaaaaagaaaaugucaucacugagacaguuggcaaaaugugaauggggccuguggacugaaugguagugcuguaucaguguugauuccugauuggaaguguuuuuauaauaguaaugagaagagugcucuuguuuugggaagguaaucaaacaccugaagagugauggagcaucauaucugaaagggaauaucuauauauugaucucucugaaugaaagagaauuaaaauguugcaagguggauaaucagggugaaaggauaccgcaguucuugcuacccuucugucgguuugaaacagcuucagaauuaaaaaaaauacuaaaagugcugagcucugagaagaagaaaauagcauaaguuuaaugggaaaauuauguuauacaugauuagaauccuucuuuguuuucugagaagacccuuuguugggaagaauugaugaucaggaaugcaaaugagaauggccaaaggacagcuagcugacuuacaaaaagaaaaagaagauucgguauaaagaaggagagaagggugaccagguaugcaaggagaaaaacugauugcuagauauugagagagaguacuugcaaacaagcaaacaguugccauagggaauggaacuuguagggaaaagaaggauguuggagaaaaguugaauaaauuuugaaguguuagguguaauauaauucuucuguuauuccaaaucaccacccauaacauccacacccuucaucaacacccuuaagacacagguauuuauuuguuuaccuuguuuguuugauuuaaugaaaaguaugagacugacuggagaacaggugcuuggugagcacagggcagucaguguguaucaguauguuuguguuuauuaugaaaagugagauaaaacaucuacauaaauaguucuaauacaggguagaacagaauaaaaaggagccaccagagagugucagauaaggugugaggaaacuucagaaaauagaaggaaaaagaauauuuacauuccccaagcuccuucucugaaccagaaggugggaauuauacauugaaauagcacgguaugaaaauccaguaaugauccaugaucccccagcuaguaaauggcagagcccagguccauagaacccgaaagaucucuuuuuuuccuacuauagugggcugccuugugccugggucugaagagaagaggaagaaagaggggagucugauggacaaagcucuguggaggacguggcacugagcagaaacuugaaacagagcuugacuggcuggcaggaugagaagaauggacucuuggcugaaggggaagcaagcacaagcacauagagaugaggaagcauggguggugguauauaggguaagugcaaucuauuucaaagacagcuaaaacacaagaugacccauuccauggcaaacauggacaccaacaccauguacaaagaugaugagggugaggaagauugagacgucaguuauacugauugggaggcuguggaauaggcagcacuggcaauacuucugugcccuaaugucauucucugaagcucaaggccaaacccacuggggccaaacucacacagaaacauuuauuuucagacaucauuuaaggaaggcaacaccugaaagauggaagggcucagugcaaacuuccagggugcuauuuuugaaaaugcagaaacucccaguuuggaaauauuuucuuaaaaauuuccccaucauuauuagcacuucugccaaauaaucacuaacuaaaaauauucccuccuugauaaugcacagauaaggucucugcacugaggaggaacaauaaaggaaggugaugaauugcaaaucaaucauaauuuaugcagauacucuacugaaaaucacauucaucaccuuuuccaaauagcgccacaugaauuuccugaaguacaagaagucuauuuucauaaauuagaccuuaauuucuuucucucaucaauauauuuuuaugccaaaaaguuaaauaguaaacaauacagcugaggaagaaauuaugaacuagaagaacaugaaacaugguauucagaaggaaaaaaaaauagucaaauauauuuucuauggccuuugcuuuguguuaaaguguguguuuuuuccccaaaggauuaugugauguaauugguacuaguuggaugaugaauauaaacaaaaaaugccaaauuaucacaagaugccuuugggaaaaaaaaaaaccuguaacugaugcuacaguguacccugccaguauuuuugaaagcaaaacuguacuaguucauuuuuacacugcuaugaagaaauacccauagcuggguaauuuauaaagaaaaagagguuuaauggacucacagccccacauggugggggagaccucacaaucauggugaaaggcaaaggagaagcaaaggcacaucuuacaugguggcaggcaagaggccaugcgcaggggagcugcccuuuauaaaaccaucagaucuugugagacuuacucacuaucacaagaacagcacgggaaaaacccgcucccaugauucccaccaggucccucccacgacacauggggauuaugggagcuacaauuugagaugagauuugggugggaacacagccaaaccauaucaacaaucauaacagcaaucagccagcuaagaccaaugaccauccagcaagacucacuugcuauuucucuguguuaucuaugucaaauggcaccuuuuuucuuagcaucccguuuguagaagagcagacacagagaauguuucacagguccccauucuggggauuauuggcuggguauuuaaauauacuuuucuuaggcuggguuccucuaaagcaaacccugaagacaagacuuugaaggcaaguaguugauuuagaagguaauugcagaaaucaccacuaguggagugaggaaguaagaucgggagggaagaaaauguguguuauuaaacaugugauugcugugggcaagagggacuccguuucacugggaaacacuauagauacguuucccaguuauuccuccacaagagcaaaggagccuggguacuuacucaccaacuuccaugagucauucugauaacugcuaccaaggggugacgggguaggaugugggcugggagauuaaauuccuagcacuuucaggcuaguuugcacugcacaaacacgaaguagacaccagugacuagaaaaagacaacagccagaauguaauaguauuuaaagauggaagccaggggacaauguguagaggaauaguccuauccgaggaauaguccuauccaaggaauacgggcaguacacugcaacagggcccuuuuaaggugagauauuuagaaaccugggucaaugcuugucuccaugccaaugcaguuacccacucccucucagccccagccacucuacgauaaagucuuaaugaacaucagagggacguuucagggccugcuuugugacgcacaucaccccuuagacuacuccagugcucacugaugucccaaauaacaaguccucuaaauuauuggugguuuggucuaauuaucugcugaaagcauucaaaaccauuggguaucccugaaggagaaagucacaaugcugcauaagaagaaacaacgccugcaacggauaacuuauuugcugucauaugauccuauagcauccuacagaucuccuuccauuagcauccaucacaucuguaauuauuuccuuuucauuaucugucuucccugagugaccauaaacccaaugaagccagagaccaugcaugauuauucauucacagcucuacucccugugucuagcucauaguagggagucacucaauacuucugaauaugaaaacaagugaaugaauuaagauuauuaccgucauccagcaggcaaaauggauuacauagcuaagggucuguucuucugaaguaccuucuuauaaaggauaaaaaaaggugcuccuucuuccaggcagaugaagcucugagccagagcucauugcuuaaccaaagcauugcagcucaaauucagcuccugcucacccauuggcaaggugccugcgguaguuuuaagagccaucaacaaauauuucuagcuugucuucuuccugcugaaugaaaaguuugcccuucccugcucccuugaaauuagauguggccauguggcuugccauggccaaugaaggaaaacagauaugaucccauucuagguggaagccuuuaugaguucgugcacaauuuaccauauuuguuucuuucugccaugacaaccagcaagaucgcagauggcagacagugaucggccuauauucuuaaaaggaagagacauauacacaguaccuagcuaacccacaaaaggcauaugauauguuuuggcuguguccccacccaaaucucaacuugaauuguaucuaccagaauucccacaugcugugggagagacccagugggagguaauugaaucaugggggcuggucuggcccacgcuauucuuucgauagugaagaagucucacaaaaucucauggguuuaucaggggcuucugcuuuugguucuuccugauuuucucuugcugccaccauguaagaagugccuuuugccuuccaccaugauucugaggacuccccagccauguggaacuguaaguccaauuaaaccucuuuuucuucccagucuuggguauguuuuuaucagcagcaugaaaacagauuaauauagcauguuagaaauauacuuguauuguuuaaauauuggcgcucuucauuccugcagcauaucuagcccacucuggcugaucuaguauacaacccgcagcccuauauccuguggcccugggcagguuaacacgacuugcaguuucuuuguucucaugaacugguguucaugucauacccucaugcaugcauuacccucucucugcacacaacgugggccucuaagaagcaaugcuuuucuguggaagaaggaagagggggcauucagacuuaacccuuucugccuaaaaggcccuucugaaauuauaugaaagagagagagaaaaaaaaaaaaacauuuugcaugcuguucauuuagaagggaggccuaauucuuucaccuuccuauaaucuccagagcaguuccuauaccaucaaggcugccucuccugagggggccagagcuucaggcucauaauuaguuguauuacuacuacugucacugcuaauuaaugauccacauucagccuaaauugaaacugcccauuucugacuccuccacucuaggucaaauagaugguuccuuauuuucaaauuauguacuucaucuuaauuguauaauuucaauuucauuuaaaaaaagaaaaaaauuaaaccaaggaagaaaugacauuuucuaaacuggugaguuggguuaucaaacuuaaaagcauaaaaaauuaauacugugggauuagcauuauuauagaaauacauuaaaucuuauauuuaaauaccagucuuuuaaaccauggcugucacagugaaaauguuaauaguauuuaaacauaaauccuucuccccaugaagaaucauucaucgugcaagcacguuagcuauucuauucacuuuagagaugcugccuagcagagcauuuuaacguaagccuugucaguguuaauccuaaugucugaugcugagauguguguuauauuacuuuauguagcugaaaaaugggaagccuuuaugucagauuacaggcugaaauaacgaccuccccuuggagccagggccugggauauaacgaggugccaaaugggauucuaggucagagccucugcaggacauaaaagggaacagaucuuuuguuaagacccauucacucacuaacagaaugcuuuuacccuuugcaaucuacuuuauggcuccucugcaaagaagaguaaccaagagagaaagucuugauucacaguggggcuuaccagccaagcuuuggauucaggcaggcgaugguggaaauguacccagccacuccuucaccuccacaaccaacagucuagggcuacgguguucaaauugcauucaucaaauucagaguggggagugagagccugagguucggcagaggcaggaacggggagagagagcaucaaaguggauccagugccuucuccauccucacugcauccagagcaguucccucuacaucuguuuuauauaccacaguuuuaugaaagauggcacaugaaauaugguucuccuguuaaaguaacucauuaauucaacaaauauuuaccagccacagacaauaaaccccugaauaaaugagcacauuucagagagugauagacgauacagagaccagcaagcaugaugaugagauagagaguaccuggaguaagggccacuugcagagaggacagggaaagccuggcugggguuugguggggaaucugagcugagucaugaauaagcagaaacagcaagccaugugagauccaggaagaaccauuccacgcagaggaaguggccaguacagacagccuaaggcagaaacaagcuuaacguguccaagaauagaaaaagggcaauguaacugcuauugggugaauaaagagaggcauggaaaagaugaggaaggcagaucauucggggcauuccagacucaaacaaggaguuugggugucauuguguagugguuggaagccaauggaagguugacaacgggggcaugacaaaaucuguuuugcggaguucuuccacacagagaguagauuccaggcacaagaacauaggcuggaggaucaacaagaagacuguuaccuuccaggaccuggaagagaguugcagugaagauggugcaaauuaucuggaucugggauaugucuaaaaguaaaucugaugggacuaaaggauuacuugaaaucacuaaccagaauuugagaaggggaggguggaacacgugguauguggggagggaggagauagugcuuagaaagaauagaauaauugccacuucuguagauagcuucuggccaacugacuuagcaaagagcagcacaauauccuugggcugagaccagcggguuugccacugucucucaccggcaaucgcauucuugcuuccaaauccggcugauaauuuaggaagguuuuaugucaccgcugcucggcuucuuuuugugcuuugauuaccuauucucauacaacacuuaaagguggucacagaauaaucucuaauguuuugcuuucuaugauaaauaagggguucgugaaguucauuaacagggauugcaucacccuccacccucuuuuacaaccacaccauaaaaguagccucuaauuaguuaaaagacuacaaauuauaccaucaacgugagguauggcaaaaucugauggcucuaauuaucuuaauaaucagcagaaccacucucaaccuaauaagagaaugagucauuagugguaguuuaugaagaucaccgacauucucuuuguuauggaguuuguccuuccuguguuaaaauuuggacacacuuucuacuugaaucuaaaaaggaugauuucuaagaaguuacugaagcaaugcaagaucaaaacauaauaaccacauucauucuuaaucagcauuacagugaaaguaauuuaccaaagaacacauaauuaagucauaaaugaaaucucaagacagaaauugcuccccuuuuaagauuucucauuguccauacacucagaaaugagaagagggauuuucucauucugauccuaaaucuaucacugaaaugaugacuucacuugcauuuaugcauuuugcuuuauuuugugauuacuuuaucucacuauccuccccuuuuucugcuugugugauugccuuaauccuuuuaucuagaaccagggggaguuccauuagcuucagcuuuuugguaugccuuagccacagaaaacuauuuugugauucaaaacugcucuaaaauucaggaccaaauaucacauauuauguacucccuagacuuuugagaguuucacucuagauuauagaggacaaaaucaucuccccaccuccaccuuaggguauguacuccccaucucaagucauaagauaaaccuauuguggucagaaggcagaguacucuaauaaccuuguuauaguugaagagacugaguccaugaaaaaguuacggaccaagguuauacacagagcuggugacagucuugaggcuaaaacccaacguuuuacucuuagcuaauguucuuuugggcuuaaugaaugaacuacugcuguggaaauguuuuuuuuuuuuuaaaaaaaaaaaaaaaaaaaccuuucauuguguuuugccagaauaaagacugaacauggcccuagcggaagagcuaaauucauuaucuuuaaaaaaugaaauuuucucaaaucauaaaugcagucaccaaguguaccuucuuucucugcauugcaguacaccaaaaugccaguccucucuacaaacacauuuuauggaucccaaagcagagagauugacguuguuccauuuccuguucacaguauaaucaggacaaaggaauaagauuaguauugugccauuuccacgcggaaaaaaaaaauuguuuucuccaugugacugucaguguaugucaaaaugauaauggggaauguguaauacaagauauugcuacuuaucaauggacucugaaaagaaaauuagcucaagcaucccuugauauaaaaagcaaauaugaggucuugaaucacaccauccugcuaucaacauguuuuguuacaagucaguuuauguuccuugaguaccacgugguuuacagugcauuucucugacagcaauacagaaccucaaacaaauauuacccuugccuccaauaccaaccaacauuaaauacaaguucuauuccugaacucaguggcauucagaaauucaaaaugcuuagaugcccucuccaucgauuugcuucucuggguauugggcugacuuccuguucaucagggggugguggugguggcuggaggaggaaguagaugguuuuaaccauuuguaggucuaauuacucaagcucagugagcccacauugaagaaggagaaggagaagaagaaaaauucucuuuccuauuguucauauauaaaaucccagggaaagauucuaaucaacucuguuuggaucacaugcuuacuccuugggccaaucgcuguggccaagggacaguguagcuuaauuaggcaagccugguuacauucccauccuguuggcuuggaaagggggauacuaugaccaguaaaccaccccaaaucauaugaaauguaggagaacgguuauuuagugaaaaugaagcacuauuaucagaaagaguuggaaguuauacuagcagacagaaacaacaacacuccacugccuuucaaauaaguuuauuaugaaaugaaacuacggcuccucuuuucuaacagaccgauuuugugauuagaaguaauagguuuuucucaaccaacaagcucaacuaguuuagcucuuucuaccagaugagccaagaauaaaggacacauaagggucucaaagauuaugcuuucuauccugcccaaauucuguaaccauuaccuuuucaguaggugauacauuucccaauuuagacuucacauuauagaaaaaaaccauccuucacugaguuguauuugauaccgaaugccugcauuuucauguacuagucauuauuccaucuuuccuuaaagaacauccuuuuuuuuuuuuuuuuagacagagucucgcucugucgcccaggcuggagugcaguggagcgaucucggcauacuguaagcucugccucccggguucacgccauucuccugccucagccucccuaguagcugggacuacaggugcccgccaccacgcccagcuaauuuuuuuuuuuuuuguauuuuuaguagagacaggguuucaucauguuagccaggaugggcuccuccugaccucaugaucugcccaccucggccucccaaagugcugggauuacaggugugagccaccacaaccggcgaaggauacccauuuuuaaaauaccauuuaauuuaaaguuaccagaugaaagcugcccacuguaauuccagggaaauuuuacucuuaguuuucuucuuuauggucacccaaaucuagauuauuugaauucuucuucugcaguaaaauuaauuauaaucauagcuuccaauuuuuagcugcuacuuauugagugcugacuauucuuggcaucagcuauauuaucauuaauccucauaccagcaauuauuaucaucuccauuguauagcuggggaaacugagauagaguucaaagaauuuacucaaggucauacagcugagaagugacacaucuuggaaucaaacccaccucuauuucacuaccaaaugccuucuccuaacuauauacucuaccccugcaucgcgagcaucaggcaccgagucucuccaaggcucugugauaaauacuacucuugugugaccucaugucacccucacuuuucacucggaauauaaggauucccauucccaugucacaggugaggaaacugaagcuuaaagaaauucaucaacagaccuaguuugcccuguauauagaaaagcucagguagucucauauuuuaaucucuuuuuagccuccuuuuguuuuguuucacucaguucagucuuaacgagucuuaauagucaagaaaauaaaaucauaguaaagaaaacaacaaagguaucucauaaggacaagaacuaauccaucccacuccuacugggcuggcuccuuuuggcaguggugauugcuuucucagaugucuuaauagaagagagaauuugugaaagcagagagccccauuaauaaggaaggaagaaccugcaaggugcaaauaacuaaucucuuguugcuuuccuguuaagguaccaugcaugugucaaaaaucaaaaccagggagcccagccucuaauaugagaagauuccagauuucaaaagcacuagguacuauuugauaaaccaaacauuuucccuguuauugcuagaagcagacacacauaggcacauuugcauccucuauauugauacuucucaaaucauccauaguaaagggcgugugugugugugugugcguguguguguguguguguauuuaaccucuauuuacggcagucugauucaugacccuacuguaaaugacuacuacauaguucauaccacaugugacuugccacacaagucugaucacauuggaacuggucuucuccuuguucaauaggauaaggccaccaauuauauacuuggaugucauggugacuucaaauugcuauaaaguuucuuauccaagacugacaacuugcauuucuucaggacuggcacugauccuccagcgacauuuugaauggccuacuccauaauuuuuugauacaggguagcaaauacuaugccuauaguggcaaggaaguguguacucugcugaggaagucaccucugcagccaccagaaugacauuucugaagccagugagagcaauaucagagagcaucaauauuguaaauacguuuugaucuuauagauaaccugaauuuugcugugugcgcuauuaauaacuaauauuuguaagaaucucaacaauuuucaaaaugcucucuuauauguuaacaaauguagcccuacuacaauccuguaacauaguauccuuacccacccccccacacacgcacacauacaaagaccaccaccuccaccccauuuuucagaugaggauaauggggcuuagaguauuugggugacaaggcuaagcucacauaauaaguuuuacaggcuagcaggaauaacaccaaaguuucauuuuauuugcccacuccaaagaacugauaaugacagccagccaggaagcuacuuggaggcugugucuggguucaguggguaaagagucuuugagagauuagcaaugucugccggguaagaccagauacacuggauacccuuggauagauuccaauccagguagccuaauuuccuuuuccacauccuuuagcacuccacauagaguuguuucucacaaguauccacauuuaaaagagguaaccucccagaacagaaacuagcugacauuuuggaggcaaagucuguuucucuugcgcacugaagacaagaagagucaauuugugauacguguuacagagauaauacacaucuaaacagcggugauaaaugcaugggaauuacaggcaaaaccaaggugauacaaaguuuccaaagauuagauguaucucagauuaaacucuccagauuauacuaaucaauuacagaaauggggcugagugggaguagucacugaagccaccguugauguacuuucccuaaccauuuuaugcaggcauuccuucaugggggucuccucaagucacuggaguccucagcaggggaaaggaaaacagcaauagagaaggagguuaggaucuugggcuucauuuugggagucacaguacuaaaacaucaccucaugauuagcagauaaaaggugcugcccugggcucaggcaauuacaggaagaaacaacccuaaagcagaauucacaacauacugaguucaugaggagggcgaugaggcugauguggggacuggcuuuucuucuuggugacucaaagacaaagccagcaguacuuauuuaaaacaugccacgugcucauguuuaugugaggaguagaagacaacggcuuugguaaaggagaaaauucacugcauaauugaaucuuugaaauuccagagggaauggccuuuucugagaacaaugucuguuauuaacagaagaauuucgaggccaaaugcagaguuuuccaccagguugcauagugagagucauauuuugaauggauauauaguuuuuuaaaaaaagaacucugaagaguuauggauguuucucaauaucuuucucaagaaggcaacagauuuuggacucagcagauaacccuuuauccuauagcuguagugaugaugacaugauaagcuguguagccugagcuuagaugcagaagugaauucugggcaagggucccacuaaccugucuucccugggcuccagacccacaucccuagcuccuuguugggggcuccaacuuguacagccagcacaucaggcucaguagguacaaaguugacauaucaauuuucccaugaaaagagaucuuguuuugacaacacuagucuuucaguuaccuagacucaaaaucuagaagcagcccugcucaccuucaucuccuucacagccugaacugagucaagggucaaaucacauagcuggguuagagauauuuuugacacaauuccuuccuuccuuuccacccacuuugaguuggcacuugcuuaaacacucccuguuuuaccucuggauaguuacagugccccucacuuguuuccucaucuccaguaauuauccauuccaacccauccuuuaaacccaugccaaaaucacuuucauaaagcuuaccuccacauucaaaucucaguacucuaccaggcacaugguggcuauucagguaauauuuucuggauggauggauggguagauggacaauguauuuacucaucauuuacuauaugccugacauugugcuggguauuaaagacagcaggaaacaaaccaacuucuaacaaaacacuucccugcucaugagccuugaauggccaauuaacauaaaugguucauuccagcauucaagcccuucugcagcacagccccauucuaauuguuucacuggucaccuacucucccaucuguccucuagccaaggguuucugaccuuagcacuauugacauuuugagccagacaauucuuuauugcagcugcugucuucuguauuacagcauguugagcagcaucccuggccucuaccuacuugaugcuaguggcacacagccccacucaaguugggacaagcacacaugccuccagacaaugccaaaugugccccgggggagaagagucgaaaagaacccaacugagaaccacuggucuaggguggcgcccaauuuacacccacuguccuagggaaauuauuaauaguacuccccuuucacuuucacauguguuccaguuuagaagacaaacuagauugguucccugcuuaaaucucccgagacagcaaccuugcucuguucucaugcagauugaagaggaaagcaacaaauuaguaugaagccuucagcuuccaagcaacacuuuuuuuuuucuggugaaccggucuccucuuuaaagauucaacuucucucuucuucuuucagcacaugcaguacugggaaguaaaacuggcccaaaugcucugcagggaaaugugaggaucauaagcuauccucgccucucaaaaaagaaucacaaaaauauuuacagcuuuucucaaaaaguuucauguuccaaagauccccuucuacgucauucuaaccccaaaugccucaaaaagaaguucaaagcucucaaguccaucgauccaacuucuucucuggccaaaaaacaauuucgugccauguguuaaugcaaagggcucaugcuguauucacgaaaugccaagacaccugguuaaaaaguucaaaaaaguuaaaaauugauccauaauuucgacuagcaugguaguucucaagcuuuacuguuucagaauucccuggagugcuugcugaauuggagguuacugagccccagucagcagaguugcagauuuaguaggucuagggugaggcacaauaauuugcauuuccaaguucccaggugaugcugaugcugcugguccagggaucuagaagaugcccgcugcucccugcuuauucccucacagacugaaacguacgauauuacgggguuaggacagugggcuugggaaagaagggagggaggucaggagacuucauccggcugcuugcuuagguuuuguguuuuucauuuuuuuuuuuugccaguuagucagaagaaaacgauuuuacccuggccugugcugggcaccaugcuaggcacuagggaugcagcaagaaccagacagaccuugccuccugcuguuuuccccuuuagagccacaagcucuucuaugggcuccaauuccauuccuucuagcacucccuuucaguucaucagcugcuaaucagcaccuucaaucacucuccaaauccccacaagacagcuuccauuuuucaaaagcaaagccaaagggaaaaucaagaguuuuuagaagcaucuccuauuucggcaagugcuucccuuuuugacucugauccauuucaucaaaaacccuuauuagagugguccuucccagguguaucuuuuuaguuaccucuggagauaggaggugcauccaguuuauucuuucugcuuuguuuccuguccagaggagaagagugcuuugauccaacacugacaaccacgucugcaggggccucagacuugcuuccagggaacaaucacucagccuaugauuuugaaugcuucuuuugucacugucaccaaagccugagggaaagcaaucuacacgcugguugaccucugaggcgacugccagaggugccagcuguuuccccuaaacuacuacucacuguugaaugucuagguuuccaucucccagggaagacauugccccagcuuaccucuucaucaucauuugggaaggccagagaagugugggcgaagccauccugccuggcguccucaagacucuugucugauaccagggcucucucugggucuauaaucuuuguucagggaauagggaaaauguccugugauuuguuaaucccuccugugcagugagggggaaguuuuagaguaacuauuuauauuuuugugauaucaggagcaucuagauaucuuugcuuacaaguuuuuuuuuauaauuuuagcaaaggaaaauuuuauaguuuuuagcaaaggaaauuuuaccuuucaucauaauaaaaaauguauucuagaggccauuauucauggguuaauauuaucagggagcuaacgauggcuuaacaagagaugggaagccauuuuggaaguguucuauuauggaaagagggagggccugugacauggauucauauaucauauucauauggauucauaugccagccaugcgucagccaugaguaacaucauuucuuaagaugucagaguuuuucccaagcacauaugcccucaggaugagaaacaacucgucuguuugauaaaaaaagaaaaaaaaaagaaaaaaaaaagauuuuaguucaagaauuuuauagauuacaaauuucagagauucuuuauuccaguauagagacacagaaaucaaaaagaaucaucacucaaauauacauaggucuauuagguggggacaccugguagauguaauuauaguuucauaugccuguauuuaaugccacugaacuguacucuugaaaaugguuaaaauaguaaauuuuauguuauguguaucuuaccacaaauauauauauguauauaugcagaaaaaacauauauaaauauauauucauuaauuagguaucugaauagggagcuaugaucuuaaaaaagauuauuuuuuccuaaauggcaaugugaauuucauguggcuuaaaaucuucuaguauggauuuuugguguuugauaagcuacauuauuuaaacuagaauaaucuggaauuauagagaaguauuuggcuucuggggccacugggacaggggcagggagggagugugggagcagcaccccuccccagccccugcugcugugggaguugggauggggauggcacuucccucaaaggagaccaauguuccauugucagucaacuuagggcacaaaacagucuucaagagagaagagguggaggggacucauaccuuuggugggagauaagccccugcuacaggguaacacaggugaaggucaaaaugacuaguagagaacaccuccugccacuaagggguaagaguaguaacauguaaaauccagcuuuaagcuuuacuuuccuguguuaguaucagacacugcugguugucuaccuacuuucuguucccccuucuuaccucacuaacguaacuccaauuuugagaggaagcuacccuuuuucauuuguucaacuucuucuugggaagcuaaucuuacccuugacccaacuggccuaagccacugauaggaauaggaagaugauacaauuccggucauucacaugcucagcuagcugaggagacaucugugaaacaguuccuuguccaucaaaagagacacauaagaagaaaugagaaucauucuuuuccaacuguuaaugggucuagauaggauggcuauacuacuguaguuauugugugaccaugaagugugcuaaccuugagccagaagccaaugcagggaaauugaagaguagaaagaagggaagauguuauauucuugaguaugacauuuaugcaacugauguaaccauucauuaucucaaagguggaacuauccuacccuuaaacuccuuacuauuggaacuuuuugaaucaugauuucuauaaugugcugccaaaaucauucuacuuaacugguucagaauuguaauucuuucagguuuuuccuaaagccauugaaaaaugguuugucauaaaugacuguguagaguugacagggccuuuggaaaacugagugggugcugaugaccauacagggauaaaguggucauggaacaaccucugcgacaugaagauauggcugcaagcagcaagagauaacaagcaggaaggcccagagcagugauccauagcauaaagugacaagugacaggagggacaggcuugugggacauguaaacaagcccuaugguucuucagaaauacgaguggagaggaggucauuuaagacauugaccauguucagacaugcagaguagaggcuugggcuaugaucaucagauaccaaaagaaaaaguaaaaagaugaagauuuuagagggauucagauaauacuggcuauaaggaauaucacaggaucuccugccaagaaaaugagauuccuauaugauuucuuauaucucuccauauguuuccuauaagaauacuagccaucaaaaugacaaauucaaauugguauauucagacaaauagaaagaaaguauuucccuaucccucaaaugaguuggauaaccaugaauggugagucagaugagaaagaaaaugcaacagcucucacucagaccuggacaaaauguuaaaagauuuaguaggauggucaaaaacauaguuuucaccuuaacugcuuacuuucaacucuucauuggaauaaaugcauauaggccaaauuaauaaggaauaaguaguuauauuuuagguuaauaguuguaccauuauuagaaaaaaucugccucauauaaaugcagccaugagcacuuccuccccuuuaaaaacuaguauaauaaaaggaaugacugauuguacuuggcauauuuccccucucugugguugcauuucacugcaguuaugaaaacauaauauaauuuuucccaaggccaugguuaccugacagaagcauuuaaaaaccaacuacacuuuggacuuccaggcacgugugugugugagucauaagacaguucagaagagaaauucauauuugacauccagagcuccaucuucccgccucaagugucuguguggauguacuuacuccagucuuaccugaguuucaauaauauggguuugucacagguuguuaugggcucuaacuaacagcuguccacugcacugagaacuauuauuuucagaggcaggucagaagcccauuucugacucucacgcauuguaaagaaaugcugaccccaaagugggauucuuucucaaauacacucacccuguaagcaccagguagagccaggagcuuucaaaagugcucugaguuuaaacauuucacagcaugaggaacacagccgaagagaaagugcaagaaaaacaauauaaagacauuauuaacugugugaucacacaagagugaggccuccagaugggccaccucauaguuauugacgagcguuuagagaagaacauucauuacucgauauugacgcuaacgagaaaggguuugagagcaaguuuaaaauguagaaggaggaaacacccaaaccccauccccauggcagcuaauucacuguucccaacaauucugcaugcuauuuuuuuuacuccccuuguucauaucuuauacugugauuaaacccaagcauucugacuguaaacccuuuuuuucugucuauuucgcauaggcuugguguguuaaucaaacugucagcaaaggaaaaaaaaaagaagaagaagaaagggcacauucuauccaaaugaagaaaaaucugagcuuucuacaacaaacacauuuuccaguggaugagcuucucacacaguaauuauuucacuucucccagagauuacugauuacaucacacagaaaaacuaaaugagggcuguuuuaucuuucucaucucucugugguucuugugcaaacuuauacuuguuaucaugaaaaaugacaaauuugccaucugaucaaaauguuaacaagguaacugucagugagauggaucucugacugucacugcaagccagaacaugaggauacauugauauuucucaauacagccccugcuuccccaacguucacuaacuacauuuccacaguaagguaauaaaucacucagaaauaacgagcuauauaggaucucugggguaugauagauguguccuaacagcacuaucugcaagauagaaaacaauugauaaugaucuaaagaaaacccuaaucaacugccauuuuccauaaugggguagaugaagcaaagauaugaaaucuuaacuaugugaugcauguuaugacaaaaccggacugcuccaaaaaaaacccacacagccccaaacaaaacacaaaugaccuaacauuacguagggucgaauaaaugaaaaauaaaguuaauaacacagucuggauacaaacauuauauuggacacuggcaaugaugggauaaucacagcaauugcuggguccacaaacagcuaaauaguggaggguuccucauauaacaugaaugaagacucuggcucaguuauugguuuaaugaacucuccuccaauacuuuuauguucuuuaagacucuuugggccacauuauuucugagccuuuaauucaaugguuuaaccaaucauuucccccacccccccccccccgccccuuagcaacguggccaagugccacauccaaaggaaccaagagagaagaggagaaguccauauggaaauaggagguaaucaaagacagaacacaagauagaaaacuucugcaagaagaucauggcuucagaucacagggacaaagaagcauggcaucaaacugccaagaagcugccucauaacgacaucccuuuagguuuuaagguuaagaagucucacauagccacaguuggucuccugccuguccccucugcucguuugucuuuggccauuccugcuucugcuguuuguagaauacuccaagcgccuucccuccccaagaccuugugccugcucuucucucucucucagggaucucucuccucccuggcuccuucccuucauccagcuuaaaucuuccccaaggaaccugccuugcccuucgguuucaaaguagccucuacuaccaccccuuuggucucuaucagcuucaucgauagcagaaagaaccaugucugucuggaccacuguaauuuccaggcuucuagcacuuucucuucucuaguagggauuaagcacagucccaauccugggcucugggauacaggacugacuagccuugaaucuagugccacaacuaaguaccugugucccacugugcaagcacucaauuucuaugugccucaggucccucauuuguaaaacagagagaauagcaaugccuauaaaugacagcguuuugaagacuaaaucacuuuaucaauguaaagagccugagauaguaucaggcauacaggaauccaucaaucagcugcuguuuuuauaagagcaagaacagagguaauucagacauaaagugaauuaauucaugauuauagacguuagaucaaugagucaccuucaucauuccagguuuuuauuuuaccauuagccaaaacaguauugugcuccuucuaauuccauauucucagacuacauggaaugaauggguauuggucuuuaagccucuuugagcaaugccaauaaauacagucacuuccaauuugagggcacuuggaauagcagugcuauuguuccuuugacaucucaacagcacuugaaagugaaagaaaaaaaaauagauuaauggauguauucccuaaagcaacaaacauguuugauguauaaacauauguuaugggcaaugacgcuguaccuuuggugccacgucucaacaauucucuuuucaucuauccccuaaucaugcaacugaaugcuuccaguaggccacacaguagggacaaaaugauaguaagaccaccuggcuauagauaccugcuucuagagaggccagguuccaacccauuacaagcugauaaccauauguaugauuuuugcuacacuggccaaguauuuggaucuuuuuuaaacauauuugauuauuuacccuuugauuagaauuugugaauaaaaaugucuuuuaagagacacaaaggaaggggguacgggcaauagcucauuacuaaaaaucauuuuaguguggaaagugggcuucacuauuccuauaaggcagucauuuucaaacuucagagcaucacaagcccccuguuagauucuaauagaacccugaggaaaaugcacauacacauaaauguucacauauaauuucuacagguugaaggaccucccaaaacaaaacaaaucuaucaaccacaaacuccaguguaaaaaacuggcucuaugaagacuucaaaucacccucacuuccuuugcauauaaccauuuuuuucuucagacaaauaaaaaauacaauuaaguuuaauacaagaagaggcuaaaaacauuaggauagaauauuagaguuuaaagaucuuugccugguuauggucuaaagauauuugcuuugauuaauauaugguguaacucauuaauuaaaugcaaauugaaauaagauaaaccuguccccauaucauuucugguagacaauaaugugccaguuuucucuccaauaaauuagaugaggcaagcuuucuguuacuaaauaauagcaauaugggacaggagaaaaaaauuuaccaugaggugcuuuggaauuauucacaugaagaacuuuuuauuucuuacuuucuuuuucacuaaaauaguacuuuuucucauuuucaaccaauuuuuaaauaugagguguuuacauugcuuacuguucaaauuagcauugcauacuuucaggcacagacaugcucaaaauaggagucuuuugaaaugccugcauucaguauaaaacacacugcugguaggaaaugcaaaauguaaaagucuuaaaauacauuuagauauggaaaacaaaacauuuaaaacauauucacacuuuaacauguuuggaaguauaaaguuaauaucguuuaugaaacaaauuucaggaaucauacuauugaaacacccucacaucuucaauuagcuggauuaaggaaaaaaaauauuaacaauauuuaaaugcagaaaacagauuaucaggaagagagaucguuauagcaccuuguuuucacuaacaagcagagcagacuguaauugaguuuuagaaaucccugaggugguaacucgguagagaaauccagacuuggcaaggaaaucaaguuucccuuuaauuacauuaucucaaucaaagagauaacuuucacaucccuacaaagcaaauguuuuaaggagaagucuggcaaggaaaguagguggagguacagagggguuaagaguuucaaauaacuucauauugguaggaggaacauguagaaaacugaaguacacugugaggaagaagacagaugcccuggcaaauggugcugcucccaaaaacauaugacaccuaacaccuugguccauugguccugcuuuccuauaucagccuugguuuugccuuugucacugaagaaacauggcauguuccuuaguguugaacacauaagccuaaagcugaucuacaguuucuuaagcugauaaaaggcaaagcuaaaaugacuuuggccaugacuaugcuguucggaggaggaaaaugagaauguucaguggaaauuauuuucuuggcaguguccuuacuaggucagcaaaccuccauucuuuccaaauuuuccgggucuccugcuuauuucaggacccauauaaggaggauauaagcagugaugugugagagcugguuuguaccagaucacaagagcuguuuguauaauuuucagaaauuuuguaagcugguagcuuaaaaagccauuaaaaauuaaauuguguaauuugaaaguaauaaauauuaaaaacaaagggaagaaaauauuaaaaacucuguaauuccucauaaugucacuacauuuuacuauugucuaugcucuuagguuauauacaucuguauuagucuguuuucaugcugcugauaaagacacaccugagacuggguacuuuaaaaagaaaaagagauuuaauggacuuacaguuccauguggcuguggaggccucacaaucaugguagaaggugaaaggcauguuuuaugugguggcaggcaagagagaaugagaacgaagugcaaggguuuuccccuuauaaaaccaucagauuucaggagacuuauucacuacgacgagaaugguaugggggaaacugcccccaugauucaauuaucucuuacaggguccgucucacaacacaugagaaucaugggagcuacuauucaacaugagauuuggguggggacacagccaaaccauaucaacgucuauuguaucuugugguggaaauacucucaguagugugcuaccgcacgucucuuuccaagucugugcagugacaucagguuuguagcuucaauucagccauaugaacuggaaacuggaaacacuacagauuaacuguuuucuuggcuaucuagauuuaagaaagugaugggggaaaauaaugauuauggagacaaagcuuaaaagcauauugugucaauagcuguuacauggugaauaguacaaaaaauuaagaaaauacccuuuaguguucuauaucuauuaucugauuuggcaaaaaugucacucauaugauugacaaaugaguaaaguuuugacauauauucuuaggcuucacuuuugucuuguuuauguaaacaaaaaugucaaccaauauucaugucugaagcacaccuguuuugucagugacaugagcaacuuugcuuaauuggguaguaaccaagcauuuauuccuuaucugaauuuucaaaucauggcugaaucacaaucauaaguugacugugauuacaggaauucaacaaacauuaacaaaagcauucugugagaaucaaauuggcuauauagaaucuaugauaaagauugguguauauuuuaugauuacucacaaauuguguggugcacauuuuauaucaguaaaauuuauaauaagcagucagauguaugaggguauguggauauauguuuuuauauauacacacauacauacacacacaugcauacacaaaaaccaguuguuaauauuuaccagcacaccacuggauaucaacacaauaaagauauacuuuauuguguaucucagcaaaaacugaccacucaacuuuucuagggacaacuuuauuaugguuggaaacuagaggcuaagacauuuauugugucauuguugaaguuccguaaaaccauuuccuaucucuaaaguuauuuauuuggcuauaaugccaagcuacaccagcuacuuccccaaaagcaaggcuaccagauggugacagauuugaaagcucuuucucauauuuugaggguagguaggggagucacgcuaugggacaguaggaaaauccacuuuuagcaggcaggauagaaugggagaagucaacaccuugucaguugccaaugagcugcugagaaguaguuacaggguauauagcaggauaguauuaaacugaaaggucauuaaugugagauccuugggacaauaugcacucuguaugucucaauaauguuaaaagauucuguacaauauuugauuguauccaaauaguuuauaacuguaacauuuaauuucaaggacaaaaaugaacuuaagucaacuauuccugugguuuuacauuucagagagcaguaagaaaaauucaccaaaacaaaauaaagcaaaacaaaaauggagugccaaaacagauuugcuaauuuuuaaaaauguguucaaauaaagauauuuucaaauccuuccuuuuauuaucacccuuauggcgcaaaagaaagcucaucaguuugcuauuaggaucauuugguagcacacaaaguccauuuucuauauauguucagaagaggaaacaggaugagcauugggcucagccacuggagaucacagcuucaucaugguucaaccucaucuucagacacugaaaauauugcugaagaaacaggaagcagcauugagcacggggggcugccauguguccucuccacugaagauagucugaaggauacagugaccgcaggaacaaaaaugcccucagaaacagcccuaaagggcuucuagaaaguacaugcuaccugaugcuuuuuuuuuuuuuuuuuaacgauugaugucucugauuugauuugguccaagcuauucugagaauucaugauggaaugagaacaucagcaacugcagccuauuggauuucgguuuaguagaguacagugcucuguuugaucauccacuuuucaagagccagcuucacauccuaacugcaucauccuugcaaagcucugcuacuuugaaugcugcuuuuuuucagucccugaaauacaugugccuggggugucaccaacagguggguuuuuuccucugacuucuuuccauguaagccucaaggcauguauaaaggacaugagcgcugcuuucauuuuccaaaagaaaucagcuuuauacugggaauugcaagcacgugccagguuucccauagugacuuauaugaacucgcacauacucagggugaguaaaacuagcaggcaggcaggccucaaccaagagcacauuugcuaguuuuucuugaaauguucagaacucuggcccuaagagaagcuaaugccaggcaaucccuugcaaggauaggaggguuaugggaucaaggcaaaagacacauuuggggaacaccauuccauugggcaagcucugauaugcagaaucuaaggcagcuuucuggaccucugaauaucauagcaucgcaguggcuuccuguggcucugugguuacagaacaauuucuaccaaaugaagagaaugacagaagcaaggaccuccacauuccuaucauaugugacagucuggaaaaaggcaguguucauucuuaccucuccuaacuucacucgcucauucccaggugagccugaggccacauuucaccugagcaucccagcuccuacagucagaggaaagaacaaacuucacucccacugaauuaggaccaacuauuuacuagacacugugcagguauuauguuacugucucagucuguuuaguugucaccauaaagaaauaccugaggcuggguaauucaagaagagaagaagguuuaucuggcuuauaguucugcaggcuguacgagaagccugguauuggccuuggcuucuggugagggccucuggcugcuuccacucauggcaagggugaaggggggcugugugugcagagaucacauggggagcgaggaagcaagagagaagggaagaggcaccacacucuuuuuaacaaccagcuuucaugggaacuaacagaguagggaguaacucaccaacagagaggucauuaaucuauucaugauggaucuacccucaucacccaaacacuucccaugaggccccacuuccaauauuggggaugaaauuucaacaugagguuaggagggcacaaacauccaaaccacagcaauuacuagucaauuauuuccgcaguccagugagacaguuuucugauacuuguuuacaggacaagaaauuaagucuuuuuugucuauuagacauucauuuauugagaaccaacuauuugucagaaauggugcugcagggcuaccagagaaccagacaaauguggccccugaccucauggaauuugcauuccuguggcacucaaagaagugaguaccuaagcagucaguaaauaacuuuggcuggcugguuggcuaaguguguauggagcagggaggcuuggaagggggaaaguaacaacauggaaagaaaagcaauugugcagggauuccuagauaauaagccaaagacccagaauuugaacuucagccuaauucacuuuugacuuuaucaagugacauagccucgcagaucccccaucucuuccuaucucauauuaaaaacgaaccagagcaagaacaguagcaguggaaucuuucccauggcccaucucuguucgcuggagucugagcaccaucuuugggccaaaagccuggggaagaacaggaucuaaauuccacauuuguggugaggacuagaaaguuucagaacauugcccuuuuaaacucaucuuuauuaauauucuuuaagcgcacagguaaugagaaagugcaaauacagcccccucuggcugcagcagucagagagccaagaaaaaacugcaugucaugccauccuauuauaauaacagauuaaaagggcacaaacaggguacuaauuagcagucauaaaaacuugaagcuccagauugcucaucuucauaucugggcaguaaaaguaccacgugugcagauaacauagaaguaaaauaccagggugcaauugcccagagcucagccagcaucagcugagagaagcaguugcauccagcagcacauccuacacuuucucaagaauccaaaggcauucaggugacugcccaagaauuaaaaaucagccagcccagagagaggcaagugccuccuaacucagcaagggacagcgggagaccuugccaacuucugauugaucgucuucaauucccuuucuccaagauguauuccuguccauggucucucccuggauuuuaugcagaaagcuacuucugagaaaugagaggguuuuauuagcaugcaggggccaaaguuuagccugaaggagagauaccuucaucaauaaaaucuuuuuugauuaaauucagucuuuuuucuugggucugcucagagcuuggaaaauaagacggguguacuuucuaacuuuuauccccaauuuguucccugaggauuucaaggauucuguugccaucggggcacucugaaagaagaaaggaaggaguaugcuuucuuuaacaaguugucucuuaacaaauucauacccaauaauucaggcuuggacauucacuguacucaccuagcuuggccaaguggcucuguauucuauguuaacugugaucuauaauuuuaaaaguagucaugcauagcuuauauagagaaccaucuuuuaaaaaauacucuaaauuuuguucuaauaaggagaaaaguguaucuacauugcaugugauacugaaacuagacaaauuccuuguagccuuuuaucugacaacagcuaaaaggcccaaauugaaggcaaagcaaugaugcaagugaacuauacaauaagcacaauuguauucauuuuauuuccaacauuauaauaaggaccauauauuauucacugguauauauucucuucacuguacagugaaauauaugggaaaaaaucaagacccuucucuuuuaaacauuagcucuauaucagaaaggaaauggucuauauuuauugauuuucuuugagggaucuagguaaauaucacagggcuaugacuggguccuagucuccauaccaccagugauauggcuuguccaacaugaccuuuagaaagacucagaguuuggcuuuguguuucucaucugucuuagucugcuuuugcugcuuuaacagaauaccugagacuggaagauuuauaauaaacagaaauuuauuuggcucaugguucuggaggcugggaagucccagaucaaggggcaagcugcauccagugagggccuucuugcuaugucauaacauggugaaaggcaucacauagccagaagagagggugagaagggcugagcuaguguuuacaagaaaccuacucccaugauaacaacaucaauucauucaugacagcagggcccucauaaccuaaucaccucuucaaguucccaucugucaauacuguuguucuggggauuacguuucuaacacauaaacuuuggaaacacauucaaaccagagcaccauccuauucucaguaauacccuuugucuuaauuuuucccuacuaaccugggaugauauucaaagauauucaacaaugcuugggcacugaccaauaaaaaugggacuagacaccaggcaucaagaggcaguccagccuuucuaauucauacugucugacauccauccagucccaauuguuucaaagguucuggugauaauaggggccaccucucccaaauuugccuucuuaacuggauuccuaaaaggacaagucaugaaucucuaaucauaauucuagcacacguaccacaggccauuaggaaaacuauccucagauaaaugaagccuccccauacccucaaauuacaucaugaaggugagacccuuagcauggucucugacucacuaggcaaccauggccaagugauuugcauucuugagaaaaacuuacccuccuuauaacagagaggaggaucccucaaagagauccugaaagcucaaguaggagaagacacuacaacgugguuggaaugcuucaaaagauaauacuuucuaauccuaagacauaauugcuaauaaaugguuucuuuuuuacguaaggucaaagaauuuuuaauaaauacagucuuuggugcucauuaagaagacacuaauucuucauggguucauaagcacacacauaagaaaaaucugcagcaacaguacaguaauaaauguaaaauccuaaugagagaacauacauuggcuggaaaaggguauuguucuuuucuuccuucuuuucuuuugcgaaugauauuguaaugaauuuucuucagaggacuuauuagugucuguuuaauauuaucucucucuuucaugugaaaacuuuccuuagaaucuuaggcaaagcuuuaggccuucaaugaagacgucauuaaaaaauaauaucuaagcagugcucaaaauaucacauuacaacaaguuaacagcacugucauaggauauagagaugggaugauauuaacuaucagagauuccagccugaucuaucaguaauuucauuauuuccaaguacgaaauuaacuucuuugagaggauaaagccugcagggcucuggaggccucuuuugaucuaagcagauuauugcccuguggggacuccauggugggaauuagaucugcguucuuggugguguccauagcugguucuccauuuucuacauuccucauguuagaauggccauaaauacggacugagcaucaaucugggacucuuuuucagauugccuagagggccaaacacuggaaaagaaaagggcugcccgugaaacuucugguuccugccuuacugagggcuucaaggaaaggcuggguuuaggguuccugaacacucugugcugccucgguucauuuccuguuggggaaguucugaaguucaucuguuacauucccaaugcuuauguuaauucauaugcaaaaugggaacccgcuuaacuauugccuuuuauuacucugaaaucagccaaaccagcuuaugcaucuuagcagucuuaaaucagcguuucccaaguaugaucuuugaaacacuauuaccaaaaagcugcucaaaagagagagagaaauuauaauaaaaauaucauaguucaaaguacuuuggaaaugcugcuuauuaucucucuuccguuaguuucacguacaaugcuaaggucaaagaaguucuucaauaaagaacaguauuuaauuuugcuuagcugagcauuuuucaauguuacuugccauagaauuuccuucauuucucccccccaacacuggcucucauaaucuguuaucauucugaagaacaaagagcacacacuuugagaagagauggcccuaaguuaaucagcacacugcauuagguggcugcuaucaauuuugauuuaauuacacaagcaugcacucagcauuuaugcaacguaaggucagaauaaggguuauguacuccucaaggguagguucccaaauuggugggauauguuccagccccuccaaggacuuacacacuuuccuaagaccugaaaagcuaugguuuaaaaauaguugaucaauccuuccaguuguccagcuggggucaguugccaacucuggcgggcaaaauaucaggaaccaaggacacaaaauaugaggaaggcguggccucuucccucaaggaggcuaccauggacaacuaaccacaaaccaggaaaagcaugauauggaaaagggagugguuuauucugcaugaagggaaaaggaagauugguaaagacacaggcugcuaagcggggcuccagugagaagaauucccauugcuggguagaagaggacagauggguaagcaaccugagaaggacugaggcugcaaaugugcagggcauggccguucuaagccagucauccccccgacaucacagaugaaccaacaggacaaaaauuuaagaguuccaugauagaggaggcaaaccuuagccaauuucuucacaccaggaagccacugugccuauauucugaaccuugcugacgguaggucuggagugggccuuugugucucccagcagcaggcauacauaggagucaucucuucgaugggcauucacauagggcuaggugugcccuugcuuuauaaaacauauggguucuuaaaaauuggauauuccuggaugucuuguaaguaaaaucauuuuacaugaccaugaggagugauccauuuaaaggauccuugcagggaagacucuggggaacaaggaauccacaugcacucugagauuucuguuuagauuuuuccugaagagcugccucuuaggggacuucugaauuuaaagagacguuagaaagcagacaugaugaaacugcguugucuccaaacuaaaaacaaaaagaugaaaguaaacuuaaaagcuacagaugccauucgacaaugauuugauguaaaauaauaguccaucuauaacucaauuuagccaaguccauaccuucugagauccuugacuuaccuaaaggcucugucuaaauagugacccuauaucauacaaguugaacaacaacaaaaggagaaacuagcagauuuuuacaucaucgggagggacauagcuggucaaacaggcaguaaaguuugagcacaacaaagcgagcuuugaaccuccuaagcaaacugacaaauugcgcucaggaguccaguucccagcaucagcaccacuuugccacaauggcuugucuccuaucucuccugccuaauggcuuuccaugccaaggagggcagucagugugaugaaaauaaccaucaacaaagcauuuggugauuagucgucugcuuuuuuaaauauaaugccugccagccaagauugauaaauuauuuuggucauuaacaaucuauuuaacaacuguaaauuuaaagugaucacuuuccugaggcuuaguguuauagagguuaggggguagaaucuauuuagccagaguuaagagcuggaaaauuaagccagaacacgagaaacaagauuacaaaguaguauuccucagugagugcugugaagcuauauggaaucaggcuauuaccaauggugggggauauguuuaaucaccucuuaaaggaaaaacaaucuuaauuaauguuguaugucauaaaaauauaauuuagauggggaugggaaauugcuaaagacgaaacccagagcaaagugaagacuugguucaaaaugaaccacccacccaucaauuauaaaaauauugcccaacagcaaaucaaagaacaugcucuuuggucauauuugggcagccugaaaacacugauccuugaaaagcguuuucauacuuuauacaaaaaagauaggaaauauuuaaacuuacuuuaaauuagaauuuuaagugccauauuuaaaaagcugaauuacucauagacacagucaaaguuaacacacuauauuuuaaaacuauaucuaaaaaacucauaaauauguagucaguuguguuggucagugaacaauauuauuaucuuuaugcugcaacauuuggaccgaacauuucaccugacuaaaguuuggcauugguccacuuguuuuauuugaugcuuauaggacauccaaagggaaacauagcaaauuguuucuguagccuauucauuaguagcacagagaaccaaucccagcuucaaggugucaacugguguugcaucccaggccccaucuaccaguaguucaauaaggagcaagauggcaggaauaagagggaaaugcaucucccuucagcuuucagguuuuagacuacuguacauggcucuuuccaaacaagaagaaaagaauauaacaugaacugauuggugcaguaaacuaaacuggauuuauaugcucuaauauggaaaaaagaucccuagaacugauccucaaaagcaucucccauuaauggagaaauaggagaauguccccaagggugaaagucugggaccagcaauauggcaacauuauaagugcgcugaacagcauuuuuguaggaaguguguucuaacugccuuuguaaaaggaaaaaggaaaauaaaacaaagcagcuggacaauaccauuuccacugauuaaaguucaggggagccugaaaaguuacuuaugagauauaguucaaccauuuucccccuugcuuucagauuuacgugauauuaacuccuaugcguccacagcagccccaugauccgccucagaggaauucagugccuaauacuugacuaggaagaaacauuagguauugaugggcaaagaguuuucaucucaaaugccucucugaucaacuagcaguagcucuuguugaggaguccgaggccauauuuaaacucaguggaaaacagcagcaugggaaauuagcaguuuggcauagagauuaagaacauggauuccagcagggagcaguggcucaugccuguaaaauaccagcacuuugggcggccaaggcaggcagaucacuuuagaccagccugggcaacauggcgaaacccugccucuacaaaaaauagccuggugugguggugcacgccuguaguccuaauuauuugggaggcugugguaagaggaucaccucagcccaguaacgucaaggcugcagugagccaugaucauaccacuguacuccagccugggcaacaaagugagacccuuucucaaaaaacaaacaaacaaaaugaucauagauucuaaauacauauggauguuugaauccuggcccuauuccuuaccagcauaacaacauaaccuuaugagguuauuaugaacauuaaauaaauuaaggcaacuuucacaaugucuagcacauaauuuacacuucauaaacauuagcaucauaaccaggaggacuaauugccauuguugcuaauuggcauugcagaguagaguuguggcuugucuuuugcccaucaggcuaucuguguuucagaaucugcuccucaacucaaguguaaaacuuacaagcagugguggagugggacaagucaaaucuacacaguucuuuauaugauugaaucagugaacuggauagacucuaccaccaagaugugauguguugcgauggugguucuguaguauguuuggaccgugaaagaucaaaaagucuuucaaugauucauauuuucagggcauugcaaagugaucaauuugguacauucuugacuuaaaacaaucacuuggacuucuccaaacuucccagacugcuaauaacaugcaauccuacuucuaaccaaagugaauaaagcaucaaaaggaaaccuugguuucaucccaagugcuaccagcugcuuucacauauugaaaguuuggcucuaccacuaacaggaaaggaaacacuuucaaaccuggcaggugaugagaacagacuucagaacuuggcuacacugucaucagacaucaggggcuggaauuagggcagggguucucaacuggugacaauuuugucccacaggggacauuugacaaugucuggagacauuuuugguugucacaacugggugggagguguuucuggcaucuaguggguagaagccugaaugcuacaaaacaucucacuaugcauacucucacuccccaaacucugaaucuucggguacaaaaugucaguagugccaagacugagaaauccuggauuagcacggaacacagagcaguguggacucauugcuaaauguuuuccucacuauacuggaggcuccagguaaguaggaaucauuguaucuucagugccuagcacaguucccaguacuuagcaggggcuauauuaauuuuuguggagugaaugcacuauaauagcagauauuaaugcaggucagcuaccauuuuucuucacagcagagcaaauauuucuucaauauuaaagucagaaagcaaggugaacagagaagacauaucagaacaugacuuugcuuauuugggcaucuagcacaucagacacuuccaauaaaucugucccacuuccuucauucccuaucuucccuagagaaguaacugaugccacauccagaaccuaacaauaaguuacgucaacuugaccagcaccaacauauuucuagaauccacuugcuucucuccuuccaugaagccuaagccaccaucaucaacaucucuaaugagucacuuugcuuuugcucuugaccucuaacuuccauucuccacagagcaauaaccauauguccuguuaaaggcguuaaucagauuacaucccucuuguguuuaaaacuugcuaacauccucacgggggcuuaaaacaucuuacaaagucuggcaccugcucaacucugcacuacaaucauagcggucaucuuccuauuuaaccaaauuguccaauuccuuugcuucucagagccucugcacuggccugggaaugcucuucaucuagauccuuacauggcuggcacuuucacauaauucaggaagugguuuaaagucaacucgucagagaaauuuuuugacugcacagaaucuucaccuguguagucagacaaguuuucuugucuuuagauuaugaggcacaaucugagagcuuuauuugcucauuuacgcuuguacacuggcaucccucccagacuggagugucagcuucaugaaaacagagaaccugacuguuuuguucucugcugugucccaagcaagcacagugccuggcacaauguaagaagucaauacacaucuguugaaugaauagauaacugaggaauaaaucgaugaaauaaacaguucauauacaugaacuagucagagaaaaaagaacucaucuaaaagaaaauauguguuaacugucacuuacaaaagaguugccuagaauuuucaaauuaaacuccaaauagcauccuuuauuuaacugcgaucaauucaacauaagacugaaaaucagaauaauagaggguaguuaguguucaucuagcaccaagaguaacucagaaauuaaauuaacaguuuguuaguauaaaucucccucguucucuuuaugaguacuaaauuaaaguucauccuauauuuuuaaaucuguuacaagcaaagagacaaugaaauaaugaaaguauaaugaaauaauuuuacuaauucuuaauacauaaccauagcaaugauuuuguaaguuuccaaauaugguucagcaguguggaccagcauggcaugaaaauaaauuuaaguguguuuuccuuuuauaauuuuuauuacugugaaagaaaauaauuaagguauuuaauauucacaagcaguaucagaggcaagaauacgaguaugacauuacugacgaaaucuggaacauaacgcaaguguaauguugcuuuuuuuggaccacgugauauaucugaaugcaacaaggaaagaagccagaaacauguuagcaacgauugggagggugaguugaugguagcauguagagucaagcaaagucagaggcugugacaaaccaugcugaauuagcacaugcaguuccucuuggucugccucccacccaccuuuccaacugcaguucuuaucacuccaacaacauccccaaaacuugcaggguucuaaaguuuauauagucuugggguaucuguguccuuauuuacaccacagcugagucuaaaagaacuuucugcaaugauggaaaugaucuaauucugcacugucuauugcuucuguaucgagaaacugaauuuugcaaagcauuuaauguuaauuaacuuaaauuuagccacaggcugccaaauugcacagcacagcucuagacacccucccuauagucugcaaacuccugcucguccuucaagacccaauucaaaugucucuuccuccagaauccccuuccucuuccuguucccuaaauagcagguuucauggcuuuaaugauaaccauuuaucacauucuauuacaaucauuuuaugguauguugguccuuccaacuacaucaagaaucucucaaggggacagacucugccugacucaucucuaaauacucaguuccgugcuuggcacaugagaauuauuugauaaauacuuguuggaugcucaagugaaauaaugaagccaucuuuagacaugaacaaauauaagcacagcuuaccagaaaaguucuucccaggggaagguuuacuccauuuauauaagaagcugcaaaccagauauagcuugagcaucccuaaucugaaaaucugaaaugcuccaaaugcuccaaaaucugaaacuuuuuuuuucuuuuuuuuuuuugagagggaaucucacccuguugcccaggcuggagugcaguggcgcgaucucggcucacugcaagcuccgccucccggguucacgccauucuccugccucagccucccgaguagcugggacuacaggcacccgccaccacgccuggcuaauuuuuuguauuuuuuaguagagacgggguuucgccguguuagccaggauggucucgaucuccugaacuugugaucugcccgccuuggccucccaaagugcugggauuacaggcaucagccacggugcccagcccaaaaucugaaacuuuuugagcaccgacaugaugccacaacuggaaaauuccacauguaguguuaugaugggucacaguaaaaaugcaguuaaaacucuguuucauggacaaaguuauuuaaaauauuacauacaauuaucuucaggcuauuuguacgagguccauauaagacauaaacaaauuuuguguuuagacuugggucccauucccaagauaucucacuauguauacgcaaauauuucccaauccaaaaaaaaucugacaacugaaccacuucuaggcccaagcauuucagauaaggggcagucaauauguaugaccuucagauuugauaguauuucaccauauuuguauauaugugugcguguguauguuuguguguguguguguguguguguguguguguguauuugguagacacugcuuaccaauguuaaaaacagauuuccaacauuucuugaaacaaauauuagaucuggcaauuuuagucccauauuugggcuuggcaacaaugaacuagaauguaacaagcagcugcaucauuuagauaauaaauauccucuacagaaucuuuuuuuuucuucuuuuuuugguacuuuuaguccacuguugucauuuauggucucugucuuucuccugcagccaugugaccuuacaacaccagacaaugaaugaagagacagaaauuucaaguucagacauugauuucucaccgacauuaguaaaauaacaacagugacaauaauagcugcaaaaacaacaauaauaauggcugguaguauuuauugaacaugacaugccagguauuauacuaggcaauuaauagacauugucagauagaauccuccuccaugaccuagaaaacagccuuagcuucauuuuaucaaugaggauagugagaugcuaaggggcaagcugaaaacaaacagaaaggucuuccccuagucugcccaccaucagaguccucacugccaucucuucauuacaaggcgacaucccucuucacuccuccauguuccucccagccuggauuuagacccagagcacaagacaaagugggaccuugggcaacugacauaaccuuucugcauuuugcuccuccacucacaauggacuucagaaauaagagcugacauuaccuccagggucacaugcgggcacaugagaugauguaggucaaacacugaacuucucagacacuuuucacaaauggaaaaugaucucaucugagcaggcagagaauggcuggacaaaggcugacacaucuggaguagggaggcauggaaaggacugaacucucuuaagguaaauaauggccuuguggcuuuugcuagcacccacccucaaggagcccucaucuagggagagcaugucuuuguggaacuaauacaaauuuggcuccaugaggcuugccuagcuucgugccaguuaggugauauugaaaggaugcaagucaauggaagguuuaagaaucagcuauuguaggccaggcgcaguggcucacaccuauaauccuagcaguuugggaggccgaggcggacggauugccugagcucaggaguucgagaccagccugggcaauauggcgaaaccccgucuguacuaaaauacaaaaaaacaaaaaaaaaauuagcuggguauggcagcauacgccuguagucccagcuacucaggaggcugaggcaggagaacugcuugaacccgggaggcggagguugcagugagccaugauggugccacugcacuccagccugggugagaaagcaagucuccuucucaaaaaacaaaaacaaaaaaaagaaucagcuauugcaggccuagcacucugccaggccaggaguuggcaaacguuuucuauaaagguccagauacuaaauauuuuaggcuuugccggccauagguaaacaaaugaguauggccauguuccaguaaaacuuuacuuacaaaacuaggccagggcccacagguaucguuugcccacaaccccugugcuaggcaccauggaggcagagcagaggcucuucacagucauccggcacaaucaccaggggcaaagcaugaagcagccuguuggauuccccacucugguagccacaguccucugagguaaaggccuggacagcaagaaugacuuaagcaacagacuuucuugguggcuccagccccagacucaccccacagggcaugaggagagugagccucucuuucccaugaaugguuccucccagcaguugugcaggccuguccgcagaacaggugaggcuacauggccuucaaccacgugauguauuggcuccucugacuaaaucaaaguccacagaugauaggccuacaauauccaagaaguugccaaacaaagaugcuuaaauugauacagacaaaacuaaauaccucuccuucccuugugccugcuuugacuccccuagaugccaucccuggugccacuucacacugagcuaucuccuugcacuugaaucccccaugucucauuaccauguguauaucccaagacgggguggcuccuguuguaggccacauauguuugguuguuguuuguuuuuuuugagauggaguuucacucuguugcccaggcuggagugcaguggugcgaucucagcucacugcaagcuccgccucccagguugaagcaauucuccuacgucagccuccugaguaacugugauuacaggcacccaccaccaugcuuggcuacuuuuuguauuuuugguauagacgggguuucaccauguuggccaagcuggucucgaacuccugaccucaaaggacccaccugccucagccucccaaaguucugggauuacagacgugagccacugcgcccggccaggccacacuguuuaaaaucuaugcaguccuucuuugauaugauaaccuugggguuguuuauauuucuuccaaguguaugaccaacaggaugcagagaagcaaaaguuuucuuacuguuuugucuguuaacguaaccucccauugucuuuaugcuuuuguuucuguucucauuuaauccuguuuuccuucacaggauuaagucugcucauuucuaaacuauugucugaacuuuaauauucuaacaugucuuagugucauguuuacucuucacuguuugacuuucugagugaaauagugaagaauaugagaguggaaaagguauuuggaaagauucuagguuuuaaaauuucagcuuuaguugauccuuccuaccugugggaccuuggguaaaugagugaauaaucugaacuugaauugcuucaccugcaagacaaagguaaguaugccaaucucgggagagguaucaugaggauuacgaguuaaacauggaaaauuccucuuccaacucaauaauaaaaacacaaaaaauccaacuuauaugggcacagaaucugaauagacauuccuccaaagaagcuauacaaaugaccaaggggcaugugggaagaugcucaauauuagcuaucagggaugccucacccaaacaaaaggacaaugagauaccacuucaugcuuauugcuuauucggaugacuauaauaaaaaguuacaaaauaacaaguacuagugaagguaugaagaaacuagaaucuucuuacacuauugguaagaauguaaaauggcaacgcugcuuugaaaauggucuggaaguaccuucaaaaauuaaacauaggguuaccuuaugacccagaaauucuauuccuaguuauauacccuagagaaaugaaaacauauauccacacaaacacuuguaauauuaacagcagcauucacagaacgauuauucauaagaagcaaaaaguagaaacaacucaacugucuaucaaaugaugaacagauaaguaaaauauggccuagccauacaauggaauauuauuuagcaauaaaaagaaguuugugaagagcaaagaaaacaagcaacauagugaagagacaauuuacaaaaugggagagcauauuuggaaaccauauaucagacaggggauuaaauuccaaaauacauaagaaacccauucaacucaauaguacccuccccuguaaaauaacccaauuaaaaaaugagcaacggacccgcauggauauuuuuccgaaggggacauacaaauagccaacagguuuauaaaaaaugugaaauaucacuaaucuucagggaaauggaaauaaaaaccacagugagguaucaucucacacguguuaggauggccauuaucaaaaagucaaaagauaacaaguauugcugaggguguguagaaaagggaacccuucuugguagaaauguaaacuuguacagccauuauggaaaagaguacagaguuuccucaaaaauuaaaaauagaauaccauaugaucuaguaaucccacuccuggauauagaaccaaaggaacugaaaucccccauccaaaagagauaucuccacucacauguucaucguagcauuauucaaaaccaccaagacauggcaucaaccuaaguauccacugacagauaaauacagacaugcgauguauauaucaauaauggaauacgauuuacucuuuaaaaagaaggaaagaaaauccugccauucgcaaaaacaugauaaaacuagaagacauuaugccaaguggaauaagccagacacagaaagaaaacuacugcaugaucuuacuuagauguguaaccuaaaauauucaaacuguuagaaacagagcauggaauaguaguuaccaagggccaggcaugggggaaaugggaauaaucuggucaaggguacaaacuuucaguuauaagauaaguaagugcuggcacucuaaugucuggcauggugacuaaggcuaaugauaauauauuguauacuugaaauuugcugagagaguagaucuuuacugcucucaccaugcacacacacaaaagguaacuacgugagguaaaggauauguuaauuagcuugguugugguaaccauaucacaauguauacguauguuaaaucaucacacaguauaucuuaaauauauauaauuuuugugaaucauaccuuaaucaagcuguaaaaaaagaaaugaagugcggauacaugccaaaagaugggugacccuugaaaacuuuaugguaaauggaaaagacaguggcacacaccaccacauaauguaugaugccauuuauaugaaauguccauaacaggcaaauagagacagaaaguagauuaguaguuuccaggguuauggaaggggaggaauggggagugacagcuaauaggcacaggguuucuuuugggggugaugaaauuauucuggaauuagauuguagugacaguuacacaacucugaauauaccugaaaucacugaauuguacauuuuaaaugggugaacuguaugguauuuuaauuguaucuaaauaaagcuguuacuauauggaaaguucuuagcuucaugucugagacaaaggaagaaauaaaaauggucacuacgguuaucauucauucaccugcauuuuaaaaaugcagucgguuuuucuagagacuuuucaccccuguuauucugagaauuaaaauacucaaacauauguguggugaggucuagaagaggaggauuauuguagccuggaguaguuagaaaagcccucgagaaguuuaaacagaauaaaggaggaggcaaaggagaaaucaccaaaggcagcaaucugaaagugaaaaggugggaauaauuugguucccugugagagccauaaggaggcaauucgauuaagcaaauggcucaugaaugcaagggauaaguugaagagaaggcaaaguuagauuuccaagggucuuggaagcauaggccaagauguuugggcuuccuccagcuuuggaaugucaggaacugaauuuaaggaaagccauccugccaguuuaugugguacaaaagggacuggcugaaaucagaacccaggaaguaugaguuaguuagggccugaagaaagauaauaagaauggaaauaggaaagaaauagcacaaaauaguggcuacuucuuuuuuuuucucccccacacccccccgcccccggacagccaguuguucuaaaggggcuauuucuuuaugauaaaggugacagaauacagaagaaaaaaaaucucccuuccuccuucaucaacaccuaacaaaaggaacaauaauaaccauaaaaucaugguuaaaaaaaaaaaagggaaauuuaccaguaagcucuaaauaaggaauuaagcacaaacuugugccauaaaauucaaaagaggaaacuaauuaaaaaaaaaaaaaggaaggcaggaaggagcgagggaaggugaaaaagcaaauaggagaugauuuucaugcaauuugaaguugcaucaaaaucuuccaccucaacugucagaaacagauuggagaaaguauuugaguugacaaaauuaugggauuucccuucaauauuccccacaaucaggagacaaguagacugaagucaugauuuugauguaggauuuuucuucucagucacuuugcaagcugggaaccccuggccagugaugcccguaccaggccuugcuuggccaugcuggugugcuccagcuucuuguguuauagcuuguacccguguuuggugguucccugagcucuuguaccaugcccaagaagaaugaggauacacuggacauugaagggugaggagggcagggaagaauuuuacugagugacgaaaacaguuuuuagcgaagaggggauauggauuuggucucccuaccugaaggugagaaaguuccccuguguggcugggccuggggccuuuuccagacuuagaaugggaagugccugcugauuuguuugugagucugcaaauaagucuaaagcaaagacaccacucaaaggugggcacaacaguguagaaaaccaauuaggaaagcgcagguauauguaaaacaggugaaggguggggaccaaucagaggagagcuuaccaaacagaaagggaaauucucaauccagucugaggauuuaacuuguagcuuggcuuucaggcuuuaaacucucuuccacuugaggugggguuucacuggggacccaccccuaucugccuaggcauuugccugccuccuguugcuaucaauuuggaaaccuuggugaagccccagaaaacccuggggaguacaaucccagaacuucagcccagccaagaauagcaauaauuaugacaggggcuuggcaggaaaaaagaauugauagaacuagagaaugacagcauacagaggacgaacuucaagaauaaacuggagaugacccaaaguuucuagccuggauuuuucagaaugggggugauaccaguaagaccaggggucagaauaggggaacauuuuaugguagaagggcaugcacucuguuaucagauaaauuaaguuugagcaacucaucccuugaauucguaugucuguauaaaccuaaccuagugccucucacguaguaagccuuuuauaggugugugcaggagggaugaggcauauaaaauuuaauuaaauaugaacaaaugaugguaacaauaaacucagauuuuaaaaaaugguuuuguuucaaccacuguggagucaauagacucuaugagacuuaaaaauuuuuuaauuuuaagcugucucuuagauauuauaaagccacagugagucaucuugcacuuaaaauccagaaaagccuauaaaagaauagaaaacccgaauacguaacuuccuccugugacagaagaacaaaaacgucaacguucacagcuuaaagacauuuagcaccucaaaaagauguaucauagguaaguuucuauacuugaaugauauuauauaaucauaaugcauuggaaauuaagucaauuuacaaaaaaaaccccucagaaaugcaaauaacagugcuuuguaaaacuguauggccuguuuucuggaagguacugugugauucugggacuggacuuuucauuaaaaagauaagagauucaggcaucagacauguucaauuauuggcucccuaaugaaguucacuauccugucuaauggaucuuuccuuuucaaaagaccccuuccuccuuguguauucuggcauugcgugucucuggcauuugcucuaugagaauaacuggacaguacaaugcucuugaauacagagagcuggagcuugaauggacaccauagccccaaggacaugaaaacuauuuuuugauuguguguguguuuauaaaacuucuugcauaaaaucagucuuuguaauuuccuagacuucaagggcauucuuuucaaguuggggcuucuuaauguggcccuuaaaaauccuaaaauuaaaugcauuuuuaagcuaucuguguaaauauauuaaaaauuucccucauuaggaaguugccaguuuauggcaaagcuuucagaggagucuguaacacaaaguggauccagaaccacagcauguagaccccuaaaaauuaaaaacauugaaaccuauuuagcaaaucugcaugaaaugagccaaauucauacugcuucuguggaguugguuccuggaaaucuaggcauuuagugguggaguuacagauggaucucaauggccugcgugauuuucccagccuauuguuuucguaucugauuaauuauucucuuaaaauuuccauccauaaaaaauuuccaaagauauuaggaucucucuucacauagucuuuccuucuuuugaaugaugcuauuguugucacuuugaaaacuguaaauagcauucaagaugauauuuaaguuugugccaacauuuaguggaaaugucuaaguuuugaaauaguagggagcucacauuccaucugguguguuuucauuuuaucuccuauucucagugaauuuuaaaagucagcugcagugucaauacccuuucugcuaugcuaaugugaccuccacguggaaaucaaaggaaaggaguucucagggcaagugauucuuucucaauugaacuauuuagugucauagaaucacaaaguaucagagcugaaagcaggcuuacaggugaccaugaugaauaccucucaguuugaagggaaacugagccucaggcagagggaacugcccauagucucauuagccacagggacaggaguugaaccucgauaggaagccuuucugauggccccauaucagguggucacuuccuuccccacacuuccauggcccuuuaucagagaccaccaucccauguuacuuagcgguuucaacuuuguagcacaguuacugucacuaauuucuuacccauguguagcaggcuaauauuucaaaguaaucacuggugugccauuuccuuccugaccaucucuuggcuaaagggaagugcaucuauugcuuagcaguagucuccuucacucaccagcuuagccuuuaauucaaaaggcgcugccccagugugagagagaaaugauucaugcagggauaaggacacagaagaguucuaacugcccacccccagaguuuaaaauagaguuucaagcuggauaauggacagagucaagagagauaaagcaagaaagagugcauguguacaugagugggcacgugcaugcaugugugugcaugugugcacuggggcagggugugcucuacccuugccuuuuccccaacccccaggcugaauccugagguuggguaauauaugaguuuucuauuugcuacuauaacaaauuuccacaaacucaguggcuuaaaacaacacaaauguauuaucuuacagcacuggaggucagauguccaaaauggguguaauggguuaaaauucagguguuggccagucugcauuccuuuuuggaggcucuuugccuuuuccagcuucuagaggcugccugaauucccuggcuuauggcucaauuccaucuuuaaggccauugauggccaguugaaucuuucucauauugcaucacucugacacuacuuauuuugccucucucuuccaccucugugauuauauugaguccacuuggauaauccaaggucaucuccuuaucuuaaaguuggcugacuagccucuaauugaaucuucuacuuuaauucucuuuuaccaucuaacauauuuacagguucugaaagauugguacauaggcaccauuugggaggcuauuauuuggucuuccacagcugacucacugcaagccaucccuuugaauuugagacucuaagaguagauugaaugugcauucagcuuuuuccauccagaauucugguaguacacagcuuugcaaagagaauaaugaaggacuauagcagcaacaugaaugucugcuggaggcaccuaauuuccugcaggucuuagcaaaguauguaagaacagacaaguuuuuuuugagcccaugagaagaacucugacaagcuggcaaaggccaaagaguaaguguccuucaugugcuugugacaagagacuaugucaggaccauggacaccucuaggaauguaggaggccaaaggucaccauccugcaaagaaugauggcauuccuuacggguaucagaauggaccaaagaugcacacaaggaccaggcaaaguggauuacuuggacaccagaggccaaggaaacaacagccaaggacaacagaaucccugccuaccccacacgacauguugcucauuaaggccccagaauacagaaucugaauugagagauuauaagccagaauaugacugaaugaauuacaggccugaacugacagaaacggcacugaacuugcugagcaaaaccuggcccagggcugaugagaugguuugcuuucacagccagaaauucaacugaacuuugggagucaagaacauuucauuuuuuaauaguccaacuggugacugugaaaguaaucauuguuauacuuggcacucaaaugaaccucagacacagcaagaguugacuuggugauugagaagaaacuggagacaagacaaaacaaaugggaauauaaaacuguagacuaucacaucagcacaacuggcuaguuuauuuuuauuuauuuauauuccuuuuuauuuuuuugagacagagucucgcucugucacccaggauggaaugcaguggcacagucucggcucagugcaaacuccaccugccguguucaaacaauucuccugccucagccuccugaguagcuggcacuauaggcacgcaccaucgacccagcuaauuuuuuguauuuuuaguagagaugaggcuucaccaugcuggccaggcugaucuggaacuccugaucucaugauccgccugccuuggccucccaaagggcugggauuacucgcaugagccacugcgcccggcccuacuuuuuauuuuuuuagguggagucuggcucugucacccaggcuagaaugcaguggcaugaucucagcucacugcaaccuccuccucugggguucaagugauucuccugccucagccuccuguguacaugcgauuaugggcacgcaccaccacaccuggcuaauuuuuguauuuuuaguagagacgggguuucaccacguuggccaggcuggucucaaacuccugaccucaagugauccguccgccucuaucccagggaguaucuuuauuuuuuuuucuaacaagucaaagaguagaaauaccaaaaaagucaccucuuuggguguuucagcuacuuagcuagcucacacacacauguauuucccaugagguuuugaucaaaacuaaagucaauuuuuuucacuagguucaccaaacaacugccaguaaauauuggcuucugccaaugaaugaaaaagaacacaggaugucugcucuuaaaaagugaccccugauguuuccuucacauuaucaaauuauugcauacucauuauauuauguuugggaaaugcaagagaauaugaagaaaggaacaggaguguaacauucuauuugaagcuacaaucucucuuaauuucaagguacaugugcuuccauuccauucuccauuuauaugccacucuuuccauucaauauuauaucccaauguauuuuuucccagugaauuuagaaagcuuauuuugccaaggcugaggaggugcaccugugacacagccucaggagguucugaggacaugugcccaaggugaucagagcacaguuugguuuuauacauuuuagggagacaugaggcaucaaucaacauacauaagaugagcaaugguucauucuggaaagaugggacaacuugaagcaaaggcaagaagacucuaaguggggagggagcuuccagggcauagguagauaggagacacaugguugcauucuucugaguuucugacuagccucuccaaaggaggcaaucagauaugcauuuaucucagugagcagaggggugacuuuuaauagaaugggaggcagguugccccuaagcagcucccagcuugacuuuucccuguagcuuagugauuugggggccccaagauuuccuuucacauuucccccccuucucuuugaaaaaaucuuuuggaggaagcauuuuagaagaaaaugagucucuggucucagguuuugucucaucucucauggcuaggauggcuuauuccuagauggguaggucuugaguuauuagguauguucauuuuuagcagguuguaagucucauguucuauaaagaaaaaauagggggaggaaggaaaaaacaacaacaacaaacaaaagaacaagccuguaaaauccauauaggccauauuacucugaaguccauacaucaguaggcagguaugaaaguggcuuauguauguaaauagguugcuguuaucuuuuucugaaguuuccguugucuagcuucaguucacuuggcuuuacgaaagcacagcuuaguuuuuggugacuccaaauuaggaaagaugggaaaaaaaagaaggaaaaaaaauugaaaacauuguuuugcagacuuguagcccagaaaaauuagaauucauuccaaaccacagaaaauaauaaaaacaggcaagacuagaaucuaacaacagguauacuacaguuuuugaaauauaacuuuucucucuccaguuucccauuuuuacuaaugauaaaucaugguaggacuaauuugcuuuauuauucuuggucugauuauuuguguacaguguuauaucauuaauauuauucauaaaaacucauuugauggcuacauagaugaauauauaguauuaaauauauuccucuauuauuuggcauuuaaauuguuucccagguuuagauuuuucaaauuaauuagaucaguuguccaaguuuuauagacacacacucacacacacucugauguaaacuggaaccauaaugcagguaagagcauuuugaacguagaggggaugacacagaaaugccugguauucucuggguuggguguagacacaguuccauacaugaagguguguguugaccagccuauuuuggauugucuaucuuggagaguacuggugggccuuuuaggggagcaauuuaucaagcuaauuuucagggagauuccagaaacggguacaggggacagagcuggccuuggugauuugauucuggaguuacccacaaaguuccacugugccucuagacuaagccucauauuccagcuuuaaaaucccauucuuuucucagcaggcuuuguugguuugaaaaaauaccuuggcaucucaggaaggacaacaauuugaacuacuauuguaauaacugagguaaaaguucuuucucagggggagguuuugacaggaggcaggcagugcccaagaaguggggagacuugcagcugauaaaggaaagccacggaccugaggauucggagaaccaggcuuugaaugcagggggcuggggaagugccagguucagcucaacagucauuucuugacaaccuacucuauuaugaagugguauuuuuugggugccgggaggcagagacgaugaagaugaguaagaugccucugguaguucauaaaggcagcagagagaaaagaacccagacucuggagccagacagccuaaguaugaaucucaggucuguuucuuacucucucuguguccucagaaaaguuuucaagucugccuaugccuccguuucuacacaugauggagauaaauguaccuuaaugcccaaaugagcacuucauuguaucuacuaacucaucaguaugcuaaugucauuaucauaucacagucucccuccacauuugagguaucuccaacuaaugaaaauuuuguuuccagccucuuucaaggaguccaauucagccuuaucccagaucaccaauagaugaaacuagcccaaugccccagggaaagaagguaaaugguagacaccgcauguggauggaaaauaauuuaggaaaacaagugcaguuguuuauuccaggucacgaaaaggaaauucagccucagucuucaauaucaacugauagggucaagauuaccagagaagccagcugaaauuucauauauagauuugaccuaaaugugcaauguccuuucaauaacucugaagagcuuacuaagagaaacaauuuuuuagagucgcuaaaaggaaauucagccucagucuucauaucaacugauagggccaagauuaacagagaagccagugaaauuucauauauagauuugaccuaacugugcaauguucuuucaauaacucugaagagcuuacuagaagaaacaauuuuuuagagggaaaauauauguuggagcaagguuacauuuccgugcaaagggaauauucuaugaguuccuuaguuaccacuaauguaagaaggauuuccagcagguacuggugcaacuggccuacaagauauuuaugguccauuaagaguuguaagcaagacuguuucuuuuucagaaaaaaagcaauuuucucuuaaauauuuuaguguguuaugacaugaauacacuauagggcaagcaaaaguauuuaagugguucagcacacaaaaccagcuccaaaaggaugaccuugggaauuuuagaagcuuggcuagagcauguugaugacuuccuuguguuuaacaaaaacuauaaaaaggaguuauaauaaaguaccuagauggggacuacugggccauauccuaaaagcagagaaaauuccugacuuuguaaaaugucauuucuuucacuguaagucuaaauuacugguagugugucuaggacuuauaaauuuauuggaaauccaguguguguguugugugucguguguggguguguguguaaaugucucuaagguugaacagggauaugaaaaccauuugggauuuaguacuggaagucccagugucuaagaaaaucgcuuuucucccuauacauggguuuuccauaaaauugaaggauaauauuuuccuuaggcuaaagcaaagggugauagaaacagggacggcuuuguagucaaacagacuuugauauaaacaagcuuugccaugagcugguuaugagguuuugacauagauauuuacucucugcaaauuuaguuucaauucaaugguaugaaugauaugcuuggcaccuagcagacaguccagcccaauguguauucucauugacaguaauaauuugauuauuauucucaaauauuacauuuauuuaaaauagauguauuacuagucucaguguauucucaaugacaauaauaauuguauuauauuauuauuuuucauuagugcucucccuaggagcaaagacugcgaacuauaguuguuuaugaccacuaaccuuacacuagaagcccaguaugauuggguauuuuucccccauuuuaaauaugggaaacauaagauacugagauuuaaauagcaaguuaaacauuaaacaguuugcaauaaaccacuauguugacucaagguggagagaauuuagagcuacacagguauaccagcuauuucuugauuuccuugauuagaaagaaaaucuggcaucauucaaauuccuauucuaaaucuggggaaggucauaacagucuccacaaacagcugcuugccaguaagcugaagcaguuugaaagcauucuagagcaaaaccauccagaagaaaucuaaugcaugauacauauguuauuaaaaguguuugguagcaacaccaaaacaaguacaaagaaacaggugaaauuaauuuuagugauauaauuuuuaacucaacauuaccaaaauauuauuucaacauguaacuauuauaaaacauuauuaaugagauauuuacuuuuuuuuugguagaaggcuuugaaauccaaacuggauuuuacauuuacaacgcaucucaauucagacuggucacagguggcuagcugcuaccaaauugaacauuaaugguagacgucaccccgcagugacaaaaauauaaccacauuugaacacucaagccgggauucuaaacaucaggcuauguuuccaggacucuaugucuccaaaagcaggcaacuuggaggccuuaggauuccuuccugcuggcauguggcacaugaaugaaccuugcuccaagcuaagagguuacgggauuuauuuauacagguuguuugaauuacguguaucauucuuuugucuaaagaaugacaggugauaauuuaaaaauaaaaacauuuacaaaugcuuugggacuuuaaaauuguauuaauuuuuaucuucuguuucccccuaauucuugcuuauuuugauuuucuucauuaaaagagagauaaaguuaaauguuugggggcuuuucacuuuggggccauuauaauuuauauugagggaaucgugucaaugcuuaauucauaucuguuuuaucuuuaccuaguuuauccauuucugaucauaauuuauuuuuccaauagucuuuuuuuuuuucuauccuuaaucccuauacucucauuucucuaaguaaaauagauuuggaaaaacuacugaggucuugguaguuugcuuuagcagguuaacuccaaacuuaucaaaacuuuuuggacaauuuuaagugacuguuuauuaauagcuaugucaagaaccuugaauguaaaccuaagauuuuuuuaaacacugaaacagcccauuauucaagcacuguaguuaaacuuagguuucauugcagcagccacugugagacugagagcagaacugugagaagcagguaggaagacagauggacuccagcaacaaggacaccucggaggaggcauuuuccuccuucaccggcaagcaccuuagagcuuucugauggaauguaucugguuggagcgagaauucacuguggagggcagauaggacucugcacaagaaagccugauucgugaaauaaugagagaggaccacauggagugguuugauagaguggauuuacuauggaugcuauggauagagugacacgugauuaaauuuuucuuauuucucacuaacaugcgauugaacguauucaaacaacauaggagagcaauuuugggaaacuaaucuaggguggcuuaccucaaagcaaacucuaggaaaaagccauggcauccuuugccuugaagcucaaccuguagauaccugcauccuccucaucaagcacucuucagccuucuuucauuacuuuuccucuuuaguguccaaugacuucaugaucuuccuuggaggcuccagcucaccaucacuaccauuauagcccuccaugcuucucaacauuccucauuugcucagcucuagccugggcugggcacaguggcucaugccuauaaucccaguacuuugggaggccaagccaggaggauugcuugaggcuaggaguuugagaccagccuggacaacauugcgagaccugucucuacaaaagcauuagccagguguggugguaugugccuguaguccuagccacucaggaggcugaggcaggaggaucacuugagacccgggguuugaggcuguagugagcuaugauugggccacugcuggccagccugggcaacaaagugagacccugucucuuagggaaaaaaaaaaaaaagaguuaauaaaaugacuaaccugaaucauauauugugacaguuaauauugagugucaacuugauuggacugaaggaugcaaaguauuguuacugggugugucuaugaggauauugccaaaggagauuaacauuugagucaguggacugggagaggcagacccacccucaaucuuggugggcaccaucuaaucagccgucagcauggcuagaauaaagcaggcagaaaguggaaagagcugacuugcugaguuuuccggccuucaucuuuccccugugcuggauucuuccugcccucgaacaucggacuccaaguuuuucagcuuauggucucuuggacuuauaccagugguuugccaggggcucucgggccuucagcaacagacugaaggcugcaccgucagcuucccuacuuuugagauuuugggacucggacuggcuuccuugcuccuccgcuugcagauggccuauuguggggcuucaccuugugaucauguaagucaauacuccuuaauaaacucuccuucauauauacaucuauccuacuaguucuguccugcuagagaacacuaauacauauauuaucugaauauuuguuucugugagaaaaaugggcacaaauaacuuuuaaccagauaaaugcuuuucugcuaauuuugugucucucuuuugaggaacauagagauuuagcucaguaauaaucugacauaggauaggguaaaccagaugcuuacccagcuuucucauuacuaaaauagguagucaaagagcauucauagauacagagggagcauuugaggucauaggucauuaaauuagcauuacuauaugcuuauuuguuaguuuuaucacaucugguucuuugaauaaaaagucuccauuaauuuagaagaacauaucaaguuguuaucuuauucugagugagagacaccaaaguuuucauuccaaaauucugaaauacccagaaacuuaccacucagugggaggacaucaguaaacccagaagacaaaaagcuaauuaacugucucacugaaacauuccuuccuuuuugaaaagucaacuagggacccauggacucugagcccauugucaaaugccgugugaaagagauccaaguucaacaacaaauaucaucagcaauauaaugguucucuccagcccucagggccaaauggccugcauuuuagcaaguugauuuugcucaugaauuguguuaagccaagcaauuguuucccaugacaugcuugaacccacaguugcuuugucuaugaaauucaugguugaauuuguccaauugcugauugcuauucccacuugcuuuaguaauagucacuuccuucaucaguaauggguuuuauauacagugcacagucacaaccauucaaugucacccauaagcauuugaugaauuguccaauacaguuaugagaguugguuauuugggauacagcuaggguaagucuuacugaguuaaugaaaugauaugacauuaggccauggguguuuccucccccacauuggcuauacacacucuuuuaucuaaggacgcauuugggucauuaccauaaucuucaucaacuugucaagauaaugaagggcccauugaguucagggaaggcuuggcauaauucaugaaaauuuaaagaacauagauguagaaagaguuugggagcuacagauaaauaagaucugcauagacaaccacaaaggaagagcuucagcagacaaucugcuuuggaagggggagaguuugagcucaguuuugagacagaagagaggcucauacucugaaaugucuaagacauacugcuggaggaacagaaggugaaaacaaacuuagagaugauaaucaagauuggaaagaaaggaagaguagcucucgagccugcuuucagcaaauccuacaucuguauuuguuauagccaccacacaaaucuagguuuggugggagggggcaaguuaguuaucaacuucgacaugugccuaucagacuugcuuagcaaucagacaagguuuauaauugcuuccgcuaaccuuuccagaguaccacaauuuguagccuucugcacacugauuucugaccaaaggauucuguuccaucaaugccccauuaaauucaccucagauggcugauggcaccaugucgaagucucacccaguguggcuaugaguuagugaauugaccgucugaagagcaauauauagucuccuuuuaaauuauguuagaacuagcagagaauuucagguucuucuaguucaacaccuuguuuuuuuuuaaauguguucauucauuuucaaauauucacugaagguccacccuaggccagauuagaucccugcccuaaagacuguaacacauaauugggggaugcagguauugaauaauaaaguaauaaauuaugucaagugugggagguguuaagaaggaaauagguauggcgauauaguagaguuacucuagaggggacagaggauuaacuauuacagaugaaaucagagaacagugaaaaggacccuuugaggagguucugcacauguaucccagaacuugaaguuaaaaaacaaaaaaaacucaccuggggccagagcacuguaaaugaauaggcagggagauuaaacagauguuucaguuaaacagcaugcccaguauaccagacagaagauccuggggaauaguaaucuuugaguagcagagagaagaggagcagcccaugaaauaggcaaggaucuuaaacuccaaugccuucaggagcuaugcaugcaccauuagccagugaagcaagccuagguagaaggcagucguggcaacuguauaggccuagagaaugagcaauaugccuaacagcauucaaacucauuaaaaaauacuuuacagucacaauaaagcaaaucaccaaaaauacuuugcaggcaaaaauaaaacacaugugaagaggcaagcaaagcccaaggaccaucaauaugcaaugcugagcugcaggaaaagcaggaaguaggcugggaaugagaaaaaaauaaauacagugugguuuccucuaaguuaaaaagaaaagguuuuaccuuuuauuuccaugaacuuaacaaugaaaacaauauguuucacuaggcagucacccaaacauugcaauacugaucacaaaaaaccccccacuauuuguuacagaacuuguaaaaccugaaaauggcgguaaugaucaaaugggucaaauguguaaagagaggcaccacaaauccaaguggcccaugcacugaccaaauguagauauccucuugaagaauuguggccaugugcucugugcuugagugaauccagggaugggaagcucacccccuuggaaggcacucuuuaaguguucauuuuuuuucacuuugacccguuauuauggagagcuaaugauaucugccacuuuguaguccgauacucacagaucugcccucuggagccacauagaauguauuuaauaucuuuccaccugccagcccuucagauauuuggaaacagugacucuguuacuaucuucccucuacaagucuuccuuuuuccaggcaaaacauucccaccaucaauuagucuccaaaucuguuuucagacccaaccaccuuucuuaugaaccuucuuauuugucacuaaccaucuuaaaacagugccuagaaagaacacaauguuccuagccaauuuauacucuggggcuucuuuaggcauaauuuucuaugucugcagcaguagaaauacaauuacauuuuauggagcucagucuccugcuguuccuguuuccuaccucccacccuccaaggcagucuguuuguugaauguccugaacagaugcauaaucuagagcaagugcucccaucaauauaaagaaugccaucccucaucacuccaucgcuucugauuaagaucauuuggucuaauguacauuaaguucuauuccaauaaugccugugcgguacugcaugcuuuucaugccucuuucuggacacuguguuauuagauacucagccuggagaaacauuuccauacaaagaggaagauaaaacugagaaugaaugguuaaaggcaaagagaaaauugggaaucucacccuuggaaagaaugguagaugggaacauccaaugaccuggcuuugaaucugguucucuauuuacuaaccauugcuacuuaaagaaaaauaguaauaauaacaguaagaacagaaacuacuaucuauuaacaaauucuugguaaguaccaagcccugaaauaagccuuucaggcuacaauaucauaugguuaguagaugccacugggauuugaacuuacuucugccuguuucuagacuucaaucucuacauagucuuguaccacaauuucccuuaguggauacugucuauacuacauaugacuuauaccacugauuuuuaaaaaaagaaaaacucucacaguaauuacuucuccugagaugauccuccaaaaugugggaaguagaaacauguguuuucuuuucuguggggccaucagagcaugcagacaagggcaaaggaauaagacaggagagagaggccauacaccaaccacagcacuguacauugugucuugaacugggcugaaaaguaaccaugcagcuucauuuuaagcacaguuggaacaucgacaagauuucaaggugacuguucagccuaaggaaacaguguuuucaagcacuuuuaugcuacuuuagcaguauuuacuaguauauaauucacgugcuaauuuauucauuaaaacagucguauuuggcaacauuaaccuuaguuuacauuagugagauugguauuuguauuuuaauuacaucucuuuauaauuacucuauaauucugauuuucuuccaaugugaacuaagcccuuaucaauccccaaacugcauuccacauccaacgaaaaugaguucaaauuauaguuuuacagaaaauggcuuuguaaaacccagagagccuauucccaaagguagucaugcaucagagucuccuggggauuuccuuauacaaugacugauuccugagugcugugcaaucuacuugaucagaaucuccagcgacgggaccuccugggaauugagaccugcagcaacugguccacaaaucagcacuuagggacuggugacuagacuauuuccacucuacacacauccaguacagcucuuggaaaacauacaaagcaaaagauaguaaggguuauccuaaaggcagaauaaccagccaccucacggaauccaauguguuccagaaacauuaauuauacguuucauuauuaacugcugaccuauuguucuuuauuuucaggguuugaguugcuguuuuaauuucaucacugcaaagaagcccuauagacacacacacacaaaaagaugcauagauuuuaacuggucccuggaaacaagguagagauaaucaugugguuuauuugauagagccacaugauaaacaaucgagauaaacaauguguuuuaaaaagcauucucaaagaguuagaacaggaaugucaaaaagacggcaaauaugauaccuaccuccuauccaaugcccuuggcaggcguugcuaaucaaucacagcauuuuuccuugcauccacaaacagccucaaaguccauuuaaccaaucacuccagggcacuagugcuaucuaaucugcucuaccgugugggggacauacuuucuccucuuuggcuacaauaaacagguaaauugaaaucaccuuauaacagccugauccaugacaggcuguaugcuccacaagguggaaaugggcaucugaaaguucucauguagacagggcuuuaggcgcagaucaccuggcucuugcugguucauguuuguagugguuucacacuuguaucuuugaaugggaguacuuagaaauaaauuaacugcuuuaauauuuaugauaugugaguuacacuuacucaaaccaaccuaguuuuugcucaugauaauuuacaguuucacuuugaauaaaugcuguugggaaagacaagcugaguuccaaaguguuuuaaaaauuaaguguagcauuugacuaaaagaaucauauaucaaucugcuugauuuccagugguagcacuguagguuuucuucuauggagauucugggccauaucuccaugcaaauauuuacuguccugguaaaugacaggauagaaaucacaaggacacuugguuucugcugguuuucauuugaaaaagaaaaucauuauaauuaauuagucauggguucccacgauggccauucuugacuccuuggccucuauugccacuuuccaagucuggcuaaauagaauuccauuucagaccauaucuaggguaauacuugauucauuagguugaugucaucccaccgacaguccccgugaucaaacaauaagaucagagagaacagacccaccuccucauagaugcugucauuccugugaaagucuccagccuuccugggaagaacauggacgugaacgugcugaaaauguacaagaaagaaaaaaaaugugauuaucuccccauguauuuuuagacuugacagugaugcucucaugaagcccaauuacuccacgaugguuccugcuggguuauuuuucagaggaaguugauauccaccuucgguaacuauaccugaaaucugccgagaagagagugcacuaagcaagagagaacaacuugggguauauaugagaguuggugcgaaaugcuagaguguuucagagucucuguggaauuauucaugguugucagucuugguuguaguuagccagugcuuugaaaugacagugcaucuucaaaggugaccaucaugacucugaaacugacaagaaauaagaauuggcuaacagagaacugcauaaguaaagagcgagugaaugagguagcaaguaguaugggcagaauuacagacuuggggcuucgaaaaauaaucauauaauaguaauacaaacaguucucauuuaguaagcauuuauuuccuaugauaaggaaagcucuguguuuggcauucuucauuuaguacucuuaaaaauccuaugagguggccgggcacgguggcucaugccuguaaucccagcacuuugggaggccgaggugggcggaucacgaggucaggagaucgagaucauccuggccaacacggugaaacuccgucucuacuaaaacuacaaaaacaaaaacuuaggaggcugaggugggagaauggccugaaaccaggaggcggagcuugcagugagcugagaucgcgccacugcacuccagccugggcgacagagcgagacuccucaaaaaaaaaaaaaaaaaaaaaaaaaaaaaaaucccgugaggcaaggucuacuaugaucuccacuuuacagaagaagauaucaauguucggugaggacagggcgccacaggaaguaaaagucagcaccggaaaugagguugccuggcuuuggcuccuguguuucauuagcacaugcacugauucugcgaacuuaaucuuuuaaauagcccauuucucuagucuacuaaagcacccagguaauauacauagcaaugcuauuaugcaaugauggugaaucagggcucagagcauaucuaauucaauauauucuucaaagcuaaacugcuauuugaaaguuuuacuuuccaaauagccucuauuguaccucggcugaaguuaaaccucauuucugcccuugagcuauguuccacuuuuauuacaaaccguggggaggaaugcgaaaaugaagagcuuaaauagagagaggcagacagagggucaaaccucaucccugaucacccaccccuuccugauuacugcgaucggguuccgaggcuccaaaaggccucaagagaacguaagauuuaagugucccuguggcuucgcuguacaaggagggggaaagugacacgcuauuaaagccgaggcagggugcaacgugguccaaggugaaugaagcagagaggagcuucaaagcagccccugagcacaguucccaaagagugacacgcuuuugccagaauauucgccagucaaugauaaagccagucacggaucucucagcaauugggccaagugugcacuucagucacaaagauuacgugagcauggagagagaaagugaaagaacaaacaaggaaaaaauaaaucacaaacuacccaugaaaccaaauucuuaggagaaagccaggcaggugggccugggcugaaaucuacugaaaucuccagaugggcugacuuaaaagcaaaaccaggaaaauaacguagaacaaggauacagacaacccuuagaaggagccuucacucacucuuuaauuccagaaucuccugccauccuuucuucuucuccucuuuuuguccuuucuucuuucugucccccuccuccuuucuuccccucuuccucccucccauccauccaucuuucaucaucucccuuauacauucuaggaaguuccagaccagugucuuccagucaaacuuccuaacacaaauccuggaccuaccacaaacuaacugugugaccuugucucacaaagucuaugugucaguaucuuaucuauauggggauuauaaugguugcuaccucacaggguuguuaagaggauuaagucugcuaaccaugugcugagcauucagcuuugcauguaguuaguacucauuaccuagaacuguacaagaauuaguuuuauuauuuaaaaaaacaaauuuaaaccugaagaucaaguagacaucacauucagggauugauuucugcaccagcaaaaaaauaaaauaaagauauuaagaagcuccuugaaugagggcauuguucaagcaucucuuuugugaaagcugauuucuguugcuuugacuagccauucucaaucuuccaccuguacuuggggcuuauuaaaaugcagacugcagggcccuaaaagucugcauuucuaacaagcucccagcugaugcuggucuaaugccacacuuugagaaccacuggcuuacaauauccaccugguuucuuaccuugcuucugccagugugggcacggaggucacuugcuguuuugccugcccuacugcauuauguguagacucuuugucucuuuucuuguuuuuuccucuuuuuuuuccuucuuuccuucuaucuuuucucuuuuuucuuuuccuucuucuuucccuccuuccuauuuuuuucccuuccuuuccuucuuuucucucuccccacagaaucucacucugucacccagguuggaguacagugauacaaucauagcucacugcagccuucaacucccaggcucaagagauccuccugccucagccucccaaauggcugggacuacaggugcaugcuaccacaucaagcuaacuuuuuuucauauuuuuagcaauggaguucucacuauguugcccagucuggucucaaacuccuggccucaagcaauccccucuccucagccucccaaguagcugagauuauaggugugagcuacuauguccaguauguggagacaucuuucugaaugcuucucuggcuuucugcacucugaccacucuccuugcgugguccucaggaauaugccuguuaguauccacuacuaacauaugggggguugcgaaccugcacuugggaaccuccaggguccaggucuauccccugccuacuauucuuuacccucgucuucucgauuuaguucagggcuaucucuauaggcuguguuaccacuaaguucuagaaaagccacucuugaucacugguaaccacuugaaauucgccgugacacacugaaaccguaaauagcucacuguacaggugguuuuuucccgagggcauagaucucaacccacccugauaucgugacauaaauucuuaagugacaggcugaucacacgaugcugacaacccacucagcuucucagaacagggaaaucacgauagagccagcucaaagccucauugcugugaaaaaauaccaucacuauggacuucuaauagaaugacauucugauaaaaacgcuaugaauagcagagaugaggauaauuugauauaaucuguucuuacugcuuucauauuaagcuguggugaucacaacuuacuuuucuaagugccaacaaaacaucuauuuaauaaaagccuuccacaaauuugcuagggguugcaguugagcugcuugagcuagaagaguaucuuuuuaaagucccaugacacauuccacaccaaaaauguuuucauggucaaauaacauuucacaaugcucauuagcacauuaaaguaugagaauuuccacacaaaagaugcuuguuuaacuucaucuaauccagcauuccagaaacuuauuugauuguggaguccugauuuuccuguuucauucauguaacacuucuguacacuuuucuaaaguauacauugauucacucaaaaauaucuauuucuaggugcuauucuaggagccagggauacgguaauggacaagacaaagccucuguccccauagagcuuauauuccaaugggugaugcagaagauaaguaaggaaaugacuauacauucuaauuuuggauagaaauaaguguccugaagaaaaacauaacgguauaagguaaauacugagcacugggccacucuaacguuugaaguuugggaagagaagcaggacucaauuuaaggcuguaguaaggaaaggggcaaaaucaagagaggguaaguuccaacagcccagagaacaaauuucaaagaguguaucacuaacggugugaaauguuuuugaaagcuugaauuguuucaguaaggcuaggagaacaaaauuuaaaaccccaugaaaagaugcuccacauuauuagucauuagggaaaugcaaaucaaaaccacacugagcuacuacuucauacccacuagaaaggcaauaaucaaaagacacacaauaacaagcguuggccagaguguggagagcuggaacccuccuacacuacuggggauguaaaaucacacaguuacuuuggaaaacaguuuggcaguuccucaaaaaguugaacauggaguuaccuugugacucagaauucugauccuaauacauacccaagacaacugaagacauauguccacacaaaaacuuguacgcaaauguuuacagcaacauuauucacaaucaccaaaaaguauaaaaaacucaaaugacuaucaacugaucaaugguaaacaaagugcaguauaugaagacaauaggauaugauuuggccauaaaaaggagugaugugcgcugagugaaagcaucaugcucagggaaauaagccagacaaaaacggccacauauuguaccaugccauuuacaugaaaaagccaaaugaggcugauucauagagaaagaaagauuugcgguugugaagagggaugcaggguaacugcuaaugggcacaggguuucuuuuggguuaauggauauguucuggaauuauauagcagugaugguugcacaacuuugugacaauacuaaaagaaugaacuguauauuuuaauaggguuucuuuuauauuaugugaauuauaucucaauaaagcuauuacuuaaaaaaaaaaaaaaaaacugaaggccgggugcugugguucacgccuguaaucccagcacuuugggaggccgaggcgggcggaucacgaggucaggaguucgagaccagucugaccaacauugugaaaccccgucucuacuaaaaauacacaaaaaguuagccaggcgugguggcacaugccuguaaucccagguacucgggaggcugauguaggagaaucgcuugaacccgggaggcggagguugccgugagccgagaucgugccacugcacuccagccugggugacagagcaagacucugucucaaaacaacaacaacaacaacaaaaacccaaaacuuaacugcaguggguuucagagcaagcaggaggugaaauagagacagcaugcaaugccaucauuuuuagaggcucugccucuucugcgcugucucugcuccuuccaccaucucuuugaacacaucucuucugcccauacucaccugaggauugccagugugguuguaucgauauccuuuuuccuugucagaauauauuguaauucaauucuaagggauagaaacauggcucauggcgggggaaagagcaaggaaggcugaagagcuacccugcuccacagcugguguccugcaaccuccaccaguuggcccugugugaauccuucucccucacaugugccaaugagcaacugcagaaggcaggucugauucuaaagaacaacagacgauacugugguaaaacgauaauggccaccuucaaaguuauccaugaccuaaucccugaccugugauuauguuaaguuacaaaagauaaauuauggcugcaaaugaauuaagguuauuaagcagcugaccuuaagauuggcagagguaucauagauuuuccagguugccccaaugucaucaggaguccuuaaaacuggaagagggugaacaucaucaaaauuguaaacuuucuacuucaaaggccacaagcaagaaugugaaaagccaagccagagacuggcagaaaggauuugcaaaucaccuaucugauaagggaaguauaucuaaaauacauaaagaacuacuuacaacuaaguaauaaaaagacaaaaauccuaaguaaaaugggcaaaggauaugaauagacauuucuccaaagaggauggauaaaugaauacaugaaaagaugcucaacauccuuagcccaaaaccacaaagacaauaccacuuaacacauacuagggcaacuguaauaaaaaggacagauaggccgggugcggcggcucacgccuguaaucccagcacuuugggaggccaaggcggguggaucacaaggucaggaguucgagaccagccuggccaauauagugaaaccccgucucuacuaaaaauacaaaaauuagccaggcaugguggcacacaccuguaaucccagcuacucaggaggcugagguaggagaaucucuuaaaccugggagguggaaguugcagugagccgagauugcaccacugcacuccagccugggcgacagagugagacuucaucucaaaaaaaaaaaaaaaaaaaaaaaaaaggacagauaauaacaaaugcuggcaaggaaguggagaaauuggaacccuuguacaagcuggugcagauguaaaaugguacggcugcuuuagaaaaguuucugcaguuccccaaaagguuaacaauaauguuaccauaugacccaugcacuguuuccagcaauuuguuauagcaacaaguagagaaugaauacagaugccuugauauuuuuaaugcauaguuuacacauuuuucuuaucucuacaacaccuguaugaaguauuauucuaccaauuuuauagguaaggaagagacaaaauuuucccucagcaagacucagaaaucuucacguauuguuuuuuugguuuuuuuuuuuuuuuuuuuuuuuuugagacagggucucacucugucacccaggcuggagugcaguggcacgaucucggcucacugcaaccucugccucccaaguucaagcgauucuccugacucagccuccugaguagcugggacuacaggagcacgccacuaugcccggcuaauuuuuuuuugcauuuuuaguacagacgggguuccaccauguuggccaggcuggucucaaacucccaaccucaggugaucaugcccagcaucuauuguucuauguuuguauaaucaccaacagcucucaacuuggaauaaccaaauguaauguaacaauaagauuguuuccauuugcugaauaucaacaucaaaaacuuacagcauagaaaaucuggaagagacagaaaaacacauaggagaaaauuuagaucaccaguuaaucucacuaccaagcaauaacaauccuuuucuucauguagagugauacaaauaugauacacgcuuuuuuuuuuuuuuuagucucaauugccccagacaaaaacccugaagcaaggaugagagugcaaguaguuuauuugguggaugaucccuggaaacacgaguaagggaaggaaacaagaaaggaaaggaggccaauauaggaugugugaucaagugaguuauuauuucaugugacuggagcuuauaaaaccugcuagagaacucugagaaccagugaagaauaugcaucccagaguuaucccagccaaggugugagggaacuagcguauucauacaccaacuuuuguccucacugguugagaacugcuccuggggagacaucaauacuccagcacuucugccuucucccaccuggagagugagaaaagccagguuuccagggccagucagaugcaagucaggcuagguaggaugcauugcagccaugguggguggggguaacacaaugugggcagagcacagaccccacuuguagcaaugcuuugcacagugcugucucauuucugacaccuggagucucauaauuugcugcugaaccgaaaguucaaguauuuagucuccuuuucaugggugagauaccagacagauaaagaucugguuagagguucuuaaacugcaaaucccaaagcccuagagcuuccagaacaagccugguauggccaaggagcagcucaugauggaaguaagaauggggcaccagaaagggcggcaggcuucaguucccccuccgugauucaaacagagcagcucuguuuuaucuguuucuauguugggaucccaugcacgauuucauuugcaaaaagaauuuauuacuaaaacaaacaaacagaaaaucuuugaaaacuacuaggauuagaauuaggaaacguuggggggugguaagagugauuaauuucuucauuucacagaagaggagaguggcuuuuagaagaccaauaacaaagcaauggcagggcugggacuggaaccuugagaaccccgaaacccugacuuguguuccagugcuuucuaccucaucuugcccaaccuaccuuucccagaucucagaaagguagaagccccuacaauuaagcaguuugguguucagucacuggagauggguggccaagguucagauccuaccuauucuuuugacugagucaauuccuuaacuucuuucauauucccucauuuaucaagugggcauaaaaccaguaucccaacgcauaagacuuuuauaccgauuaugugaaauacauagguaaagugcuuaagcuaaugcugcacauucugaauauucagucaauuccagcagugacuauauuacaggacauuaguuuuaaaaauaauuuugacaaccugcuucuguucuaaaccagaaggcuuaauucuacggugagccuugcugaauguauucuacuucauccagaccaucaccaaccccaaagcuguguguucuacauggcuggauuucgccuuucuugauuuggggaggccucaucuucugcaacuaagucgagucaagggucagcaugaaauuacugacagccacuuaguucuaaaauaaaugucacuggaaguaaugccacuuacaggacuuugaggauaccucagcaugaucaacucaagaaucaaauuaguggccugucaaaaugcacaggcacacugaugguuucugaugcuacugucaaugagcuccuucacuuagaauauuagcaaugcucaggcaguugguaugccuuucaggaaacagaggaaacauagugcuuuucauguguucaaagugucccaaucaaguugggaaacuucgaggaaaaaaauaaaauaaaaaaaaauucaguuuaaacaaaaaaaauaaacagaaaacaccuccuagaauuuguggagacucuguugaguuucguggcuuaacaauuguguuuuuaagccauacaucacugguggugcuccaauugugaguuauaauaauauaucauaagagggauggugaucuccugauauaugggugccauacaucaucuaagcaccauggcuuugaugauguauugcuccaagccacaaugagaguuuaaaggagcuuuuagcagccagacagcuuuaaauuucaaauuuucaaaaauuaagaucuuuucaaguaaaaaaaaagcaagauaauggaaugugaugcuauauaaagugucacugaacucugagagccuggguauaugccuuuuccuuuuggcuuugagcucacaagguggaaaucauuggcaaguucuucuucaauuccuccuccaugagcacagaggugagcaagugucaaugcauccauuuugccaaucaauuucccccaucuuccacacugcaagccugaguagcucaucaucaucccaaagacuggaucacauaaaaugcugugauaggcacuggauaaacccaggagaaguuauuuuuuauuuuuuauuuuuugguuuguuuuaaagagcucuuccacugagauucagaacaaaaagaacagauaaaaaguagauagacuuccuuccucauugcucucaaacucaaaacagggcauguaggaagaaaacaugccuugucuagcauuugucuuuguaaagcaaaggaagcauugauugcagaugaggagaaagaggggaauggcauaugggcuucucauccagacuaggaaagggagcuguugucauaguucugucaccuuuccuauuuuaacgauggguuuauaagacgguaauguggcuuaagagaauguacccacuucguuuaaaagccacucacuuuugggggcaaaguaaucacaaucaauuaagaaaacagguguugagagaacuccucccuuuuuuuuuaaauccuacugcaauaaacagaacaaaaugagaaaucuuccuacuguuucuguaauagaccuaaacaggaacagugagagacgauuacacuucaaguggcuucuuccauuuuccuuuacuaagugaauuaaaggaaagaauaagaguaguuacugccauguggagggaaacaucugggcauaaggaauuaacagucuucccucccauucuccuaucucuaauuuuuugcuccuugggcuuccuccaguagauucuaagucccaaauuacuguagauauuuugcacccggcucccuccuugaccacuuccaaagggcaaaaacaucuuauuuccaccaaagaaaaccaauggcugucucaaaaagaagucccaggcuucuuuucuccuguaguaguaaguuaacuauauaaucuggguaacaaagacauggaaauaaaugcaucacccacuauucugaggcugucaguugaaagaugugaaugaggcaggcuuugcaucuagagaaauguggguucuuucacgggcugguaaauaaaucccccaaauucaguccucuucuucucuauaaagagaauacugacacaacacuuaauuauuucuuucacauaagccaaaaagcuuuacuuacguauuuauaguaauagcacaccauucauccacccaccauuuuuaagucauuaucaguuauaaaacuugcugccauuuacauaagaauauuauauguuggaaugguacuuaguacuguauauuaucacauccucaccaaaacacuaaaaaauagaaacuguugucuccuuuuuuuucaguaagcacacugaugcuuacuggaauuaaauaaauugugcaagcucaccaagcuggcaaaaguggccgaguuaagauucuaagucagguugauaggaugucaagcguaaucuguauuuugcuaugcuccuuccugaguaaauaacuaaugucugggugaccauaugccccagucuguuuggaaccauccagcuuuaggccugcagguaugaacaggccaguguaauaacaaacagcaucuucuuucacucuccuaaguucugcuguggacaauaaauuauauggucucccuaacuaguaguauaguucaugccaggaaauuuuauuucugcucauucuaacuauucucaucugcagauagcaggggaaaaacaaagaagaaaggaaagaaagaaggcucugugaaaguuuuuaaagaaugggcuacuaacucuuaucuaucaauaccuuucaugaaaccuccaacauguucagaguagagcucugggagggaaaagaaauacuuuagacuaaaacagggccccucaagcucuaaagaaaaaaccucaagcaugcuagaaaccucuccaguugagcauucuuuacuuauuaucaucacaagaggcaacgguaauagcuguugcuauuuauuaagcucuuacuauaugccaggcaccauaugccaggaacugagcuaagcacuuucuuuguaagaucucaauuauuuaucauaaaacugcaugauagauauaauccaaauuauuaucaucauuaauuuauagaugaagaaacuaaggccgaggaacguggaaugaggaggucugcccgauuccaacauccaagugugauacuacuaucaacacucugguacaguugaacacagccuaguaaaaguucuaagcccacugccccugcacccccugcuauucaaccuuaugacaguaagcucuucugcaagaggggcccauuagagagaauggacuucuaacaaauugagaucaaucuuguacaaauauucuguauuaucuuuuggcuucugauugguuuucagugacauaacagcuuuaaauucuuaaagcuauuuaaugagaagagaguagauguauuagucuguucucacacugcuaauaaagacauaccugagacugggugauuuauaaaggaaagagguuuaauugacucacaguuccaccuggcuagggaggccucaggaaacuuacaaucauggcagaaggggaagcaaacauauccuucuucacaugggggcagcaaggagaagaaugagugcccagugaaggggaauccccuuauaaaacuaucagaucucaugagaacuaacucaguaucaugagaacacgaugggggaaacugcccccaugauucaauuuucuccaccuggucccacccaugacacauggggauuaugggaacuacaauucaagaugagauuugggugcggaugcagccaaaccaugucaguagaauuuauaaucacugccucuagagaaguugacaaaccuaaccaacagcuauaaaaccaggauaacuccagauguagggcucucagaugaggucaucucuacugccuuggguuauggacagguagaacccugggaagaccauuccaagauagagucuuccuguucaguuagacaugcaggagcucagagguucuuguaaaauugguucugcuugcugcugggugggaagggacagugccuuaguaaugucuccaucugaaaacguaugaaaguuucaaaaugacuuuuaggagauacagaggauguuucaagauuugucacccuugugcuucucagcuguuguuguagucauggaguuuauaguacaugugcuugguagaaaaaauuauaaguguucuuccuuccauguggaguuccuuucucuuuccuuuucuuccucugaguuuuaaagagcaugcucaaaugccaccuccuuuguguacucuucagacucuuucaggcuuuucugauucauuauacauauguccaugacagcuuuuuaccacaaaguauaaguaauuacagguuuucucuuccacuagucuggaacucugggcuauuuauuacuuauuuuuccccugauuauuucuuuucccuaacccuagguuccuagguuagaagacauauuuucuaaauguugaauggauggaugaauggauggaugggugggguggaugggugauggaugggugaauggauggguggauggaugaauagauggaugaguggguggguggauggguggguagcuagguacaugagugggaauguggacagauaggugcauggauggaugaauggaugguuaaaaaauagacaacuacacugcucuuaauuucuuagcuugcuuaaaagaagaaauauaugcacugauuuucuucgccauucuugucauuuucuuuugcuugaaaguucuugugcauacaaagauauggucuaugaagagccauuaugaucacauuguacacaccuuucuuccccacugaaaaguaucuuuuuaccaaaauguaaguuugaaguucuuguguuucuagccucacauaaaucccuuuuaaaaaacuccucagauaugcucaagugucuggagaaauagcuuauccuaaaaacagucagcauugcaaggguugccaaggggauauauuuguucuucaguauuaacuucauuaagagcuacugugguucucucucaggagagaagaagaaaccuaaccuuucuuuggauaucuucugaucuuuacaaauuauuuccagggugcugucuuuguuagacaaaauaugaagaauaucuauuuuuuuauuuauacaucauaucagaacauuaauuuguagagugauucccucugggugccuuucuguuggguacacaaaaaaggauuuggaugcaaaugaaacaaugauagcauuuuuccuugucuuacucauuuugugacaaaugcacauugcuuuacuguuugcuauacacauaauuacaguucuuuaauuuauguuucaauaaaauguauaauaauaaacauuuacugcuccaugaauaaacauucgagugaagccucuaauggagguuacauguuucgaggcagcucuguggcuuuuucagaaaucugccuucuacuuaaugagcaucauuuccauaaucugugcauuauugcuuaagccucccuuuaaaacauuucaaaaugcaaaaauuugugaaauaugaucaguccaaaggggaaaaaauguuaagggaauuagcaacuuguccuguuaaagggacaggacaagcuuucaugucccuccagagacaguaacauaguaauuauggagacagcacuuccuaauuaucucacuagcugagcgcaauacuacugugguuuuugccucuaagaucugguuuaaauaaaagugauaagaaaccuggagaggucagccaugaaggacaagcuugugcuaauucucuuuccagugcuaacaaagaaaccagaaaguagaaccagaaauuuggggaaggucaagauaccugugguauggacauuccuggauguagagacagacaaaugguuugauuaaaacggucaccccaaaguaacugaauucagacaaaagccuaugcugagcuuuaugucgauggugucacacauuauuuucaguguguuauuucuuaggaaaauuacuuacauaauuuuaugucauuaucacuuuaaaagguuaaucuauuucagauaaucuuugcaaauuguguucuaaaaagcaggugcuuuuaaaaauaacuaaaacaugaugacauauuucuuuuuucuuuguccaacagccauggcuggguuguuuaacuagagagaaaaaaagaugccaggagaaaugaaggaacaaaggacccuucacagugugauaagauacagauagucagccucugcagagcggugaugaaauguguuaaaagugauggcugucacuucaugacaugucagcgugcuuuauugguggguuggcacaauuuauuuaaacaucgucaggagggacucauuuugguguaguuagaaguuguguuucuuuagugugaauaaauaucucugggcccacgugcaacauuuuaaaacugugcuguuguuuacugugggaauuggagcaaggagcuaagaguuccaaagugaagcucuccuucucccaccauuuuaugauuugcuauaaguaauuugcuccuugcuuugaccguuacuacaaaaucuuucaaaggaacauuauucuccuuaacaggggcuaaauuuaagauuuuucaucauucaauauugcuauuuucacaugugacuucaacaaaauaaaacauucggcauaaauagaauuuaguguaauccaaauccugcuuuucucuugguacauaugcuuuguugcuucuugacauuccugaauuacaaaguauuaagcagaaucaucuuuuuaaggguuacauuuuccuucuaacucaagugagcagguauuuacgucaaagucacacauuuaaaaaugacauccucuuccagcauggggcaaaucucaaccuacagggcugccaaguggagcugcaacuuuuugcaaggguucuacccagaugugcuacaaguccauauuaccuuugaaaucaccaucuuguaaagauaucugcacccucauguccacugcagcauuaucuauaguagugaagauauacaaacaauguaaauguccaucaaaggacaaacagauuaaaaaaugguauauaauaaauacaaugaauauuauucggccuuaaaaauuaagagauucugucauuugcaccaacaaggaugaaccuggaagacauacacuaagugaaauaaaccagacacagaaagaaaaauaucacaugaucuuacuuaaauguggaaucuuaaaguaaaauauauagagauagagaauaaaacagugguuaucagacugcgguggagguugggagggcagaauggggagauacaggucagagaauaguaagcagcagauuuguaggaagaaccagucuagagaucuaacauacaacaugaagacugcagguaaaacuguacuguauuugggauuccugccaaaugaguauacuuuaguugcccuugucacaaaaacaaacacccaaaaaagugaguaacuaugugagaugaugaauaugugaauuugcuucauuauaguaacuauuuuacuauuuuguauauaugucuuaacaccauguuguauaccucaaauacacacaauaaaauuuauuuaaaaaccaacgaaaaagcacauucccuucauaaaugagauucuuuucaaaauaaguuugaaaauauacauuguaaaauauacuagaaaaaccacccccuaacuaacuccccacaacccaggagcucugauuugauagcuuaagacaggauaaaugacuccgauuaggacaaugagccccaguuuuauggggaccuccuaaaucauaucucgguuugggucuagaaugauggugcugggagcacccagagagcugcauaucaucucagccuggcuuccacacagggagccagagagauuuauggggcccugucugguggcuuugaggcacaaacgaugaauacugcuaaagcaauaacaauaaaagaggcaacagacagugggggaagccccagcaccaacccucauuuuucucauaauauacucuguuguacaaugagacagagugauuccauagguaccagccagaaauuacaugaaaaauugaucauguuucuuuuucugggugauaucagugauugaggcccuugauuuaugcuggccaaacuuuuucagugcagaauggaacccuuccuaacuucagucuccguggcucacacagacuggccauuaacagaagacacacugcaucauaccauuuagucaggacccuacacuaacagagggaacugcagcagagucuuaauagcaacuccaauuugccaggaaucucaccacagaucagaaauuuacaguggcggagaccuuuuaggaacuuucagcauggaugcucccucaaggugugggucagaauuugcggcgcaggaggugaggugaggugaauaguuuauaaugauuuuucuaugccuuuuaaccuuuggaauuaacauuuggucaagaaagccaauugaaggcuaaguguguacuugacaugugaaaaaaugaaugugucuucuaggcguuggcuuaggacacugcugagcccuggcuacagccaacucaggcuuaacucauuaaggugauuagccaacaaucaauucuuuaaaauuaguaacauaaaacaggccauaccaggcucauggauauaaaauuuggguaucaaguuuugcuccagagaaaugucacacccucaccggcaaaaagucuauagagguagggagugucacagguaagguugaguuaaugagacauccucuagcuggcaugaauguguaaagugcgcuccauggucauacauccagcaagucaggauuucacagcaagcauagcuuucacuuuaagcuaagugacauggaagguucagguccuuaaccuuaggucacgggaugacaauauacagaaucugcagcuugacagccugggcuuaauuccuaguccugccacuuuccagcugugggaccugagauagucaacaccucagagcuucagauuucuuguuuguaaaaugaacccaucucagaggguugcugugaggaucaaauugguuaguacugcaaaauacccagacuaguacuuggaacuuaguaagcauagauguaagguguuugcagcuaucauugcugcugccgcugccacgauuauuaguacuacaacuacuuaaccacaaaaucugugcuacuugaccacaacaucuuucaguuaaaaaaaauucacaauuuauuuuuuuaauuuaacuuucucuuaaggacuuuaccauuguuuuaaaaauuacucuacugaagucuaauuuacuaaaugggaacagguagaagaaccauucuccuaaaaacuaauguggagucaauauacuuauccugggcaugaagaaacccuggagcuuccaaagaacacagugugaaaaacuuugcuuggggagggagauggaaggcagagaacgaggguuucucccacugggguacaaauccuuaggaaguggagcuuggugauuaagagcaucgagcucuaaagucagaugagcugggaugaaauccccaccccaacuuucauuuccugugugaccugugaaggcagucgaauaucuuaauucuuuggguucuauauuuauaaaaugcagauaauaaagucuauucuucaaagggcuucugagaggauuaaaugaaauaauacaugaaaaccucuuagcaccgccccuggcaccauuagaaaaugccuuauaaauguaagcugcucuucuaguuacuuuuacccagaucucugcucaaguguuacuuccauagagaggacuuccccaauuucuauauuacauauaaacaguuccgguccuaucucaaauuaaaaucugcauuuauucacuuuuucauuuuuuguucccauacucacggccaugaucccagcaucugugacuaugacuagcacuuaguaggcacccaauagguauguguuaaaugaaugaguuaaaaaggagagacaggaaguaucucuaacucaauguuaagagacugcaaaaacucuauuaggcugaaaacuaggaaguauaauucuucaaaguaauaacagaaauaaaacuugaagacauguucuuuuguguaugcaauaguguaugcugauuguucucaagcugccaacuacccuuaacagugcucugcugugaagacacaaaaggggcaggaggguggaucagacagacuucauaugagccacaaugcagguccagccaaaguagcaaggauacaguuggaauauaaaugccuuuacccaccucucacuguuuucuucuccugaaaauugcucuacauuaugaucucucucucuuucucuaucucuugucucauacuuggcuuuccucuguccaugcaaagggccuccuugugauaucccacauucucuuuuauccugacacauugcauagacuccuguuguggguacuguguaguuauauaaccagaguugggauguuuuacugccuugaugcuugcguugugggucuguguaaucuuugcauucaaagugugauaacagacacuggacauagcgcauaacacucagagcugcacuccagguacuaagaugucaugaggcccacgagagagaugcacauuucugcaagggcgucaagggacccaggagaggaagguaaaagccacuacgagguccucugagggcaaacgcucccugcucucuccugacaaugauccccaaugcaugaaguaggauauaguguguuaaggugauaagggcugaggaugaaguggguuggcucaacuggcaaagcacugugaacuggaaauguguuaguguguggaaaagcaauguuaccuuggaugagagcucacuccucucgugaacuagacuuuucccucaagugccuucccccauaauacagucaguaaaaucuucuaaagcccugagaacuggaaucaucucacgaucuauaguaacccaaaguggccuagcaacuagggguggacccuguuaacuauucacaucgccacccugacaaaagucuuccugcucccauuucaaggcucucuccacacuugguuucucugaccuuucugaaccuuucaccguaucuugcucucuggacugcagccccuggcugugaauacauauuuagucucucagccugcccuuccuauagacauauuauuugaugcuuaugcaaagaucacccuuagccuucaucuuuccaugccuuugccauacacuaccuuccuccuccccacacuccuguagucagaugugaugcuucaaacucagcuugagcgcaggucucauuuucacccuccucauacgccuguggacaaguuugucagaccauugguuaaauauucgaccaagagugagguugguaaaaggaaggcauauuuacgagacagaacaaaggcuuugcauuaaacaaaacaaaauggcaguuuuccuucuugcugaaacccucacuuggauauuccuccagaaucagagcuuuccaagacuccacaugauucauccccucucccauacuuagcugucuggauuacagcccuuaguucuuuuuuuauuuuuuagagacacggucuugcucuguugcccaggcuggagugcaguggugcaaucauagcucucugcagccucuaccucccaggcucaagugauccucccaccucaggcucccaaaaagcuuggacuacaggcaugcaccacauuggcuaauauuuuuuuaaauuauuuguacagacagagucucacuauguuguccaggcugcucucaaacuccugggcucaagcaauccucccaccucggccucccaaagugcugggauuacaagcaugacccacugugccuggcuuccuaguucucuauaggagucucuagguuguucugccugagagauucugauaguucagcuaguuucaaccagaaugcugaacccauuauuuugagcaugaaucugcucuccuguuauauuacuaagaagaaaaacaagguauuccauuaaaucugugggcacauccucaaaagcacauaguuuugccgagaucuuacaccugacaauggaagugcuugcacgaugcagguaguaaaacggaaaauaggaaucaggaagcugaucaggaaccagcucagggcuuugaaaaggagaaggccagugagcgcccaccauuugcagguugacagagucaauuuuuuuuuuaaaccugggcucaaagagagauuaggcagcuggauggggagcagacuaaaaaauauguucaccuuuaaauaaaucagcaacgaaauuggaggaggauuauaccucagggacaaaagaggaagaagaacaugaauaccugcuuuacuugaaaugccucccuucucccagccuuuccugcauggaguaugacaagagaggcccuugguaaccuucacuuuaauuagaaucauuaacugcaaauggaaguaagaacaacucaacucuccuugucuaauuacaggggcuaccuuacuccugucuguaaaaggcaccaauauuguccuaugaggcccuggcaugaagacuuugcuacucucucaaguaccaagaacagccuuggaguggaagaaagaacauauuugacucuaccauggaaauucuucuauaccucaacaucauuccuucaucauacucacauccuggcuugacagaacuuauguaucccugaaagccaaaggcagcuuaagggacaggauaguggagaaaaaugcagcccuggaacuagacuccuugugcaugcauccucaucacaccacugacugcuaccuggagcaaauuacuucauaucuccagauuccaguuuccucauccguaagaaaggcacaacaccacugucuacaucucaucauaguuuuucccugacaauuaauaauacauuacauaaaauaaaucuuuaauaaaguccuaggacucaguacuagguacugucuaaauacuagcuaugauuuaacauuuuuauugguaaaguuuuagaaacacuugcuuugagauuauggauucaaaggaagguacaaaauaguacagagagaucccugguaguguacucuucaucuaguuucucaaaguacuaugcugacauaguuuauaaaauauaacauaccuauaguacaauaucaaacccaggacacugacauugguacaaugcguguguauaguuaguucaaugccauuuuaucucauguggagauugguauaacuaccauugcgcucaagauacagaaugaauccauuaccacccaaaucaccauuguaauccuuuggggaggcacuccuguuccuucuccuccauccauuacaagacuggcaaccccacaaccacuaaucuguucuccaccuccacacuuucguuuauuuuucuugaauggugcaauaauaugcugcccuuuauuaaacauuuuuuucuuuuuuuuuuauuuaaacuuuuauuuuagguucaagaguuuaagcgcaaguuuguuauauagggaaauuguaagucacagggguuucguauaaauauuuuuucaucacccagguaacaggcauaguacccaauggguaauucuuugauccgcucccuucacccaccuucuacacucaaauauguccuggugucuauuguuucuuucucuguauccaaguguacuaaaugauuagcucccacuuauaagugggaauaugcaguauuugguuuucuguuccuauguuaauuugcuuaggauacuagccuucagcuccauaaauguugcugcagaggacaugaucucauucuuuuuuguggcugcauaguacuccauggugcauauuuaguacauuuucuuuguccagucuaccuuggaugggcuuuuagguugauuauaugccuuugcuauuaugaaaacuacugcaaugaauaugucuauguaugugucuuuaugguaggaugauuuauuuuccuuuguguauauacucagcacugggauugcugggcugaauaguaguucuguauuaaguugagaaauugccaaacaaccuuccacaauggcugagcuaguuuacauucccacaagcaguguauaagcaguccccuuccuccacaaccucaccacuaccugcuauuuuuugacuuguuaguaauagccauucugaaugguaugagaugguaucuuauuguguuuuugauuugcauuucucuaaugauuagugauguugagcauuuuuucaucugcuuguuggccucauguaugucuucuuuugagaaguaucuguucauguccuuugccaacuuuuaaauaggguuguuuuugcuuguuaauuuauuuaaauuccuuauagagucugaaucuuauacuuuugucagaugcauaguuugcaaauauuuucucccauucucuagguugucuguuuacucuguugauaguuucuuuugcuaugcauaagcucuuuagcuuaauuagguuccauuugucuuuuuuuuuuuuuggucacaauugcuuuuggcaucuuugucaugaaauauuuuccagagaccguguacagaaugguauuuccuaaguuaucuuccagaguuuuuacauuuaagucuucaguaguuuuagguuuuacauuuaagucuuuaauccaucuugaguuuauuuuugcauacauuaaaaggaagggguccaguuucagucuucugcauauggcuagucaguuauucaagcaccauuuauugaaaaaggaguccuuuccccuuuuggucagcuuuguugaagaucagaugguuguagguuugcagcuuuauuucugggcucucuauucuguuccauuggucugugagucugguuuuguaccaguaccaugcuguuuuggcuacuguagccuuguaguacaguuugaagucagauaaugugaugccuccagcuucacuuuuugcuuaggacugcuuuggcuauucuggcucuuuuuagauuccauaugaauuuuagaauaaauuuuucuaauucugugagaagucacguugguaguuugauaggaacaggacagaaucuauaaauugcuuugggcaguguggccauuuuaacaguauugauucuuccuauccacgagcauggaauguuucuccauuuguguugucucugauuucuuucaggaguguuuuauaauucucaauguaaagaucuuucaccuccaugguuagauguauuagguauuuuuuuguguguguuugacuauugugaaugggacugcauucuugauuuggcucucaccuugaauacuguugguguauagaaaaagcuacuaauuuuuuacauugauuuuguaugcugaaaccuugcugaaguuguuuaucaaauuaaagagcuuuuggacagagacuacaggguuucccaggcauaaaaucauaucauuuccaacagaugguuuaacuucccgucuugcuauuuauaugccuuuuauuucuuucucuugacugauugcucuggcuaggacuuccaguacuauguugaaaaggaguggugagagugggcauccuuguuuuauuacaguucucaaggggaaugcuuccagcuuuuguucauuugguaugauguuggcuauggauuugucauuauuauuuugagguaaguucauucuuccaaugccuaguuuguugaggauuuuuaacaagaaggaugucuaauuuuaucaaaaggcuuuucuacaucuauugagauaaucaugugguuuuuguuuuuaguucuguuuuugugaugaaucacauuuauugauuuguauauauugagucaaccuugcaugccagggauaaagccuacuugaucauaguggauuagcuuuuugaugcgcugcuggauucaguuugcuaguauuugguugcggauuuuuauaucuauguucaucaaagauacuggccugaacuuuucuauuuuuauugugucucugccagauuuugguaucagaaaaaugcuggccucacagaaggaguuagggagaagguccuccuccuacauuuuucagaauaguuucagugggaauaguaccagcuccucuuuauaugucuaguagaauuuggcugugaaucugucugguccguggcuuuuucuaguuguugggcaauuuauuacugauucaauuuuggaaauguuauuggucuguccaggguuuccguuucuucccgguucaaucuuaacagguugcauauuuccagaaauuuauccacuucuuguacguuuucuaauuugugugcauagaaguaguaguaauagucucuggggaguuuuuugguauuucugggggguuggugguaauguccccuuugucauuucuaacuuuguuuauuugaaucuucuuuuuuccuuauuagucuagcuaguggucuaucaaucugauuaauuuuuucaaagacccaauuuaugguuuuguugaucuuuuguaugguuuuccaugucuuaauuucauucaguuuagcuccgauuuuauuugaugcucugaggguuugauuaugguauaagagguucaguugaugagcuucauuucuggaagauuucagggggccacggcuuagcucagcacuccugggggaguaugcugcaacccugggggggcugguaccagucccccagcuuuguucucugccccucaagguuaagaaccugcugugcuggaggggcauagguguuccccaucuucuggaaacaacacucugacagaggaugcuggccaaagcacuucacuggggcaguggcagcaggauccaugcuuacuagcaugugcuggcaacaguggcagaaugguggguguaugccaauuuuguuuuuuugaaaaucuauauaaaagacuccuauauuaucugaccuuuuaaagugggcuuuugucauuuaacauuaaugcccuugagauccauacaagcuguuuuguguauuaauaguuuguuccuuuuuauugcuggguaauauucuaugguauagauguaccacuguuuguuuaaccauucaccugcugaagaaccuuuugacuguguccaguuuucagcuacuauaaacuaccugugaacauucauucauguacagauuuuuguguacacauagguuucccuuucucugggauaaaugcccuugggugcaauuguuggguccuaugauaaguauacguuugguuuuuaagaaaucacucggccaggcgcaguagaucacacauguaaucccagcacuuugggaggccaacguggguagaucauaaggucaggacaucgagaccauccuggccaacauagugaaaccccgucuccacuaaaaauacaaaaaaaaaaaaaaaaaaauuagccgggcauaguggcaugugccuauagucccagcuacuugggaggcugagucaggagaauugcuugaauuugggagguggagguugcagugagcugagaucaugccacugcacuccagccugggcaacagagcgagauucugucuaaaaaaaauaaaaauaaaaaaaaauaaauaaauaaaaaauaaauaaaucacuauuuuccagaguaguaguugucuucuauauuuccaucagagagauuugguuucuguuacccucaccagcaucuggugcugucauuuuaaaaauuguccuaauguaugcagugauaacucaucauggccuuaauuugcauuucccuaugggcuggugacguugaguaucuuuucaugugcuacgugccacccuuuauuaucuucaaugaaaugucuauuuaugucuuuuguccacucuacuuguauuguucauuuuuucuaucauaaaguuuuuuuuuuccccacaguuccaugaauacuauagacuuuuuuuccuuuuucaacuuuuauuuuagacuugggggaacaugugcagguuuguuaccugaguaaagguaacuacugugugaagcugagguuugggggaugaaugauccuguuacccaggcagugagcauaggacccaauaguugguuuuucaacccuuaccuccucuuccucucccucuacucaaguaauccauagucuauauuguuaccaucuuuauguccaugaguaccugauguuuagcucccuuuugugagaacacacauauaccagaguuuugagaauucauuauaucuucuagauaugaguccuucaucaguaacuuuuuaaguuucagagauccucucucauucccuucaacuacgagugaucucuucuuucccuaacuucuuuacaaauuuucacauaggaccuuuuauccugucuaucuugagucugccauagauggcccucccuaacugccucacucaucuaugaacaggcucuauuucugauuugucaucacucagugucuugcuaacauuugggcaccuaucuggcauuccacuaauguccaccaagugacugaaucaacuauaccuggauuuucauucaguuacuauaagacuucagccuaaagcaaaagccacgguuaccauggauacgcaggcuugggauagauauguauccuaagcauuuaauacuuuggaaaggauaacuaauuacaaaaagaaauacacacacucagauguguuagugauuaauuucuucucagcuaccacacuucuagcuaacgcugugacacacuaacguuuauugaggaguuucuauuuacgccaaccuggggcucacauuuggcuaauuaagaacacauacauuucagaacuugugaucugugggcuguguuuacauaugaacaucauauucaauacacaggcaauuguuuagcaccucuaaccuauuucuagccuuauauuuaauuagugagaauugcugauggggaacgcaggguaugacuuugcauuaaacaaacagcuauccuccuuacaaaucacaacaacaaugcauaauuaaacaaugagcuaccugagcuuuauucagucuuucuuccaaaggaauuaaaucucuaaugaggaccaggccucaggaggaacugcagaaggaauagagguaaggagacauaggggucaauucuagcccugcuuccuggccuuucugggucuuaauguccuuauugugagaugaggaaaugaauacuccucccuggcuccccauccuucucuucuucucucugguaugcauguucuaaagaucacaugcaauaacagaggcaaaucucuuugcuaaaguaaagcauaauauaaaauauaagaauugucacugcugugaguuaagaggauuucauuauuuuuacacuggagaagaaaaacaauugccauuaaacagguucuccaugaccuguccccaucucuucccugcccucaucaccuguccuuccucucccuguucacauguaccagccaccugaccuugcuuugcuccuucccaucauaucaggcacaugccagccuugggcaaaucccccuccucaucaaagccuuuccaugaccgauccuccaauugaaacuaucacucacuccccucuuauaucacuucuuuuaauacagucagaguacuugccacugucuaaaaaaacuguuuguuuacuuguuuucuuuucuuuucuuuucugcuuuuccuacuauucucuccugcuuuuccuacuacucuccaccagaaucaggagcaguaaacucaauggcucugucuuacuuccaugcuacaaacucaggugaguucacuguagccuccaggagggaaauguacauuauguucucugggacaaagcucccaggcaacaggcaaaaauguuccuuuuauucuacacaacuuuggaaaacaccucugaauccaacguugagagccaucauccuuaugcugaguacucaagagcucccaggauucuacagcccauaaaugagacaauuugacaagagucacuaguggugaccacaguaauaguauuaggaugaaccacaugaaaucacugagauucacuguuuuggcccuaaccacuuucauaugguuuggcauaguaacaacaauggcagcaggagcccuugcuacaugccaggcuuuguauuaaggcuuuaauagauacuaguucauucacuucccaccacaaucuuauaaccuaaguauuaauuaccuauguguuaugcauggaaacagcaaggcuuaggaagguuaagggauuuuuccagaggagaggugguagcaucaggucacaaacuuaaccccguauuauccuggaagagcuaauguguguucccuuccuagggaccaccaugaacccaccuggguucugugcauggaaauaacacagaaauggaaguugcuguuuuuugcuuuauugccuccacgacuuuguagccauugcuguugacugggaaucucuaaauuacaccaacacucagggucaucugaguugacaacuuucauggccacggccacuacgcccaagaaaaaaauaaguuggagguaaaaugggguauaaaacuaucuucuagcacuuucugcuaauugucuuuuacccagacaaggaacucugaaggacucugacaucaguuugcgaugccucagcuaccucuguccuuuggccaucucugacccuucagccaacuugggacccucaguccugguaagagaucaucaggccuugugccccccaccccaccaucuuggugagcugacucuuucuugcucacaccauaccuaaguuccaaauagaacuuuagggcaucugagaucccacacaggccuccccacugcugggaucaaugauaaccaucucauggaaagccucuucauugagauguccccaguuacaucaccccaccagcccagcauucuccuggcucaccucucuccagccacagaauuugcaucucacagcugagaaaugggauuggucuucuccucucuccaugucucugaaaacaucacucaaccaccuuggcucaauagucuccugcuucaaccagugccacugagcaugccaaucucuuuuugucauguugacaucauguguggccuugauuugccucccccaaauuccuccuaggauggcccuucucacagccuugaucucauccugggcaccuaaagggguacugagaauggucccucccacagcuuugacugaaaguucuuggauuccuucuauauccagucaauuucacuaccuucuacuuuagcuacuuagucuugcggauguuugaauuuuuuggacacuggauuuuuuucaucguauaaaugauuucacaucccaaaucugacauuauguaacaccucuuuccugaacaaccugccgaguuugucuauaagaccacccacacugugcauuaaguucaccagguauaaaacauagguggccauugcaccaccaaagccaguaucccagacacaguggguuggagacccucgggacaugcagacaucuccccacucccagucagccaucugacucuguggagucuccucccucucuuguuaccauuccucaguugugccaaugugacacgccacuuccagacucucaccuccccugaccaaagcuagaggcauggccuuucaaugaucucggcuuguggucucaccauagagucuauaugccacauuccugcucaacaucuagaggugucacuucaagcuacccucccauuauaggguauuaagcucugaaguuagccaguaagggggaaaacaugguuaaaccacucuggaaagaucccuuaaacugaccaaccuucaacaaaucugaaaagucuaauuucuuuuucuuggaaccaagcgcugguucugcauuugaacacaaguuggaguccugguuaggauuuggagggcuagagggugcaaaaacguccuuauccauuagggucacacucaucacagcaagaugcuccccuuguggacagcugugugggacggcagccagugaagaggagacuagccacucugaagccuacguuccuugaguagaaugguccacaaucuaaaucuagggguucacuccuucucucccucugcauuugucucucuuuccaugucugcuugugucugucucuccaccccccgaagugugugucuggguguuucucucugaaucucgguccccuagcguauguugugucugucuuuauguacguaucuguguguaccuggcucugugucucucucagcauguuacuguguuuccauguguguaaggguaaaucuccccugucucuaucucuucuugucuuucucugcaucugucccugucucuacguguguaccucuuucuugguuucucuguggcugucucucuguuucucucucggucuugaugucucucugugugagugucucucucuccuuaugacugucuucaugcgugcauuggguccuugugugcauguccuccuccuccagugagugucucccuaugcacacauuucuugagguguagggcucugcaaaacacuuagaguugacccauuucaaauauguuagccgcacaugauucccggccagguaugccagcgcugcccucuucugcauugccacgcagacgccuaccuuggucgaaacacuugcagacauaucuuuagcaagguaucuuuccucguuuuuccccaacaaaacucaugcuguaggaaucuccaacauauacaaugaaagaguauugagcugccauagauaaauuaaguacugugcucggccucccacucagcaccaagaggccaaacagaaucuaaaaccacugcugacaccuagcacaccaaaccuuuccagccucugcaacuggcauucucugcaugucaaaaaccucugaaucauucugggucaagcacacaugccuccuuucacaaagguucugcaaacagguagcauccuguaccccgagugugugccugguaccuacugguguacccccuucucauugagagguccugaugccuguggugugagucaguuugaguguguuaauggaguguucugcuuucaaggccaaacugcauaagcagagcccauccuuuucccuucuuuugugcccagaugggaggaauuugugaaacuuguauuccaguguuaaugcugaaguugggaaauggcucaaucaagcaauggcaguuuaacuugaagagugcaaaggagaagagcagggagaaaaccaacacuggaagcaaaucagaaggccagaaaccuucaugggcacuugcacuauuguuuacagccacaauaaucauguaagggaacccagcauuuuucagaaguuauuuuguucuguuuuuuuuucuuuuuuuuccaaauguguguuuguauugcuuuguuuaaauauaggccugauucauucaggcuugggucugaagaucccaggcuuucagaacucaacaaagcuuucaucauuugcaaauaauucaacucaacaaauaucauuugagaaaagcucugugcuagugcuucuuguagagacacaaugaagaaaaaaucacggucccugcucuuuggagacaaauaacuuaggggaaaacacacacaccucucaacucucaccuaaggagugcugugcaaagugcugaaggagauggagacuccucuccugggaaaaucugcaauucgaaacucaaaagaagaugaggcuaagggcccuccagguggaggaacagccugaguaaaugccuagaaaggaauggcacauaguaggcacuugcaaucaaagcuuugcuaaaugaaugcauguugaacauguuccagaaaacucaagaccagaguagcacugagaaguagagguguuucagggcuuccuuuuagaaauuucuuauacugaagguuucagaaugcuaggagggaccagggagaugguuuauuccaacugguuucuuuugaaaacgaagaaaccaaaaacccaagcuuacaugcuagggccagaaaugagaugagaacucagaacuguuccagaagguaaucacuuugaauuuaaaugccuacucuucugaucucaauuuaaggaacuaaaacaaaaucagcaguacuguuugcuaguuuucugugaaucauucagacccuggagaagccagcuucacuuuugaaagcugagcugauccacuuacaacuguguggcuagguucccauuacugagucucagucuucacaacuguaauauaggaaaaacaacaguagcuaucguacagcguaguuguaaagauucagugagaucauguacaaaaacagcucuuaacaaggucaucagugaccuucacuuugccaaacucaauggacauuuuuuguccccaucucacuagaccucugggcaguggcaucuggcacaaaggggcugcuccuuccccaaaacaccccggcaccggcuccugggauagccuucuuuccugcuauucuuucuuucuggauguuccucggucuccauugccaaguccucuucuauccaauuucuaaauguuggcaaacugcaagagcucaauucuauauccucuuaucuuccccagcgacacacuuuucucauugaacccauucagccccuccgcuuuacacaccauccaaauguugcuggcacacacuuuuauaucccuagcucccacuucuccgcugguugucagacucaaauaucaaacuaccugcuugagaucuccauguggaagucauagaagagucucaacccaauaugucaaaaacugaacucuccauugccccauucccaaacuuaguuuuuccucaccugcuuaaaugguauugauacucaaccaugacuuaagccagaaaucuaagagucauucacagcaccuccucucccccucucccaacaucugccaucagguccuaaauuucauuugugauauauauguuaaccguauacguuuuucuuuauuucuaccaccagcacugucucucaucugaaugacggcaaucaccuccuaacuccacuccuguaucuccacagucaguucucugcccagcaaccgccaugguguguaacaaaugaaacugaucccaguacucuguguuccauccaucaguggcuuccucuuguucauagaauaaaggaugaaaccugaaauacuucuucaaacuucuccaggaucuacucacaaaaauccucuggcacagcucucuucuucuaucauuuggcugcauuucuacuugccuauuuuucauacucggaacaaucaugcuuuuuguagagccagggcccucacauguguugcucaggucuuuagucagcaaacucuucuuccuuaaucuagugguuaaaagccccagcucuggagucaaacugacaggggcugggugacuaaagacagucuucuggccaggcaugguggcucacaucuguaaucccagcacacagccucccaggaggaucaccugagcccaggaguuugagaccagucugggcaacgaagcaagaccuauuugccaaaaaagaaaaagaaaaaaggccgggcaugguggcucacgccuauaaucucagcacuuugggaggccgaggcgggcagaucuugaggucaagagaucgagaccauccuggccaacauggugaaaccucaucucuacuaaaaauacaaacauuagcugggcuugguggugugcaucuauagucccagcuacuugggaggcugaaccaggagaauugcuugaacccgggagggagagguuaccgugagccaagaucgcgccacugcacuccagccuggugacagaacaagacugucuccaaaaauaaaaaaaagacaaucuccuuaguaaaacuauguaccuuacuuuaaucaucuguaaaauggggauaagaacaguagccaccucacauaguggugaauauucaauaaaacaaaaugugugaagcacugaaacuacuaccuggcagaagaaaaacacucaguaaacauuauugucaaaaaucccuaucauccuuuaguucucaucuuaaauguuucugcuuaaagcacucuccauuacucuaacccucaguuuuaauccauuuuauuuccuaguacuaaucuaaauuggucaucaaauauugauuuugagacuuauuguccauuucugccucucaaauuacacucuacagaacagggacuuugucuguguuuccuucaguccuggaaaccuggcagaggagcugaggaacugagcuuuacaggcugaguucugugacccugugauuauuauguugaagcccucauccccaguaccucucaaugugacuuuaauuggaggcaggggcuuuaaagaggaaaguaaguuaaagugagaccaucaaguuaaaauuaugcccuaauucagucugucugguguauguauaagaagagagggaauuuggauacacaaagagaaaccaggggugugcauucgagagaaaagauugugugaagauagagcaagaagguggcuagcuggaugcucacaagaggggccucaggggaaaucaacucugcugacaccuuggucuuuggcuuccagccuccagaacggugagaaaauaaaugucuuuuguuuacaccaccuaaucuguagcauuuuuguuauaucuaccauaaaaacuaaugcagucaguaaagacugaugagugaauggaugaaugugucaacccagugcucagcacaagguaaguaugcacaaagguugacuccuauuccugaaauaaugaugaugaauguaauaacaucucaggagcaaaucuaaccaaugcacauugaccaagucacugagaaaaauaugucucaguggcacuuacagugcuuuucaccuguaauacugaagugaaaugugauuagcuaugaagaucugagaccuuccuuuaggagccagcacauacuacucuaugacuucuguuuacuuaauuuguacauguuggaacuugacuguuuuaugguagacucuuggcuauacaacauggaacacuagacauuuccauacucaguaaacaaauauuucucagacaugacagcaaaacuagaaaugagaauauuagauuaauacuuccaaaauaacagccucaucguuuuaaucaacauguccuugaacacguuugaauguguguguaacugugugggaaugugagcuacauguguauuuuuccacugaaggugaccauaccauaugcaagagcaggaucucaaauuagauauucagcauagguagccauauuauccacaucuaccaacugucuucaaauuaaagcccuucucuagcuggaacauguaucugucacuggaaaguaggcaguguugaaaaucaugacaaaauuggcacauaucuugauaguugcaucaucuuuucuguggcaguccccaguaauagagcuucaucuaauucagcaaacuauuagcucauaauaagaaacagcauguguauugauucuuuuaauagaucuuggaauuaauacacaugauuccuauaaaaggacuguauaaaaaaaaucaccaaguugauuauugcacaaugaggucucacucaaauggcauaggcuacggcagaaagguaggcaauuccucuuuugaaaaaaacucuccaucuuacagacugauucucuccugaggaagaaaaaauauaaugaagugcuauaauuagguaucucacauguaagggaagauaacaaaaucaggaacagcaaauagguuuuuacugagugucaacuccauucaauuagcugcagcuaccuagaggguuguauuaagaagcccaaggucgacaguaaacaaugccuuggugaaauaaugauguuggcuaggguugcaaaaugaugaguagauggccgcuauguaauuucuacucugaaacagaugucacuaaagucucuuccggggccaaccuucuaugacucucuccuuuuuucuccucuucccucacucuugcucuuggaguugggaugaauaaguuagcaucuccugagaaucccaacuuucuccucuuauauaaaguggucaggcucaguuuucaguaucaggauucaaagcagcaaccucugucauuacaaucaugugucgcuuugguauaggcauugaaaagcuguaccagggugcugacugucacuuaaguaauuagacuaaacuauaauaaacaagaagagaucacugcuggagacccacauuuguuaaugaccuccaggguccucuccccuggcaagagauagacagaugagguaccaggagugcaggccuccuugcacguauaaugacaacagccagacaacaaugcaacaaaaauggucccauguccuguucuguguguauagggagagugaugacaaucaucauuaccaccagaacuaccaaauuuccucuccaguucuuugaugcuucucaaucauugucggagcuacccuuuaaagaugucucaccaugaacaguuacuaugacaagauacuaagaagagaguguuucauuuaaccccuuccaucacuaccccuaugagacaugauugccuuuacuugacaggaaaaugagguucagggagguuaaauguauguagaagauuuuagcaagaauauucugacuugaaaucuauguucuuaaugauuuaggauaccagcucacaacucaaagcaugaagcauguggcaauacuauaggagguaagagaucucaugacaggaaacucggguuauucauucauucauccaucuagucauucauccaugcauauauccaucucuccacucagucacugugucaacagauauuuaccauguaacuaucucuguacuugguacuggggcagaggugagcaaaacagauaaagccccuggccucacaguguucacagucuaaugaaagcacaaacaucaaucagugacauuacugugcaaucacaaauugagauaauacuugaaaggaaaguaaugggagccuaugacaaagaucuggauuugggguagggucagauuuaagaaaaugagaccugagagcugaacugauaggcaaguugacauuaauuagguggaaggcaggugaaagaauggggcuagagaacuaauaaggagauaauaacauauguagagguucauggaggaagggaauauaaaguauucaaggagcuaugagccagagcacaucgagcaggucaaugagggaaagagugguaugagaaaaaccuggaaaggcagagaggagguggaccauauuaaggugcauaggguggcaguggaaaccacugaaaaauuugagagagaggaagacaguggguggaagaaaggggacaacugugauuguucagacuucagugaccacaaacaauacagggagcauggugagaucagaauggagaugcagcaaccuguaacaggucacuuaguucagaucagagacacuugguagcuuugauuaggugauggugguagagaugagcagaaauggauggauuuaagaaauauugugggguaaaaucuaaagcacuuacugauaaauuggauuugggaagaugaggaagcaggaggcaaggauaaucccuagauuucugaccugaccagauagauguugcuacucacuggcuggcaacuucacaagguggccuuguugacuuuggaauaccuuuugggcauccuaguggaguggccuaaaagggaguuagguuuuacauguuaggaguucagaaaagaggucugggguggagacauuaucuugacagucaguuuuauagcuagaaaugguugaggcuuugggauagauagagaagggguacuuuggaaaacaauguucauggaaagcaauaaacauucucgucaaucacuauauucuucuaauacacuucuuccuuuuguuaugagcaucugcaucuuucuuccucuugcguuucaauaaaagcuucuauuuuuaauuacacuucccuugguucuaauuuuuaaaaguauuuugcauaucuguuuuauacuauguaucccuauaaccacuccaacuuuuguagaaugaggagagaggaccaauuacuaguuuucagaagauccacaugagacuccaaauggucaaauuauccugacagcgaacccagcaaggaauagauuaaauuugaauagugcacucaaaaggacuaucuuugagacucuaagacgauucuugauucauucauuucgugaaagccaaaauguccgaaagugguuugcggaugaggggacugaaucgugaauuugaggccuaaagaauuucccaauguucagccuuaugguggauuaaauuuaccaugacuaauuggaggauucaaagcuguuaggaacacuagcuauuagggccauuuuucucaucuucgaucuuacugcuugacugauucauagcuggaacugcuaggccguuauggaaauggaaaugcagagaugaagcaguucccaaugucaaaaacuuccagggacauguaaauacaauacacguaccaaguaaugaguuuaauuacuuaauuauuagauacugagcacuaaaauuuaacuaacaccugguuccauaaggaaaaaaauacuucauuucgcuguacuuauagcucuuuauuaugccuuuugaauuaucugaaauccacugauguacggguaaaaaacuccugcagcuagcucagugucuguccaaauggccacccaguuuugugcuugaaauccaggaccccacugguguaggcaucuguggggaaucuccuggucuguggguugugaagaccaugggaaaagcgugguaucugggcuggagcgcaccauuccucaaggcacggucccacauggcuucccuuggcuaggggagggaguucccugaccccuugugcuucccaagugaggcgacaccccacccugcuuccccucgcccccugugggcugcacccacugucuaaccagucccagugagaugagccagguaccucaguuggaaaugcagaaagcaccugccuucugcauugaucucgcuggaagcuguagcccagagcuguuccuauucggccaucuugacagccaccaccccauuuuucaauuuuuuuuaugacaggcuaacugugggcuuuccuaagagacaugagaguaguauccuuccccuacaauccucaggccuagcauggugucuggcauauaacaaauaaaucaaugcagccucucaaggaauccucaaaauacagcagaaucauucuagaaaacaauucauuucgauuaaagaaaugaacaccauagagauguuccauuggaagacuuuugaaccaaaacauuuaauucgccaguccugaccauaucuauaacaaaaggaacuaugucuuuaacguauuuuucuugaaagccaguucauaugguugagagagcuuauaaggaauacuaaaauagggaauauaaucagccuucuguuuuugagcaaaagugcugucaacuagagauggggcucuuggaaaauacuuuauacugccuguucucaguuuuuuucuucuuaagagcuacuucauuucauuguucaaaguuuagugagagccaaaagaaaauacaaucuauuuacaauaaaccuauacuuuccagaaucaccuuaaauuauuucugcuaacucuaagcauaaaucaaaaguucugaaaagcagaauggccuaaagaggaaauaugucauuuguguaguuuugggaggggagggagucuguuaggaaagauaaauuauuauuguccuaagcaaaaggacagcuaaugaauuccuaaaugacaggguuuaauccucaggcuuguugacuacaagguuauagagcuuucuuccuuuccauuguuaaggagauauuuaaauguaaacaucuuuucuaaccuuggaaggaaacugauggaaaacagugaguauuuucuuggugcaauuuaaauauuaaauucaaacuuaaagcaauuguucacacaugcauuugcuagcucaagaacacaaacauaaucugugggaauaagaaucacaauaaaugaaauaauaauagaacaacugaauccaucaauuuuucuagcauauauacacuaagcaaauaguuugcacuuugcauaggauucagcauugccaauauuuuauuucuaauaagccagguauaauaagaaaagcaaaauguauuggccaggugcaguggcccaugccuguaaucccagcacuuugggaggccaaagcgggcagaucacgaggucaggagauacagaccauccuggcuaacacggugaaaccccaucucuaccaaaaauacacacacauaaaaaaaaauuugcugggcaugguggcaggcaccuguaguccccagcuacuugggaggcugaggcagcagaauggcgugaacccaggagguggaguucgcaaugagccgagaucacaccacugcacuccagccugggugacagagcgagacuccaucucaaaaaauaauaauaauaauaauaauaaaagaaaagaaaaauguauuguuagucuuaaauauuuucugguuuuaaauugagucgaaaacucauggcucaaguucauuuaaaguccaagucugaauucuaaagguuaaaugcuaguaccguuaguuccucaaauuauucacuuguuuuuuauuuuuguuacaugagagagagaaggaggaggagagagagagagagacagaaagagauaucacagaauuagaacuugaaucucauucaguggauagggaugagaagaaaaaugaacauucacagagcgccuaacauguuucacguauccaaguaucacaucaggaacuuucauacuuaugauuucauuuauuccuaaaaauuaaguaacuaaguuucagaaaaauagagugacuugcuaaagauaauucagugacugagugguggaaucccaguuuugaagauagagcucuuugacuccaagaagaauucucaauccauaaagcuuuacuacaaauuagggaaaauggcuuaucuuuaaaauagcgugugaauaaauaaaugaguaaaguuuccauggggacauaggcagcaaauuaacagaacacaauuuaaaauguuggauguaaacuaauaaacagaugcaugucacuaaaacgucacauuuuucaucguaacaguguauuaucuguuggcaaagaccucaguaaagcuguuuuuauacaacagaagcacagcuggcuaaaaacagaacaaauguggucaaccaacuaaaauuuucaauucguucaaugccaagaaucugcauggaaugacguuuuaaauaaaacaaccugaaaguaagcugacccauaacaauuugguuuuuaucuuuaauaacuuuaaauuuuugguuaaugucucuauaaacagccuacauauuauucaggguaaaggcucaaauauauuauacuaaaauugcuuuuagacccagaaaauuccuuugcauggagguaugaaaaaggaacauuugaaauuagcuugaaauuuggguguauuucagauaugacaugccauucacauucauguguuuccauuccccaugaacaaugggcugcgugggccaguaucaaucaucuauuaauccagaacuuuccauacuaccuauuaguuaauaaaguacauugacauccauuaccccaugugaugggauauuuaacacacuuccagaacauagaauaaaaauaaagggguuuauacuuuaccuagaaggcuagugacuuaagaauuuuggugggaaguuucauccacuagaggaaaagucuuaugauuauguggaaauuauuuaucacaugcccccaacaaaccccacaacaucacaauagacaaauaguggugcucaaauagugaacauuauggaaauaagggagaacauacaucucuacccauucccaauaguuuugaacuuagguauuuauaaaauuaauuucaugaugcugcacauaaaucuuaauucuaaugugcauaaacagaaaaaagcaaguuguauaauuauucuguguuauuauuuuuaaaagcccuauauaucaaaccaaaacaaaucaauauaaugccaccaaugugaauaucauuaggcucagcaucuuaaacucagcaugauauccaucgggccauaaauuugaaggaaaauauucaauaccaguuucauaaaucauauuaacauuaggagaaaaucuauuauagcacaaagucuuauucaagggaaaaucauguucauaggaauuaaacaaacaaaaaaacacuuguggcccucugcucuauuauccuuaaauuuuaggaaauaacuaauuauaggagaguuuucagucauguaaaucagagaguuagcaaaacaaugguuauauuaugacagcaaucaauaauagcaugcauuuuuauuaaaacauuacuuucuaaauuuguagggcuuuaaauugucuagcagaacacagcuugaaguaugauauauggauggagguucauagaaaauauaguguaugggaaauacagacuccacucaggagauauaucugauuuaaacacaugcauauauaugugacaauauauaucuaauuauauacuaaaucucacagaacuacauaaauaucuucuugcuugcuuucuacaguuucuuuaagaaaauauuauuuaagaggugacaaguuucuuguuguuguugagcaacuugaauuacuuaguuucuugcagaacugugucuucuuccagcuagaguguaaaaucacuuggaaucauaacauauucaaagaguuuugucuuaacaaauccaugagugaucaacuuccuuccauccucaacaaagcugagagguagaccuugccaguucuaaccuagcacuggaguuuagguuuauuagauuuagccagaaccuucaagugauucuugaaaugaacuuuuuaaagagaauuaauuaagcccaauuucuagccuacaugauucccaugacuauacauuuauauuagaauugauauucaaaacuaacuauaaauauuuaaaauccuuuuaucaacaaaugaaacuagaucagcacagagaaaguugaacucaacuucuaauuuccuccucuuggcucuaucaaacaagagcaaaucaaacuggcugcuaagagaacugaugaccaagacagacugggaaaugagacuucuagggaguaugucaccgucuuaaaggccuuucuagacuggaugaauagaaauaacuggcagauaaaacugauaaacugauuugaaaacaucuaaguaaacauggccacaugcaaagguauccagagaaagauaauucuagaauuugcagauaaaacugcugaauugcuuuuuggagccugugaagaauuacagcagagguauucuaacaaagcagagguauucaaacaaauaagacucuuaguauucaaccucccauugggcaaaaacuagaagcuggcacccaagagagaaagcaccucuuucuugucccccaagcauguggcuuggacuggauuuuaccccaagucccacuguagccagaaacuuucauguagggcauaaccugugcaacucacauaugguuguccuggaucuaaauacuguauaagaauaaauaucucuuuaucaaaagaacuaacuacagcuagccauguguuacuuaacaauggggauacaugcugagaaguauacuaguauauuucacccuugugcaaacaucauagaguguacucauacaaaccuagaugguacagcucucugcacagcuaggcuauaugcuauacccuucagcuccuagguuacaaagguauagagcauguuacucacuuaauacuguaguuaaugguaacauaaugauaaguauucauguaucuaaauaaauauagaaaagauacaguaaaacuaugguauaaaagauaagaaauaugguauuccuauauagggcacuuaccaugaauggagcuuguuggauuggaaguugcuuugggugagucagugaguaaggggugacugaauuugaaggccuggggcauuacuguacauuucuauagacuuucuguacacuguauacuuaggcuauacuaaaugaaucuucuaaauuuauguaauaaauuaaucagcuuacuggaacuuuuuaacuuuaucaacuuuaauuuucuuaacuuuuugacuuuuguaauaacauguagcuuaaaacacaaauacacuguacagguauacaaaaauauuuucuuucuuuauucuauuuuuaaaaccuuuuauuuuuuacuuuuuacacuuuuguguuaaaaaccaacacacacacacacauuagucuaggucuacacaaggucaggaucaucaguaucacucucuucuauguccacaucuugucccacugaaaggccuucaggggcacucaccauggagccgucuucuccuaugauaacaaugcauucuucugcaauagucccugaaggaccugcuugaagcgguuuuaaaguuaucuuuuuaaaaaaauaauaaauacacucuaaaauaacaauaaaaaaguauaguauaguaaggguacaaacuaguaacauagucguuuauuaucaaguauuauguacugaacauaacuguacgugugauacuuuuauacgacuggcagcauagcuuuguuuacaccagcacugcuaugaacaagggaauaaugcaauggacuacaacguaaagacagcuacgacauugcaaggcaguaggaaauuuucagcuccauuauaaucuuauagggccaccuucauacaugcggucugugguugacugaaauuuuaugcagugcaugacuacuauaaccuuacaagcuugauaaaaggcagguaaaauucuaaaaugcacuguuucagaaggguugguggaagcuuggcaaagguguucacgaagagccagcauggcucccaaaggcaccucaguuucuauguuuguuggauaagcccaguagauccaaagaaugcuacaaaauacaacauauaguauauaaagcuaccauaauucugcuuuaggggaggauggagaagaaaagauuagaugaacaaaggaagaaaagagugaagaaaaugaagaaaaggagaaggaagaagaaagucuaagaaacauaaaagaaaaaagaauggagaaaagauaucuuagaaaauggaaaaugaaggaauuaagaagaaucaggauaucugcaaguuauaugacauacucucucacaauaccuuugcgaagcaugucauuuucaucuaacacagcagggcucaagcaagaguaauauaguaauauucaaaaagaccagggguagguagucaguuuuccaccuuuaccaauauggaggaacacugauguaaagaaaacuaucaccuaucuuuuuagggaggcauuuuuaguguauaaucaggacuuuagaaggcaaacuuucuuuaggcuguacccaccauugaccuuaacugagaacaccucuaccaaggucagggggccaagacucuccacuccaggugaugaaaucauacaguuucgauaugauuucacaauaugaacuguagauuuuugauaaaguaaaggccuggccagaaaaagggcagaaaccuauaugaacuuuaagguggucagaaagcucagcucuacuuaagaaacacuuuuagacucacuuuaguaggcuaucaaaacaaaaacaaaaacaaaaacaaaaaaagacacaaaaaggaaaaaaaaaauaguuguaccuucaagauaucucuugcaggaagccuaguccaucaagaaauaaaccuucaucucccgauuccaaaaaucagauaccagcaguucucacaaugccucuagugguaauucugugguuuuauaucaaguucucuauccuccccagagacucacagaaauggcaucucagcacuuuuaauccauuacuccccauuaaguccauuaguuacauaagccuagaagauaccaguauaggucagcaugugccaaaguguguuuccacaagcacucaacgcugcuagaugcuaaaacacgcucugugaacaaaagcgcuugcugucaaaugcuuuugagagaugcuagaguuaaacaaagcuaaaguuguuuauuugcugccagauuucugggagccuuucagaugccaaugcagccuguggcagugcaggaaagagaccaagaaugcaacauuucccacacauucuucacuagggucucuucaucuucgaauuuugcugagcaucaucacagucaacugcucuaaugaacauauuuugggaaauauacaaagaagaggucagcuaggucaugugagaaauccauguuucguucauugcucacacauuaaauuuucugcacaaacacauuauucucugugaaauuauccuucacucguagggaaaacaacaauagaaguccucugcaucuaaauccaaagggaucugagcuguucuacgcauauuuacuguguugcuuaagaaugucucaugguucuuuccuauggcaaucuccauuccauuauucaaaaauacaaauuaaucacauucuaagcaauuguucaguuuccuucauuuguaugugguugcagucuguaagugaaauuccuuaauuucuuuucucaaagaaagcuucuauccauacaaaacaguccccaaacccccaaauuuugggcucuaauaugaguuaaguagaaagguaaaugcuaauguuucauuaauccuaacgcuugaauuucaccccaaccucugcaguguucugcucucucugaagugcuuguuugcuuuucaguuccccaaauuuggcucugguaaaaacaaaacaaaacaaacaaacaaacacuaaugggaacaguaacuguguuuuguauaauuuggggccauuaccagcuacuuuaugcuucauuugcguacuugcguguauuagauacauuuuguuaaguucaccuaaggauauuucccucaaugggcacaaauucauggugccuauaaggugacuuuaguacagcuucaucaucuacacuaauauuuccagcagccccucaaaagcgagauauuuucuugaaaguaaaauaacaaaacuuacuguaugucugauacugcagaggccacuuaaauugucuauaauaaguccaaggaaaggaucguugaaguuaacuggccuugggaauuucaaguacaccucccuuugaaauaaaaccauuuccaaagaacgucaugucaaaugcacaucucccuccagaaaauuguguuuucuuuucaccccacccagaacauaacugaauaucauuuugcuggguagggaaccucccuaaccugccuuaagucucaucuauuuccauuuaaccauaguucccagcuaacacuaccucuuucccaaguuuaccucuggcaagacaaaaaggauggucuuuaugaacagauggucuuuucaagguaaaguaguuacauuuaaauacagauaaauguacuguaaaaaacggcuuuaaaagaauuuaggucuuuaagggggaaaauaugagagcacaagacacuauucuuuaauuacaugagauuucuuuuuucuucccuugaagacaaaaccaauuccuaaugaagcauaaugaaucguaaagaggcaccaaugcucaucccaacagauguuuauugauugguguugacugaacacaaacacaaggguguugcuuacuauugucaguaaguggugggaagcagcaccaguucccccugguuauuuuaccuuucaaagacaagcugacaaauuuauuuugucacgagcagcuguguucuuauuuuuauaaggguuggcuuacaacuaagaaagcaagcggagggaacagccuuuugguguccaauguguuaucuggcaaggacagauuguuuuagggugcaauggaaaagauuuuuaaugaaacuacauuucaaacgagcagcauaugcuugauuuucccuucugcuacucauccugccauuuguuaauuuuuguuauuguuguucuccgggacuccuaaauuuucauacaagcugucucguccggcacuaacacagcuuggggcgaauuaaugcuugggaugcaaaaaccugcacgucccacuccagccauuuuuuuuuuuuucauuucuaaaauuucuacauucaaucaggguuuaaccggugaacuaguugacggaacaagcagggauuaaaaaaaaaaaauuccuccucuuugugaguccuuggagccccagagccagaaaaugugacuucagaauauguguggacuugucagcagcucagcugcacacaauuauggggucagagcccagauuggaggucuggagaaacucugaaauugggaauuaggacaaaauuuuuuucuuuuuaacaccguaaugccacauauuaauuuaaaugauucucucagaaugauucuguggcccaguuaaaugaaguucaaggaaaugaauuucagccuuugacacucugaguccuauuugaaaguagucggcuuuacaagauuaaaaacaaauuacagggaauacgaaaucuuugauuagcaggugcuuugauagcugcaagaauauuuuuucucaaaaaugugaacacacaugggagaggcaccacuauuauuaucuuuguguggaaggccuuauaaugaggauuccauuguguccagagacugaggacaugaauugcuaugucugaaggguccugguucaagaggugauuucaguaagacacagcugauagauagaaccuaagguuucauggguucauaaacucucuuuuuuugcuaaccucccauaaucaauugaagaauuuaagggacucaccccuuucuguaggauucccuucauaacuaaugggaggcagaacuuuucaacagagaaagagaaugcucgacauuuuucaauaccaugugcaucaaccaaugggagaaaagggucuuggaaguuuagacagagucuuuggucagcucugagcucaggaagacugaaguccauguccagguugccccauucacucauuguaugaccuugggcaagauacgucaauucuaaggaguucaguuuucucgucuauacugugggcauuucaagggucacugugcagaugaaacgaguuaccacaggguguggcauacaguaaaaacaaguuaaauggcaacaaaauauaaucagaaauugcaccaacgucagugccuuauuccaucucauuucucccauucaguuaguuuccaaguuauaaggguucaaccccuucaugcuaggcccugugcagacaugccuugcuccaucacauguucagccuugaauggauaggaauguccacugcuuggucacuguuacagaacuacacauaugagaugcuccaucauuauguaacucauggaccagcuagcaagauggcacuaguguccuagugaggauggguacucagaaccaagauauuagagacagaaugugcccuguuaaguucagaacauauaaaguaaauacucuagaguuucagacuaacuugauggaauauucaagaggcuugauaagcccugaauggggccuugugagacauagggccacuuaaccuuggacaguaagaauauuauugccagcaacucaagugugucucucaugaagaacuggggcuaccugugaagcuugguucacuagccauccccagacuauuccuuggcauguuuggcugggaagguauccuuggcgcucacuguaguaucauacauuucaguagcucuaugggucaggguugauauucucaccaagccuccagccuaaaccucugagggugccuauucuucauuccuccagugucaccugucucacacggggccagucagcuuuuuccugcagguuccauccugccccagauucugaaccaaucaaacucccugacaaguggaauccaaguccuaugaguucacagcuuaaagucuucacagcaagucagaccaaugccugacccugcucugcuccugcaaguggcuuauacccuaguuuagcucacugaguuucucuugucuuauucaguacaggucucaguaguacuccuguucauuugggauugguuuucuaccuugucuccucgagguucucuggaaaacagaagcaaaccaguauuugcuggccccuaccuagugcuuucaucaaauugaucuacauguugcucuucagucacaggcucccucacuuccguauuuuugcuccugacuuaucucuuccucaaccccauucucaaucucagcuccucuacugauaaaaucccucccaguugaauaccaacucuuccaugaaccucagcuagacagggugugucucccuccucuaacucuuaaaguacuugguuucucaauucuggugcuucucacugcuucccaugauggcaauuacugacaugucuucucuuucugguuaaacucuugacugucuuccaaaugcaucuugccuuauccacucgcauuuccucuaaucugucuuccauccuaaccguauagugacgcucuugaaacacaauucugauucccucuguuucuggccuucagucauuuccuaccauauuaaaaauagagacuuggaucccaaacgaagccuagaaggcuuuaguuggccccauuaucuuuacugccuuaucuugcauuuuuggucuucucuugccuugugcucccaccacaccaaccucucucuucugccacaggcccucugcacaugcuguaucccuccccaaccucugucucugccuucacugacaccuauucaucccuuacaacccaauucaaucauguuuuaaagaagaucucuuguggucuuuccaacuaggccaguuuucccuaagauauccuaccacaaacaugucuucuuuauagcauaaagauguaauuuuaaguuuuuuauuaauuuccugcuaucccacuagauuguaaccucccugauggcaagaaccauguuagauuuuguucaacauuucauccccauaaguucugagaauauuuauauaauaguugcucaauuaaauauuugcugauugaaguuauuuugggccaaagaccagguuucauuuuucuucucagcccacugauuucuggcacaaaggagagguuccauaacuaacuguucaccaccaaugaaaauacagguauaauguuuaaaagcuuccuauuucuucuugugguacuauuaaguaggaccagagcagcaguacuucacagggguaguguggcaucuucaaguacaaugauuuguaggggauaaagaaaagaaaaaaaaaacccacaaaacuaguuugugccacauauaaggaagaauaugguucucuugggcaaaaauggcauuguuuucaacaacugauauggacugccucauaauugcuauagccuuagcaaucuauacuggccauaaaggcaagccaaagggaacuguuaugacuccagagaguuaccauugccugucuauuaggccaaguuguaccccaaccccaaaaugacagaugauuugcuacacagugcccaagagaaggaagaauaauaaaagaaaagccguguucucauucugugcauaguuuugccucacuucguacaguaaguccaggagucuuauuuuccaaaguaaaaauggugaaauuugucuuuaaacacugcuucuaaauguguugguuagaugcuucauuucuacaauuaaacaccuaccuacuggcuucagcaccagguauuuaggccauccuggccuaguuccacugacuauuccagugucuauaaaacaccuucaccaagcaugagaaacaaacacagacuuuauuuucuaccucaucugucuugcauuuccuugugcuuaauacugugacauuuaaguggcagugacacaaucagcaaaccuagugaaggaugagucuauguaaaggcaaccauguuugcgggcagagaauaucaacuuuauacguaccuaaaugacugcugugugcacagcagccaagcccaauaaauguuaaaucacaaaacucacacuauaagcugaaagugccuuuaggugugugaauuccaguuucauguugcaaagcuaccuaauauucuaagguugucgggggagauauggaaauugagucuauaguagagagaaaaguucuacaccaacuccagaccuuaucaguggucaauauaccaacccaacaaaagcagguugcauucuaccacggcuauucauuacaaauaauuuuacuuauauucagugccaaugcccagccuucucuagucccuguucuagcuuuacuuuucuucauugcacuaaucgccacuuaacaugugcauauuuuacuuauuuuuuugugggcccucauuccccucaaccaaaaugcaaacuaagaagacagagauuuuuaucaguuuuauucauuacuguaucccaagaagcuaggauacaggggauucucucugagauuauuugcuggcaaaugaaugagauucuuggcauuugcuaggcacuguuccuuucgcuuuccaugaauuagaagaaggcaacauaaaugaauagccaaaagcuugggccucagagugagauaaccuaagucccaaaccuuaugaaguguuuaucuugggcaagucucuuaaacucucugugucccaaguggcuaccucuaaaagggagaugauaaaaaggacacuacauaaaagggcuacuaugaaauguaaugagauuauaaauauacuguaagaugcuuugcauaguuccuggccacacaguaacuaaacaacaaauguuagccauuauuuuuauuuucuuucuauuauuuuuauaauuauuaacuauuaaaauaaagguaggaacuauuaucauucucuuucuacaauugacgguacaaagaaugcuucugcuugaaguugcaaaauguuacaaaugguuaaaaaaacauuagagaaagagagcaggagagaaggaagaguaagaagcguuacaggaagaaucaagagauacuagccuagaaauaaaaagacucauccuggagaacuugguuaagguggguucugugagcaugugggagccugguagguccagaauagacacuucuuauagcagaucuagaacuggcaacgaacuguaguaagccaaagagugagguaggaccuaacagauuggacuaggaauccaaccuacaugaccuagauuucugauuaucuggcuccacuuccuuuaccgucacagagaguaaggucuccaguuccuccccuguacuagaaugcucccagacaaccuaggugauuagugagaguuuaaguucucuacucugaaggacuuggguucagacacaacucaaucacuuauaagcuuagugaccuuggacugacccuuaauuucuucauuugcaaaaugaggaaacuaacugcaucuuaucccauaggguugccaugaagauaaaaugagauggcucccaacaaguacuggaugcugucugggggguaaaggaagcuuucaauaaucacauaaacagaaguagcauucaaccuggcugagcaaaugcuuuagauaaaaucgaaguucuuucucuucccugcccugacuccccagaagagaauaauauaugguauaagcaaauccaaaaauacccgcuaaaggaaguuaacaaucagcaacuaucauucuuaaugucuugggcaaaucagcauacuuuucaaauacaaaaaacacaaacaaacaaacaaacaaauaacaccucaaauaauuaaguacuuuaugaaaauaagucaaaguuucuuuagaaacuuugucuuaagaaucagacaaaggccagcccaccaccuaugucauggaggggucauaaggaaagagaaugaagaaagagaaaaagaaaaaggggugaaauucuaauauuuaacaucuccaggcacacgccccagccucucacgcagcccuaccuaccacaaccaaccaccacauuugaugcuugaaaucuaccuaaaucaaaucgauauuugccuuagcacuuuccaaauaucuaggcuuccccuagaaauacuuacaagggagaugauauucaguuuagacucaaaggccaguuguuucaaaugucaagugaaauaauaucuccuccuccuucaucgugcucauaaacuuauacaacaaagacauccugacccucagaggucagagaacucaagcaagagaacgagaaugcaagauaucuccaagguuauuuuggaacuaggcauggcuugaagacacaucuaauggugaagggcuuuuaauugagaugcugcacaccaccugguugggguuggggucucuggguggguggaucaggcagugggggacagugaaaacuggugaaauuaucuuggaaugugcuuuuauccauagagcuuggauauacccuuccuuagcugaucagagagggcccgggaaccaaaagacauuaagaucuuagaaugcauuuucuacucucucauuuuauagauagcacaacugagucccagauaaaauaaaaguguuuuucccaauaucauacaucugcugaugguccugacuuagccacuaggcaagucccccagacuccagccugcgguugcuuccaucuaucaaggccucuuuucaagcuacuuggaaggcucuccuagcaaagaugacuacaauuuaugcucccuucacaacauuuugauugauuuuugguggaaaaguaggcaucccugaagcauuucuuuaaaauaaauccagccugccaaaccagcacugauguacaacccuaguagaagaauccaccauuggccacaauaauagcaaaaaggguaaugagaaauaaacguauuuaaguuuacaagccucgaagagguuaucacacacaaugacaggaaucuuugugucaggacugaacaaguaacccugauuuaacuuuacauuuugauagagucagccgcguugcagucauuguuucgucuaacaauuaaaagcggaauuugaaacuauuccuguccauaguuccccuuaaaaaaucuaaagcaaagagauucucucaugccaggauugaaugaauuuauaauuaucuaucuguagcuccaggacaaaagacuuaaacacaaaaaagccaaauaaaccaaggacaaauuucugauaguucuaguuacccugccuauuaaaugauagacacauuaaaagaaagagagugauauuuggaauauucagaaguuggugguccauuucucaugcuuuguuuuaguaucacucuuucuuagacgaaagacagucaugaaguuguuugugaagacucucaucagacaagaguacaguguuaauaaaugcauuuagcaagcauuuacuaugugccaaacacuaugcuauguaugggcugucauguacaaucucaguucauccucauaauaaaccuguggguaaguauuauugcuaauuucaguuuaaagaaauuagcaauaauacuugaggaaacugaggccuaaaacaggcaaaguaacuuacuccaguugcauggcuaauaacuugcaauuuggacucaaauuccaaagccuguauguuuuuacucgcuaaaguuuguggucuuggccagcaaauuucaagaaggccugucauaaagccgugcugagagggccaccuuacaugccaauuacaaccuuauuuaaaauuuaaaguacguuauuucuuccugaaauggaaaauaaaccauuagauaucuacaauauuacuaugcuuuagagucccaaaaucacucauguauaauuaguuauacccaugauguaaauauuuuaaauauuauuaaaugccuuacuauaaauauuagaggcuggaauaguuaaacagccaauuaacuagcuaguggccaucucuuuaccucucagcauuucuacucuguuaucugaaacaacccauacaaguaucuaaguagaaguuuagaaacaacggggcuuuggggagcugcugaggagggacacuuugcaaccuccaaaauuacugcaaaacuaugugcauaugccuauccaauaguuuuucaguaauuuuggagguuucaaagugucccuccugcccagcuccccaaagcccauacagaaaccuauuugagaagcuuucgaucuaagaaaugggaucugggaccuuaaaaaaaggcuaaaacucaauggucuggauauuugugagacuauauuccaaccaguacaccagguuacugcuucccagacucuguucuucaaaagacaaugugucaaguuuccaaauuauggggggcaaggguagugaaaagugagugugaaccuaacagacaacuaacugaauacuucccucugcaucuggaggcuuaggaauucagcagacagacauaagcaaaccauucugugaaauuguuagggugcuauucuuucugacauuguguugguuuccuauugaacaucugaagacuguuuuaacaugugugccuaaaaaugucacacugaggcugagagagcacagagccaggggccacccagacuuucaaaucagcucucagaagcagccagggaaauuccaaccuuggucuugugguccucaagaacuacagaagcauggcagaauuuuagauucacagguuguuuguacaguuagugcauuuauaccuaacuccucaaagccagagauauuuuuuauaacucagcauugcccucauugcuuucuuaucacauauuuugcauguguuuccaucuccaagauucagggaaaacaagauacuuaguugggaaugucuagaguggagaccuuauaaaaauuacuugacagacuugggagaggaaagcauuuugcaaaacaccagcuaugagaauaaacaauuuuagagaaucccuuggggacauuuuuuuuccuauggaucccaaaaucuuuuuuaaauagaaacaucucaggcagggguaagaaauuauugguuaagcccauuuagaacguguacgcugucauggaacauuccuaucaauggggcacauugaaacucuacacuaagauaugguggggcuguggugcuuuacuggauaaauaagaagggguuuggucgcuauacucccacccugcccauaaaugaguaagcccgugugacaagaguacauguuuucgaaaagaaagaaacugugaaacugagcgucaccauccugccacauaaaaagcaacagaaaugagaauuaaauucagcacuuucuuaaugggagacugaggaaaucugggagaugaaacaguagcucuucuccaguccuucccagcauaauaaggucagcugacaacacuguucgacagagaagacuuaaugugucugacagauggcaaauacaccauauugacuuuucuuccuaauuuaacaaauuugaaucuuuugucaauuuucuuuccccagugaaaagauauucuaaaacaccacuuaagcuuacauugcucuuuucccccucucccucuuacacauuaaguuugacacuaucuaaagaaacugaagcuaacucacuaaauuaacucaccuuuccagcucuucaugaucaucacaaauuugggcauuggcaugaauguuaauuccucaucucugccaacuguaaggcagauacucacuucaggccagaggaagguggcugaauggacaacaaggauuccuugaacucuuaaaaauaacacacaaaagugugcaucuauauucuucauacuucaaaacuauguaucuauguucuucaagaguccccaguuuugcccaguuccugaagguauaaugccucuggcuuuagcuauagguuguuauaauuagcccucauucuacaguuucuaaccggacuuuggaauuuuaugggguuugucuauauaagauggaugggaugauagcagagaagagcuucaaacuaguggagcuccuggaucacaaagcuguguaagucaucccaagugugacucaaguucagccuggagaagccauggccaggccaaggauagcuugucccacaaggaggcaaggggccguuucccaccacugccucaucccuuccaccaugugaggacacagggagaagauagcaucuaugaaccagaaagugggcauucaccagacaacaaagcugccagugucuugaucuugaacuucccagccucaagaaugugagaaaaaaauguuggucguuuauaagccacccaguuugugguauuaccuuagagcaucccaaaugaacuaaacuacuguuuucauaauuuacaauguguccuaaaauuaauuauaauccuaacuaugaacaugaaauucugccaaugugaaaauaacauuaguuucucuugacaaccuuuguaguuauguuacccaaaaguaucuauagacaaagcaucugaagauuuuagugguuauucacuauuauaaacaacaaccacaaaaaacccaccaccaacaaaaaaaacacuggguccauggagaaauaaguuugaaaaauauuucauuaugcaaaguaaaauggauuuauuacaaaaaccuucuuagagcaucucauggaaauggaguuuagaagaauacuaugcuuuagauuauuccugaauccagacacauuuuuuuuaaauuuuaacucaaaggauuaaaauuuccacacuuggaaugccccuguaugaggaagaacugaacgcuguccugucuugucuaaguuucagaguaaucccuauguuucuagcugauuagcugguuucauaaggcaaagggccuucugaaaaugggccauugcuucugugacaaauucaauauccaaauucuauugcugcccuugaacugugcucucugauuuccugcugcaaaaauguaggccaucaguggggacgugaaaaauuuguucauuacacacagauucccacaguggcagugccuggccacauuaccgaaccuauagauaacaucacagcaccugacauccagcccacauuuccucagccucagaguaaagaacauaccacggugcccgcacauuaacgcagagagaugcccuugauaauuaacaguucuuauggagucucucgaaugcuaaauggucaaauagagaaguuaaacacacauaaaacauuuaaugugaaaugaggcaaauaugccaaauuaaccugaaaugcacacaaaagccuuucagcucuggaaucgauauuaaucauuuucuggaauucaagaaaaagucugaugugguuaauuuaaaauuguauuuuaugauagagaacaaaaauaucccacaggauucaagguaucaguuuacacuacugccacuccuuuuugcugccagggucagcaaaaagaaaaaaaaaauuauugaucugguauuaaaaaucaguugacuucacuucuuucugaacagguauucuuugaccacuaagcacuggcuagucuuaccucucucuagugacaacaugaagagauaaauagacuauucaaacagagcucuucgcguuacauuagcugaauaaauagugauguauggucucuuuucucaagcacugccuuagcuugugaagaugagagugaggaagauggggcuuaugaauccuauuugaauauuuaaauaaacacaaaauaacaucccugaagaugguuguuuaaguggaaaaagaagguaugaaaaucugucuuuuaauuguagcuuuuggggcaacaaaaaaucccccaagaaacuuuugagauuccagugucaagugaaaucacagaagaaaaaaaaaauuaauuugugguuuuauaagcaguauccagaggaaaugggaugccagucccacaggguuuucaaaggcugcaaagcuagcacaaaccaauucaccuaaagugaaguauauuaucaauaacuaacugugaucacuuuuuggccuuccagcuaagaucaaguguaauaacuaacuuuacuuugggaauauuucacaaugaauuuuugcccucuuuaaucugcuuuaagauuucugugcucaauuuccgguauaugccguacuugcagaaagggaugaaguucugagcuagguuaagugcuuguggcuaacuacaaauguguuaacacaauguaauuaggucaucaaacagcaucauguuuauuagguaccaauagauaaaaaaagggagcaggccuagaccagcacaucagccccagucccuacugucuuggaacugggauucugagacaucuccguggcuucuacacauuacuggcauaauuacuaaauccaaaguuuucuauuuguaaauuagagauucuagcaaggaaaagaugaaguccuaugcaucgugcauuagccaggauucuuuuuuugauuuuuuuuuucauucuguugcccaggcuggagcacaaugccacuaucucagcucacugcaacccccaccucccuggcucaagcgauccucccaccucagucuuccaaguagcugggacuagaggcaugugccaccaugcccagcuaauauuuguauuuuuuguagacaugggguuuggcuacguugcccaggcuggccucaaacuccugagcucaagcagucggcccaccucagucucccaaagugcuaggauuagagguaugugccaccacucccagcaggucaggacucuuuuggaacaaaaagaagggguauauuuauugguucacauaaacacauccucaggaauguuaaggcagaaccaguacaguccuaccuuccuauuggcaguuuuacuuucuaugguuucaaguugccuacaaucaacuauggccugaaaauaagugacuagaguacaauauucugagagcaagaaaaagaccacaauuauuaacuuuguacuacaauauauugguauaguuguacuauuuuauuaguaguaauugaucucuuacugugucuaauuuauaaauuaaacuucaucguaacuauguacauauaggaaaaaacaguacaaacagaauuugguaccaucugcaguuuuaggcauccgcuggggucuuagaauguauucccuuuagauaaggcggacuaauguauaguccuuucccucuccaguguuggcuucauucucucagaauaaagaugacaaccuggcuguggaagguggccucaggaagcucccaaccuaguaaucagagaagaaugagaggauugccccauuaguaccagaaaaucccuauauuagcaaagacagggaccugauuuggucaagucuccauuccuguauuaccccuguggccaaaggggauugaguaacuauaauuaauccagucaugagggaggaagaguugcugcauagaccaaaaacaagagccucuacguacugaagugauagggcaaagaacauauauuuacgaauuauaaccaagucuaaauuguauucgaauuccuagaagaucaauguuacuuaacuuuccugugaauaauacucuugccucuuacuaaguagcacacuaucccuaauauuccaaggugaaacucagucacugagaauugggcaugcugcaccagacuguuuucccaguaguagcaggagauaugcugaaccucauauucuuucucuuuacugcuuuauuaucauuaaugccuuagacugaauuucuccagaacugaucaugagacaggaaucugaguacaaauggauuauuugagagaugggcccaggaagcaccauuaggggagaaguggaaguaagacaggggaaaaaagaaaucuacuacaagaaacauuuauaagaauauuagugcuucaagcaauuggggcucaaauccacuggggggggcucuggaagacagcguggaacaugcuacccucugaguuuucgcacuuacgacauaggaagcuggggaauuuauccucaaauucccacugguauuggcuaaacauuguuccuaaagucaauaauuccugacacuuuaggccuacacucuacaccagcaagagaaagccccagagugcagaguaaaaggcaugugaaauagaauaaccuuagcacauaugagaagggugagucccagagaauggaaccaaggcacacagccuuggcuaauaccaguaacacacacuuaugaaaaugugccuucauuuauucaaauacuuaccaagcuccuauuaaguuugaguuuucuucuagaugaugggcauacacugagggacaaaacaaagauuauugucuuauuuaauacccagcacaacugggcggggcaggggcagauuccaggggcuacaugucauaauccucuucacaacagcaacuucaaauguggucccuaaucuuaagaguagcagcagggucagcaguauugggcuucaccauuacuaagccagguguguugaggucuaugauccaguaaugaaccugaaucagaaauggaaucucagauagguauuggaaaagugggagaguucccaucguaggacagugaguuacauuuuguuuaggaaacucuucagggacaucuucucugugguggcuuguguccagaggcacugcagaguugccugcucuaacucuugacaguugaguggggcaugcagcuucuggacauggaaaggacuaaaguuaauuugcccaucuggggauugaacuggcaucagugacuucaaaugugcccugcagagcccaaaugaucuccauuacaaacacagaaugcuccgccuuccaaaugccacagaauuccauuuuaucugcacuggcaggguaaggcagaguauuugccaaaacuccagacauaggggguuauuuguaaaaccuuagaguauuaucagguguugcuuucaauaaaccauuacacuuguauagaaaguaacaaacuacguggucuaaggaccaguuaucccuauuccaaaaaauaaaguguaaguaaguaaagcaauuuuacauugaaucuugaacaucuauguacauaauuuagaauuugcuaaaagguaauuuuaucugugcugauuaucuuuaccauuuggcauuucccaucucagggcaaugaguacaacuucacaaguccagcuccgcuuagcugugaguacucaauuucacuaaagacuuaaacagaaaauuaaaaaucugugagaauugggaugaguccugucugucuuaaagcagggugagcaaauauauguggcacaugcccuuaagagacauuauuaauugaucaccucucacuuucacacugagccuaggcugaaccuuagaauccgucacagcgcagguguccacucagucaugacuggccuuccagaacuggguacuggaaaugaaaccuacuugacacuuaggauacauuuauagagccugguccccucaguacuauacuccccucucacaaacagagagagagaaaaaaaagaggaagaggagagcagagaaaggaugggggaaggaaugagaggaagaaaaaaaacucugaaccaaguaucacuuccuuugcggucugcacaugucaaggaauacuccauuuuaagcauauuauaacggcaaaaagaaaaaagcacuaucaauagcgguucacacuuuauggcugcucacccugaaacuguagcagcuaacuuucuugggaaaacucagacagacucauucuuuccaaaaacaaggaaagaagaaaaagaauuucccacauccuuaagauaacugagaagcucucaguaggaguaaacuguccaaauaaaauucaacggcacccccuuuggaaggauaguuaagaaacaccacauguacaaagaaggauuaagauuccaaauacugucuuuucuccaacucgauuuuuccuucuugugcccuuacuucucaaacaguuauucccuuugcuauaucacccagaagucugugauuggaucucccuuggacuccaaagggcucuggguaugagaaaguaguccaaaauauauauauauauauauauauauauauauauauauauauauacacacacacacacacacacacacacacauauauacacacacacacacacacacacauauauauguguacauauaugucuaggauuuacuauagaaaauuuuuaaaauauuuuuauguauuuauauuuauaauauauuuacauauuuaguuuuauauauauuuauauaaauauauacauauauuuauauaaauauauacauauauuuauauauauauaaauauauuuauauaaauauauaaauauauauauauaaauauauuuuguauuauauauuaaaauauauacguauauauguguauauauguauaggauuuacuauagaaaaauauuucauauuuuuauauauucauauauuuuauauuauauauuaaaaauauauguacguauguauaggauuuauauacauauauguauauauguauaggauuuacuauagaaaaauauuuuauauuuuauauauauuaaaaaauaaaaaaauaaaaauauaaaauauauaaaauauauaaaaauauaaaauauaucuauauauaucuauauuauauauagauaugaagauauaaaaaaucuauauauuuuauauagauauaaaauauauaauuauauaaauaauauagacauaaaaauauauauuuauauauuuuuucuauaggaaauccuauauauauuuauuuauuuauuuaggacugcuuuuccugaaacucuguaaaaguuuucaucauacuagcuauuucuugugaugagccagaucaucauucaccugguauaaaugagcuuggcugugaacacgguuagaaauuagagccaaggaugaucuauuaguucaucgugugugucucaugggacaaaagcaaauguguuucucuaaagaguuuucuugaaugguuucccaaguccaacuugaaaucacauucacaaucuugucauuuuccucuuucuugcagcacaccaguaauuagauguuuuaacacgucauggcaaugauaucuaacaugaaggcaaacuguauuaagacacagcaucacccaguuuuauacuguaagcucauuuccaaacauuauuuguuuuuauaaauuugagcgaggcugacucuuuccucucugccuuuaauuaauaaggaaagcuuaauaugcacuuuuuuuucaucaaucuggcacuaaaaauccugaauuccuuuuguaguaauuugaaagaagaguuuggggcuauuaggagaaauucacauuaggcauuucccuacauggccuacuuauguuuuucaaagugaagggauauuucaaggaaagaaagacuugggguacuagagaugucugccccaucuaaagucuuauuuuucuauuuccuauaucaagaagccuuagguacauuuuaguaacauagcuugaaauauauuuugaaaaggggaacaagacguaaccugacccacuacagaaaaaugccucauguagauccuugaaugaauuuaugacuguaaaagucccucucuuuuguuuccuggguaauuauuucacacauuugggagguuuauagggaaugcguaucagcuuuucaaguaaaaagugugagucucugacucuuccuggaaaucuggaagcaacagagaaugagaaauucucaggcagccuccaaaauugagcaagagauacugcaggucaccuucagugcugaauauuccaaaguuaacuucguuaaaaaugcacaaacaaccugauaaaauaucugauuuuaccuuuuaaaaguaggauuaaaaauuuaggaagcuucgugacuuacucucgcaucucucuuugauauuucuuuguuugguauuucucucaccucuuaugcccugguggagucuauuguugguuuauguguaacaugaucgaauaaagcaaaauuguaaacauuuucuuuuuaaauaaauagacuuuuaccugaacauuauaaucacaguaucucauucauccauucacucauucauucauccaucuauucauucauucacccauucauuuauucacucagguauuuucugaguucuuucuguguaucuggcgcuccucuaagcaguggggauacacauguccccuguucucaugagcuuacagucuccuggugaaggauuuuaaucaaaucaucacacuugugccuaaggguuucaaacugagauaaggaucucaaaauaaaggagcaaacacccgaaggaucaaggacgacuucccuguggggguggucccugagccaagggcuucagcagaagcagagguuaaguaaguaggaaguaggacaagcccuccaagauaggggaaugcaguuagggccucgagcaggaggaaacaggggcaaagcucugaaaguaaaggacagguaguauuugcugagcuacucuaagacagauucucccaccuaugcugacagcaugcacaauuucagcucaaugaauacaaaugaaugcucuaaguauuuuuuagauucucuagauuaugcacauugaggagcaguuugggguagggaugauggaggucuggccauuagacucaggcuuuaaagagguucugggaaggggagccaaucugaaguaccuggaaauuggaaaaaauagaugaacagugauuuuaucuggcuuccaauggcagauaaauuuccuuucgggaaaggcagauauucucauuucaagccaggcuccucugcccucacuuuagcauaugaggaaacugagcucuugaguuccuggaaaccuuugagaauauggagacagccuuuucacuaggucaguuuagcuucagagggaaugagauggcugacuucccccacacauuaggacuuucauuccaacccucggccagcaccuagggaacaaagcaaggccccagcuuuaguucuacuuaaagugagacacugcuugcucuuucacacucagguuaacauucacuccaacaaugaguucagaagugaccaugggaagacaagaggcuuuccaaauaacuaccucaccauggcacagggucucugagggcugggcauguuagagucugagauauaaaacacaguauaaagaacguucuauuuugcaaaacaaucacauucuacaaucuauaccuaaguaacaggaagagagcagaucucauuaugucccuucuacaagaagaacaucugcauugaguugggugucuucauagggagucauucucagggaacgugaagcuuccuccccaucacccugaccucccuuccccuguaaauuuccacauugauugauuguaaacaaauuguguucaucugcccagauuccauuauaucaaaaagacauacuccucuccacaaauaucggagauagacagacagauaaagaggauuacuuuccaguagcagggguuccuccccacucuuccuccacagagaacuuuauuucuaguacauaguagaagaaagagucaagagacggaugagaagacaaacucagcaaagccuuauuuuuaugcugcuguuguuuuuaaccuuuagugggaaguaauaggagaccucauacuuuaugaagccuuuuuguaucuggugguaguuuuuaaaaagaccaucagcuaaaauauaaauauaaauuuaaccauggaugauuguaauuuccugcauuauauuuuuauguauuuucgaaaaguaucuguaaugagcgaguaucaucucuguaaucagaaaagaaacuaugaaaauauccccagugagaucuguguuugcucacagggcacuauuuggcaugaugagagugaggggaaugaucugaauguuuucagugccaagcaccauguuggccucaaucgguagcaauucuaauucuuuuuccuguggauuuguaucaguugcugguucauuuaaaucagcuauuaaaggaauaaacaugaaucuuaaaaauacauuuagagaaaguauauuguucuaaauuaagcaagcaguuggcauuucaaaucauauggaagcagaugaggggaacccgcucucaccagaucucaauccacuuugcaaacugcuuacuccuuaacuuggcucccuaauuagggcauuuuaucuuugugagcauuuaccauuacugcaucaugauaacucuuggcuaguauucugugaagaaauaauuaauaauaauccacaccagccaaaaguagauagagcaacaugagcaaagaacuagguuggugugauguggcucaauaaccacuuggggaaaaacaaugagaggguuuuuauugaccaaagugguuuaacaaaugacacuuaagugaucuacuggcauuuuagaacagaggcaagacugcucacucauuaagucauuuuaaaaauagucauuauagagcuuuugccauaaaucaagaacaaaagauuccaggaaauaauuuuuuauaauucauaaacacauaguaauguggaaagaaggacucuauagaguugaacaggguuaucaauuacauuuuccaguugucuauccuagagacaacauuccuuccgugaguucaaaccuuaaacauccagaugagguauuguggguaaacuugaggauugacacacuucagcagacuaccagcuccaugagaucaagggccacaucuguuuuauuuagcgagaagcagaauuaggccaugugugacaguggguguuacucagcaggugcucagugaauaaugaauggauuaaugacauuguauaguagugucugacuuugcaaacagaaaaucacagccuuugugaauguaaauuuacacaguaaacccaauaccauauagacuuuuagugauauuuugguauuuagaaaaaagacuaagaucuucuccagguagaaagguauuuugucaaguauuugcuguguguguuugacuuguuuuggccugcaauguaaaugauccugauagacaucuaguucuacuggguuccacagcacuucuuuagccaguggggucuuguauucaacuuguauuuaucacguccuucuaauuucacuugucucacccuggcuguuauuauaaucccaaacagacagauacauuaguaccccaggcuuaagucucauccuauucauugcuaucggguuauucucuaggaagcaucuuucuuuucaucuuagucccuucuuccuuccuuccaucaguccugaaugcuuucugagucaaauuccgagagcagacccuggcuccugaaucuuuuuaugcucagacccugcaacugcucaacagucguugucucccugauccucuucacacagccauaugucggccaagaugcucaacucacuacugccaccuuuauaccuaggcucaugccagucccuuugcagagaaagagaaacacagagggagagagaaacacagagucuugagucccuggaucaagccauaccugaagucagaaacuucccuugaacucuuuaauuaugugacccaauaaaucauccauuuacuguagccaguuuggguuuucugacacuugcaacugaaagagucuuuaacguaugcagggaagaggagaugaggaagagaggaacauaaaaaugaaguaaaacgaaacagaggaagaaaacaaugaaagauuuguccaaggcuguagaacuaaacaguauuggauaagaauauagaacaugaagcccagagcccaagacucuuuccccuacuacuucccuucagaaauuaguacuauuacucauugccacacauuguuacuuuaaaccuaaccaaaugagaagugaccugccaucaagcucccgcagguuuaagacauauauuuguccugaguaacuuauauuguuuuccuggcguaguacauuuaagaauuacuuuuacaauuaagcugcccaaggggucuauagaugcccguuuuaauuuaaauaaauacuaaugcuaaaaucaauuuguaggauauuucaauuggaccgauaaguacagucuucacuaaauccaaaguauuucccuauuagcgcaucuuuagaagcguauaccaacaacacaucaggauuuucagaaaccugcuacaaauacauuacucccagagacuggaucaaacagcugaugaucaaaacauaaggcaaaaacuaguauuucaucuuugaauucggaguaccugauuucuacuaaauauugauuagaguuuuucccauaagagauccugcuuugugccuccuuaauuuucuugguuucaauagugcuuugugcagagaacagcagaaguaaggcagaggauacagcugucaucugugccacagacauugacaugcagcuuagucacagaacagagagaacacgugaaagucaccaucacacccucgcaacagugucaguguaaagacucagguuccagauaugaagacaggacugaaaaugcuucuggcuacaaugaaaugaaucuaccacacacuugccaacuuuauucaaacugaugauauuuuucuuuaaacaauggauuuaguuauucuacccguaagaaguccaggucguuaaugaaaugauaauuuucuacaaacuaaaaacaaacauaucucauccuacuaaugguuccugccucuccaauauuucacuuaggccaucucccuuuucucuucugguagaacaacuucaauagguaagaaaguuuucuuacauccgggaaauuucuuuaaccaccaaaauccaugguguuugcuuuucaucuucaacucacuccuuggucguuacgacauguugccuccuauuucugguuaucuauguuaguuuccugcucuuccuacagaauugcaaccccggaaagagagguacugagucucacacaccuucuucaccuggagcuuguaacaacauccuacaaagcaaguaaucaacauguguuuuacagagaaaacugguuaucccuggacuguauuaaaacagugguauggguacucuaaaauaacaccaaugugaguguagaaugcauuucucauuuaagagagguguucauucagccugaggaugggagaauuuacgaaaccucaaaccccaauuggcaaacagccucucuaccuucccaguuuacaaaacccuaccugagagaaggugucuucucucaaaugaagacuuccagauccuguucuccacagacaauuaaaugugguuuaaaaguugcugcugggagcugagguuauuacccacuuucugaugaggccggcgccaccaaaaccagccugugggagcugauuucacuaggacucccccaacauuuucuugauguuggagguguaacggggucucaguuccuguucaacucugccucugacuggauucuaggucuugagcaagucacugcuucccucugaaccucaguuaaccucaucuuuaacauggggauaaaauuccuggcaccauagcuaccucacucaaugcuggggaaaauuaauaauauugauaguguuaauaauuaaauaauagcuaacaugcacugaguuauaccauauucuaggcacugugauaagucccauaccucccuuaacucuuacuauucucauaacuacucuaugacaccaagcaccaucauuaugucucuuuuacagaugaggaaagugaagcucagagauguuaaauaacuuguccaggaucacagagcuaggaagaagcagagcaauauuugaacacuggcauuguggguuacaaagcauuacucccagaauacugccuuacaaaaauaagauaagccaugugacacaaaaaucuucacaaacugcaaaauauuaagccacuguaaaguacuguuaccaucaaugcaaauagaugcucauuacauuuauuguaaaaagcagguaaccaccaacccguuuagggaaggugcauaaaccucugucagcaauacucaauccaucugcagagaaacaauuagaacugcauuagcacauaaucacagaagaaguucucuugacaccauuucugccaaagaacucauucuucccuggaauuugaaaaggcaaaaagaaaaaaaucccaugccgcaucugacaauaggaacaaacucuucuugcagcucugguaaugcaacacuucugaaagaacaaguuaaggaacguacuuccacugcccucauuagcugacaaccucuguggggacugcaaaccagccacacauucaaaacaaaucccagggaagaaaucacaccacaaagccuguuucuauuugcaaguaaaaugacggccccaagugucuuuccauaaagcugugugguaccaaauccaaagcccaaacugguuacaaagggucgccauugauaagacauggcauuucagguccacccaccaugggccaaggagguauaaagcucagaacgugacaugcaauuuuuaagcccuccuuucaccuugucuaugcacuaaguuacuuugacgccacaccuguuucuauucugccuggaagcccugucugcacaacagauggcagaguguuugccuaacaaauguucuugugggucaguauaagaagguggugguggggauuguuguggguacgaaaggagagaggcucugcuagagcagcaaagaaccaucgaucuccaacuuagcuagggaaacuucccacccaaugagggucuggguaugucugagcucugaauguucucaccucuguucaucccuucugacaaucuuguccaggauaguacaaaucugcugcugcaaccggaaauuacaaagaaaaucugauguaggcauuuagaaaaaaaaaacaacagaacaaaaccuuaucaaauuuaaaaguuaacuucaaauucaauucuaacucuaucuccaacuuagcucucuugaaucuaacugaagauucaacuuucuuaacucuaaacuuaacccuugaaucccaacuccuagcuuucaccucucaagugucuuaacucuaacuuaaagucaaacuuagucucuugaggagguaauuaaacuucaacaacuaauuggaaugaguucuugugaacugagagcuuggcuuaucaacacaucuggucuucagagguuaagaaaaaacucacuuucuguuauuguaaacuuaacaccagaguaauguuuuauuucagcuaugaugguaauauuuuuuaaauuaugcuauuauccacuuaaaaaauccaugauguaagguauaaaguaacauaaugcuccuugauggugaaagcacaucuuaggcaccaugcuuuggagaaaaacuguggaucuggagggaaucuccuccucccacccuaaaccacacauaccuaaaccacacacagcaccggguauaccucagucuucaacauaaagaaccaacucggcacguuccauuucauuugacucacuugcuuagauagcuuaggaaaccaaucugcucaacauuaguaagucugggcccauuaaaaggggacugacacuaaacugaaauccauuucaucucuucuccaggguuuuccucggacucucugaucagccuuuccuucacacaggggugaggccaaaacuacuauagaugaagaagaagagagugagaugauguucuuuuugagggccaggaugacacuggcuuuguccaguguuuucaucacagaaauugaagugggcauguaguagguucucaaaaaaacaaaacaaaacuggugaauaaagacgaugugugcuaagcacuaagcagagaccuccccauucgugcucuuauuuaauacucacaaaauccuaacagcaggggguauuauuauuccaauuuugcaaccaaggaaacacaugcaaauagcuaacaguggacagcaucagauuuaaauacuuaaagcaugcauuucccaugagugagagagacauuuugcaaacauggguagaauguggcuuugugacuugccucaagauucaccccaucaauuuaggcaaaaaauacaaucuucccugacuauuuaguuggaagauaacaagucagggaaauucagucuagcaguccauggguaagccucaggggaauaggaggccccugaaauuaaaugcgacauuuuguguguaugugaauuuuuccauggaaaaagucugcagcuuucgaauacuugaaagauucuaugguccucccagcccacaaaauuuaaugacuuagcugcuuuuaauuaaaguuaugcuucuaauucucauccccaaagaguccaaagggcuccagacacccuuuguaugccuacugaaagaaaaaugauuagcaugaaagccugguggguauuagacaugagaauagucaaacaccuuagguauggaaagcacccacauagaucauuacuuaacgaagaaaaguaauugagaauguauuccauugcuagcauuuguccacaaugagauugagaagccauucuauugcugaccagaugguccugaggauagugaaaugacagaaccccuguaucacucaucagauucacugcucuucaaaauaugaaaaagaaccaacaaaauccucauuaugacagugccuacaaacaagauccuucugaccauuucacauucugcaaacuucaucugcaauaagaauguccagaccugaggcucuauacuuggugaaaccaugcucauguucaaaaagcauuuauugagagccuacuauauucuaaguaccgcaauaaauacuuguuccuauaccaucuggaugcccucaugugauucuaggcaacacguuuaaaagagaacagucaccaaauagagaacccugagaugggaggaaccaguuugggaaagggauaaaaaucaugccauguacacagccaaaggcauugaugauucuuuaaagggaaaguaauacauuuucuuucaacuucuacaaaguuucuagguagaagaagaaauagagaaucaauccaaauugccagagaagucugaaagaggaccacaagguaaauauuucagagaagcaaaguguugguucacaauaauaaaaagaaagaaaggaaaugaaaaagcaaacuauuauagcugggguuauucaacaauggaauaagacagcugguaaaauguuagucguugcuggaggaauuugaaaugcauuuauauguuaaaagcacuaaagcuaaaacuauaaaaccaaaagauggguuaguacaagaugauuguccuaaaauacaaagaaacacacauugucaguaugugaaccuuaaaaacuaauguugguuauucuguuuaaagagaagaaugugauguucacaaaucaacuuaucacaaauuacaugcuuacucuaguaauguaaugaccuugggagcugacucauagucuuccuugaccuaaugagcaugcugaguauaaucaauuagguuugcaauuaaaauugcaauuuaucuaacaccccccucuacccccaccuuuuuauaaggcucaggagacaguggggugauaaauauaagcccuucugcuguggcuaucuuuuauuuuuuaagcauuucuauuacguauaauuuauuaaaccuuaaauuucuucccuauuuguaaguuucagcaaaauuuagucagguuucaacacaggguaucaagggauaauuaggacaguuagcaguaauuuaucauuucucagcuggguuuucaugcuuucgcugacugcccguagaaaucuguuagccacuucuacacagaucacuaugaaaucugcuuuaucuuugugcaaauugcuuuucuauuuuccuaaagugagcugaaagaugagccaaucgacuccugaaaaucuagccaccggugugcuugucaucagagugcagcugaggccagggccgcagaugaagggcuacaguggcuaauggaugaugcaaugccaugagaggcuuuuuuccagccugcugcggguuagaaauuuaaaccaggcagcccgacuucagguuagaucuucacaaaauaugcccaggaaucuaugaacaugccaauacacauuuuauggagcaaauauugccuaguaagccaccagagaggaaaagccuagaaaaggcagagacacuaguacuauaccacuuccacugaaaagagggauuuuaugaagccugaaccaaaaagggaggaccucguguucuuuagagagauucauuuacuagauggugaaaaaugaaugcuucggguaauuucauuuugaauugauuuauuucuaaauggggggaaacugacacuuggugaagaaaguaacaagugguucucuggaaagagccagccagucucagguauaauccaauuauuccaacacaggaaauaaggacacagagggaaggguggaaggucaccugagaaagucauuccuugcaaugaauaccuuccuguccccuucccuacagacucucagagaaguauaaacugacccauauuuccaguuuauuucugacaccuaaaccuaaucaaaguccacuauuuagaaauccaauaguuauucgcaauuagacugcacggcaaauuaaaucauaaauuucucuaucucagcccugguugucacauuccuaaaacacaacuugccucccuccggcacuuuauuuaaaucucugaggccgggcuccaaagcaaguuauggauuugauaauuugcuaauguggccacaguaauuguuuugagccauauuuaugauuuuauuggaucuuacaacaaucaauaauaauccauugaugucccugacucggguuuucucgcagucgacaaauggggcagcagauucauuuuuaauguacucacuuagcacucccucccugggagagagagcccugcauauuuuaaaaaagggcaagaaaugaauggcacugguacacauacuuuacugugaaaaacuagcugcaggauaagauuuaaugcuaaaaagaaaggagagaauagacuaacagggcccauuuugugcagcaccaccaucguuaaaguuaauggaauuaccguguggucacgcacuagagggaaccuauuggaaguuaagcucuucuagggccauugauucacagacuuucauucaaagauucccacuagcaugugaugaguauugcagauaugcagaggcacuuuagaaacuguuuacucaaacugccaguuaagcauauuaagaaacaacaauaacugaauauuuuagaguggaugaucuaguggaacgugucuucuguuagacauaguaaaaacuucaacuccgacuggcuuaaacaauagaggacuuuauuggucaccuaauuuuuuucaggcuggagugcaguggugcaauuucagcucgcugcacccucugccgccucccagguucaagugauucuugugccucagccucccaaguagcugggauuacaggggugugccaccacaccuggcuaauuuuuguaguuuuaguagagacaggguuucaccauguuggacaggcuggucuucaacuccugaccucagguaauccgcccaccucagcuucccaaagugcugggauuacaggugugagccacuguuccuggccagaucaccuaauuuaaaugucuggaaguaaugcaggcuucaagucugguuaauucaacaauccaauaaugucaccuaguguccagcuucuuucugucucugccaugucagccucagcaucuguuuugcucugaggcauguugcccuagaaaauauaagauggcugcuagaagcugucaguuaccugcuuucuuguucauaagcaguaguggagaaaacagcccauccacaacuaaugcaucuaaguccuccaugaugaugggacuccgauccuuuagaguguaggauuccuaaagucaagggaauccuacacucuaaauagcuuaggaaaggauuaaugaaagucauuacuguggcagagacaacugacuuagacugggaugggcaaauuauggcccucaggccaaauuuggcccaccaucugcuuuuacaaauaaaguuuuauuggaauacggccaugcuuauuugugacaauucauuuucauauauucuauggcuucuuuugugcuguaaagucagauacauaauuaugacaaagaccaucuggcccucacagccuaaaauguuuacuaucuggccuuuuacaaaagaagucugccaaccccugguguguaccaaacaaggucugcaccuggagcuaaagaugaguucaaacccauccuaauuuuguggcuacuaaaucaagagggaggguaggaagaaugcuagagggacaaccacagugccuaagauagacaugagagaaaauccuucaagucuagaaaaaugggcuuagaaacuaaaaaaaaaaacaauuuaggaaaccuaucauaagcacaugugaaauacccucugcccugaaauacacucugaguaucaucaaaacaucaaauauauuuaaaauugaauuacaauuccuuaccacagcauaagucccaguguaacggcuccccgcccacucuucccacuucucuccugcugccacucucccuacacuaaauuucugccaccuggucuucaauuauuuccuagaaugugccaagcucauucccacugccauuuccucuucccagaauggucuuucuucuccagcucuucgcuggcuaggcgccugucguucccuguucuggguuuauggguuaucucuucagugaccaccccaucuaaaguagccauaccaccccauuccccuuccaccaugucauuccauuucauaacaccuuguuuuagucuuucuaguauuaacccaaaucugcaauauuuuauuuguucccuuucacauaaggggaagaagacaauacacugagaguuuuuccuaggcugucuugccuuccacuuuaacccagugccugggagcacauggcacauaguaggcacucaauaaacacuuauuggaguaauauguuaauauuaacuauagaauuucuacaacuuuuucagccuuccugcauuaugguguucauuucaaagucuguacuugaaaacaaggacuacgucucauucuucuuagguucucagagccugugacgauaucuggcacauaguaggugauagaagaauaaauuaaugaaugaaugccagauagaaaaacaugaguaggcaggauacucauuuccuggaagggaggaacagacuacuuugguagugaggaaaucgagaucagagcgauucagaacuggaagcagcuaccucacagugcuuugaguuuccagguauagaggaagaugaaagacagacuuaaaugcuacaggggugauuaacugucaaguaguggaugaugcuaaugacuuuuaaggucacuugcuccucugggauuuucuugaauuaucccgugcucugaguuucuuccuuaaagagugagauucaucgauggucaucugauaguggagcagagcuuggagucacauuuauuccuuccuuggccaaacaguuucaucaaaauuauacugcuagaaccugauuacgucugggaauuuauaccauuuacaaccaacagacgaauuuaaacgcaaauaaaagccccuggugagcuguuugucagggcaccaggauggaaagcaugauaagaaaauauuuugugggggaacacgaacugauauauggaccccagagugggagacuugaaugugaacguuaggauaaaugaauuccaccacaaaguaaaagaauauuugguguguucacuuuguuaacucaauguuguuuauucuucucaaccacccuaggcagggucaacaucuuaaagaauuccaucuucauuuuucauguaacgucaggaaccaggaagacuuguuuaaaagaauaaacuaccagggaaagaaauggaaguuuucauuacuggaauccaauaauauuaucuuuauguugaauaagccuagaauuucaaaccacuguuuguguguguuuuuuuguuuguuguuguuuguuuguuuguuuguugcccuucccuccugagguuuuggauuaaucugauggagaaggcuuccgaagauauaugucucaacuucccugauuuuggugaacaagaggcuucuuuggagaacggaucuauuagacaauaagguaggauggaugccucaugacaugggaaguuaaaauuucaaaaugacccuuucccagcacuaacauaauugacuuagaaggagggaaaggauuccucaccauguuuggccugagggccauuauagagucucaccaucccaacauuuuucacucaaauguccucaggaaggucauuauucuaauucuuccacaucuguggcucugcagguugccuugucuauuauucauuaagcugguuuccaucugacccuggcucagccaugaaaucuuuaccuuuuccagcugcuuuuugugucuugagacuuacuuuauuaaugacuuuggcauaaaggguaaagagaagcgccugaggggacugaauaauuugagaugaguaucaagaaagaaucaaguccaggucaucuagaccaagaaucaaaauauauuuauaaaaauaaacaaaugaaauugcaguugauauucuggguaaccaucagaaucaacuguggaccuuucaagaagcuacuucaugggccccacccucagagauuggaaaauaggaggcaugagaacuagcuauaugcuaaagauaauaaagcaaagagaaugaauuauaauagucauuucuuaauggaaagugcuucaaauggggcccuugguuuuucuuuuaaaaugcacuuuaaauaauagaaucaacaaccauguacacauuacccaauuuaaaaauaaaacacuguaaagccgaaacccucagguacaauucacaucccacauugcacugcuuccccucacuaucuccacccagaggcaguaagaauguuaucuguguccuuccuucuaagccauauauagaucuacauguuuauaaauuauauggcagccuauaagcaaccuguucuuuuauuuuauuauuuccugcuguuaauaacuacuagucaaaaguuuguagcauuuggaucuguuucagcuaaaaggcccaauuucaaucaaggcacacauuauuguauggucuuucauuccccauucuguauuuaaggaugugguguagucuaaaacaaaugguuccagagcacuuuaagaggccaaggcaggaggaucacuugaugucaggaguuugagaccagccuggccaacaugaugaaaccucaucucuauuaaaaauacaaauaauagcuaggcaugguggcucgggccuguaguccuaguuacucaggagggugaggugggaggauuauuugaacccgggaggcagagguuuuaauaagccgagaucacaccacugcacuucagccugggcaacaaagcgagacucugucucaaaaaaauaaaaauaaaacaaauggcucaucuacugagguugaauuggccacuaauauuuaaucaaaaguacugaaucuuucucacaugauuaauugggcugcauuuauuuuacuuuuuuuuuuuuuuuuaacagaauugacaguuuggccagccaaguauuuggauaucacagguuuaaaauuuugaaauuagaaugagcugauuacauggaguuagagauuuuuauauuugauuuccuaggcuugaaacacccauagcaaaauggugaggcagaguagugcuccuucaaugauuaguuauugagcacuaguauccuauagcaaaaugacaacagugaguaaccggccuuacuacaucaacaaagguaagacucugacugaauaauaacgccuuacauuuaggugguauuuuagggucuacaaaacacuugccuuucacaggagguuugacuucacagugauuaaguagaaauuacaggcucugagccucagguguaaaagacaguuuacugaauccuauaaaacacugaaugucccuacuauaugugccacgugucggcauuacaaauagcaaaauaaauuaaacagccaaauauccacuuugcuauaugucagggccucuaauuacugaggggauuuguuugguaguacuaaugaaaaauuaaacacuaaaagcauauaauucugccauaaauugacauacagcaauaaagcagcauuuagguuaagcuucaccuguguaauaaacagggauuguccucuggauauuuuuagauggaaaccaacauuauuccaagcagagcaaaauaauacagauuaauaugugguaagggugacaaaauauuuacaaaaccugugcuugaguuucuucuacugugauuacaggauacaacauauuucuuuaggaacagccuggucauaugauauaaugaagaguugaaauuuuggauaggcuuggguuugaaucccaauuccacuaucugucaacugugcuuuuccaguaugugauuuuuuuucuuuaaaccucaguuucccuaaguguaaaauauuaaugccuacuuuugcagguuguugugaggacugaaguaagaauuauaaaacuaauggugaacauguauugagacuuuacuaugugccaggcacuauuuuacagggauuuacaugcauuaauccauuugguccucacaacacucccaagagacaggauacucuuaagaccuccauuuucuaaguuuaugaaugaaugugggggagcucagaaagguuaacucgcccaggguucaugcaccugguaggcgacagcucuggguuugaaaccaaguagucuggccccagaguccucccucuucaucaguaugcuuuaacuucccugcauuuucuucucacccucaucccugcuucaggaucucucucaucucuuucaccuuagcugccuuugaguuugaaugaacagggaaaaaguaaauaagaacgugaaaauacuagggagcuugguuaauuuuucuuucagugcuuugauccaaaugguaucaugcaaaucaaaguuaacaaacuagaaacggaaaaacucaaugauuuguaucuacuuaggaaagggccugaggguuuaguaggagagaggaaguuucccaaaggagacaggcaggcccccagccccuucugccuggagagcuggggacuggggguuuugccucaaaucaccaggagcgggagagggaggggaagucagagauauuuacaugccagaggaaaagggcuuggaaccucaacacuucucuaaggcguccacucccacauguacacccaaacccaucccccugagcacugcaguugucuuugguuuaccaacccagucaaacuggauucauucugagggcagagaugcaaauuuuaaggcaauuauacaagauaaaagcuacagcauccugaagauaccaauucuucaugcaggaaauacaugcauuagguauuaacauagucagggcacuguucaccauggcuguaaugaaaggauaaaaguccuauggcaaaucacaucucucuuggagugucuuuccaaaugaaaauaauaaguaacgguaaaagaaaaucauuuucauccucaagauaaggcuuucucucuuucuguacacaucaaaucuuuccuagaaauugguuuggguugagagcagcagcccccuacaagugcuucuuaucacuccuuuaggaaagcagcuucagaaaagugaagugugcaucagaaucacuuguggugucuguuaggacagaguccuaggccccacaucagaacuaccgagucagcaaagcauggggcaggcaggcuucuguccuauggcuaccuucuucagguaacugugaaguacucuaucgauuuguaaccgcgacuuacucgugaucaucugugcauacaccagaggcuaaaaauguucggacagagagggccaguauuauuuuccccaauuaagaaggcagauuucugaauuuucaaagugucauuuuuauaaguucagauaagauauuuaaauagcacaagucauauaaucagaguaaaguuuucucaagaauuuaaccaaaaggcagucauucguagcgagagaauucaguguauaauaauuaagggaauuuggcagcaccacaaaccaucucaaugcuaguuacaaccccuuaaagccuagccacaaucuauuuuauagaugagaaacugagauugagauuaacguuaagaaacauguacgagguccaagggccaugauguggcagggccgggauuugaacugggguggacuggucagauucuauauccauguccaaauccuagccaaucucugcuacauauaccauguacugaacaucaauacgucaguuuuucuccacuaucauucaauauaauagauaggguuuccgcauucaaaaaaaaaaaacaaggaaauugauguucagagaggcuaaaaggcugauccaaaggugcacaguuaggaaguuaauauggcuaauauuccuaacggaaccucugaugccaaaguauguuaacuacuagacuuaauuaagagauaaaauguccucauuuucaugaaucugaaagauuaccaaauuuucagguggaaaauuuguucuagaaccacagaaacuucucagugaacagaagagcuuccuuuuuaucucauuuaauuuuugaauuauacuucuacaaauaauuaucuucuucuucuagagcaaucuaaaaaguaauuucuaauaucuuaaaaguuauuaacagcuacuucccacugcguuaauacuauaaaauuaaauuucuaaguagaagauucaaguaccauaaacauagaagaguguaagcaagcauaaucuauaaacaguucuuacaagauuccagauuaccugccuggaauaaaucuguccuuaauauaccuaaaaccgccucccacccaaagaugaacauaccaauuguucuaaaagauagcucacauuuaacuuauuaagcagcaucgcuucuaaagaaaugaauauugccuuaaugguuagauuagauggaauuacauuuuggaacaugauuugagaacuugauucguggaaauuuuagucuucguuaguaacaccuggaauauagaagacuuuugauagagauuccaggaauauugcugacugcaugcuggaauacacauacauaucgucuucuacuucauguuaacuaaaguuagaaacuuaugagauucguuccaacaagcaacaagcaaaguuccauuaucaucaucauucucuuccccacacaaaagaggcauagaaaauaaaccggagaaaaagcugugucauuuccuuacccauugcccgguucauggcucagaccccuguaacacaauacagauuaacgagaggaaagccuaacgaauauauuuaauauaaauuuuaugugccaugggagccuuuagaaauaaagaccuaaagacaacuguguauuuuuacggacagucaugcagaaguaugauuggaugauaaaagaguaugacuugaugguaauaaauuggggaaaacuuagcaaggccuguguguucagauucuucuuggcaugugaguagagggcagaacuccucuggaaugaaggucuuaugaccuacuugcauggguguuaggucagagaauucuuuuauggcacacuugaggguagacaaauggaaaaaggucagagagugauguuccugcuucuguaguuuucucaguuuccuucaccuuaaaauacucaguaugcagagcuagcauauuuuggggguagcguguccugagaccuaucauaaacaaugacaaaauccagguccucacaaagcuuaccuucucaaagaacuagagaaaagacagagguacaggugcauagccaaacaaacaaaagacaaugaagaaugccucgagagaaaucaaaucaugcaccaggacagagaguaggggcuuuaggagagcuacuucagaugaagggucagggaggcuguuuggaucuguaugguugaagaugaaagaaaaagauuauuucucaagccugcaggacaucaaacugcugcaauaaucaccuuguggauggcaggguucuacuccuuuuaaacccaaaaaggagaguuaauaaucaauugugaaauaagaggucacuuuuuuacuuugauauuucccuuuccugacuacaagugccuuacugaguaagcaaggccacgcuuguucuuugcaaagcagaauuuaaagccccugaaacaaaaaaacccuacagugguaucauguucaagaggcuaacucaguggugcaccuucauuaacgauaacaacaggugcuccaggggaaaagaccauuacugggcuuauugcuauuaccacucagcaugagacaaaaaugguuuagaacccagggaucaggcagaaucucaagaaugagacacagaggcaaagaugaagagaacagucacugugcuuuccauggcagguugucaaaugcugccuuaaaaugugcaacugugugaauuccaaaauaugaaaugcucagaggcuugaauuguaguauucacaacuggacagcugaauauuaaagaugcugcuuuguccccuagaggggcuggcuacugcaagacuggcuuccaggggucauaauuauguggccauugccacucaauauuuuaucaucauacaauacugaggcuggcaaauaucuaucacgggaugugcuuguuaauaaugaagauucccaagccccagucacaguauucuaaauaaguagauuuggaauaagaacugagaaucaacuuuuuguuguuguuaacugauaccaaaguuaauuuucaugcaggugauacaaagaucgcauuuugaaaagcagauucaacaacuuuagauauggauacuuugucuaaaaggacagcuuuggaaccuucauuguucucugggauuuuauguguguguguguguguguguguguguguguguguguguguguguguguguguguguguguguguauggugguuuucuuauaaccaccauauucuacaaacgagucaagauauccccauuauuucauaucaggaaacuucugugaucagguuggaaacaacugaaagaugugcaaaacagcauaaccugcugauuuaaaaaacagaaucguuuuaaaaaguucaacuuaagcuaaauaaucagggugaugauaacaauaaccacauucaacaauucauauauaaguacuauauguuaagaauuaguccaucaucaucaccaucaaagguaacaaaaacauuacacauuuuggccagauaauugggacaucaaaaaguaauuacuauuggaguuacacaaucuguagccauaguuaucagcccagcuaggcucacugcuuauuuguuuuguguguguguguuuauuauuuuuagucaagagauaauucaaauaugauaaaauucaccauuuuaaaacguacaauucaguggcuuuauuauauucacaauguugcacaaccaucaccacuaaguccacaacguuuucauuacccuaaaagaaccuguauccauuaggaaucauuccccauuccuuccuugucccagucccuggcaaccacuaaucuacuuucuaucucuauucagagccuguugcauagcaaauauuuucuaucccgcuuuagaauggcuaaaugaaauuuugagaucauauaaccuaucuauucauauaaguuuuagcuaugcuuacuaugcaccuauuaucauucugugcaucccacuuaauacaguuugugcauucccccaugucacuagcuaugccucuacaguaucgcuuucaauggcugaaggaauuccaucaaauagauauugcauagugcaucuaacuaauccgguauaguuggaauuuacauuugaauacugaguuuuaaaaaaucuuggaaccaaguuuaaacauuuguguuuugcauuucaagaagugauuucaaaaagaagccacagguauuaaauccuuucuuugcauccguauauuuagagccucacauggaggugagacagugggacagaggaaagcugaaagccucugugucuaucaccauacccuguguguagagcaauuaggaggcuagcccuuuuuuaugauaaggaauuugguagcccauaugguggcagucccuacauaaacuuucacugcuuagaaguauuucccagagauuguauuuuaaaagucccagaauagcuguguuaaagacaaaaguaaaguaagaucaaaagggaacuuacguuuauuuggcauuguuugugugggcagcaccuuauccacucacagcuagucuucgaagcauuaaacuuuauuucaacaaaguguaacauuaacaucccagccugacuugcuucugacuucuagcaccaaaaauagagccuuuucuaugacuuaggugcagaaucuacccguauaggaauuagcauuuguaugaaaagagcugaaacccagcuucugaaucagccaggauuuuauuauuuuauuuuuacuacagaagcagagacuauccuaauaaauccuccuuucuucuccuagcacacuuaaaaacccaucuuugagcuccacugacuccauuagguuugaacuuugguauuaaguacacagggaggaaaagaguaggugugggggugacgagaaggagaacagagagaagcacaggagaacagaaaggaagggaggcagcuugaugcuacugcugcgguuauugcuucacucaaaaacaaugaagcaaaagcagacuaugucaagaagcaaaggugugucaaagacaccccaggcuuaacauggggcugcacaaacccacaggaagcucacaugcuauuuccuagacacucucucacaugaaccacuuugacuuauguuuccggacuccuugauuuaguuucuguuuuagcguuugcacaauaauaauuuuacuacuaaaaguaaaugucuuguaaaccaaugggaaacauauuguuuggcagaguuuauaaugucaggauuuacggcucuaacacugagggucucucugaccucgaagauaacauaaugaaacagcaaugugcugcauaugacucguugugauuuuuuauuaguucucauaaucgccucuuauuaauuuguaugcacauaauaagcacucaccuucacagucuguccggcuucggggccauccuagaaguaggaaaaaaccaacagaggugagaauagauagaugguaucuccugcuuauucagaaauaucacccauuaauaauuuagaugcaauuucauuguguguuaauuuauaguauucucauggggaccauuggcuucaaaugugcgggauuagacaguucuccauuuccgccugagaguaagugcgaaguuauguauaaaaaugauauaaauuauccagcaagccaacuccuugcuacuuuucaugcucuuugcucuaggcuaugguuuuaauugcauuaaaggaaggcugaaaauguuuggggaggugaaguaucacaccuucugguuauguuuagaggugguuuaauuaaugucugauuacuuuaagcuucuacucaggaaaucugcuauaaacauaagccauuaaggaagaauaugggguauuucauaugggaagaguccucuggcuauucugaccuugugggagacaaaugguaguguucauuguagcuggacccuuuucccaaacugguucccuuucucuguuucugaagcuuaguuggaaaugggcaaacucaccaagucaccagccauaauauaaagcaaaagcagauacucagcugguugagauggccaaacaaagcaauggcuccacaaucagaaauuccaaaauagaauuucaccucugcaacuuuagccagguuugucuaccucuaugagccugacuaacggggugagaacucccgccguaaggauuaagcauaacuguguauaucagggauuuucaaacuuagagucacaauccauuagugggucaugaagucaacuuaauggguugcaaucagcauuacaaacaauguaaaucagguguuuuuuuuguuguuuuuuuuuuuuuuuuuuuugagaaagggucuuacucaguuguccaggccagaguaugguggcaugauggcggcucacugcacccuugaccuccuggacucaagugauucuccugccucagccuccugaguaacugggacuacaggcaugcaccaucaugccuggcuaauuuuuguauuuuucuuagggacaggguuuugccauguugcccaagcugaucucaaacuccugagcucaagagagcugccggucuuagccucccaaagugcugggauuacaggugugagccaccacacccagccagaaaucagaucuuaauagaauaaaaacuauuagacugcacagaaugaguaaacauuguuuugugaaacucugguuuccuuuaucaauauaggcauaugcauauauuucauauaugugugucaggggagacaggcaugauuuugaaauaaauauguaucuuacuguagguuacaguaaaaaauaguuugaccacauugcauauacgaaaguacucuaggugcuaacacaagucagcucuuacauuuauggaauuaacuuucuagugaaaaauguuccauaaccagcaauggccauuuccuauaaaugugauuuuuauucuuguaucucacuaaacauuaacagagguuuucauucacugccuucauuuagucucuccagaaacacgguuugcaacauaagcuugauaaacccacucugaacugaacuaccugccugaaggggacucaaaugguuugacauacaacacauacacacaaagcauuugggggaaguuuagcuacucuuaacacagacauggcagcaaaaaaagaaagaaaaaaaucuguuugagaagaagaugagcacuuuuagucagagccuucauaaccugaaaacacuggcuuucuuuaucuggucucuuugaagcucuaugguaaagagcuaaggaggggaggaagaauggcaaacauucaguuuaacuaacaggcugaguacagaguccucacauuuugaaaguguguccuucuaaagggcaauuacagagucauccaauuucagagccaugaaggacuuuauacauugauaccccagcccuuuccauagagggccugaaggagcucaugguauguuacuacggauuuacucaauucccuacugaugacucaccauggacauccuucucccaaccugacaacuguuggcucaaccucugccuaaaaaucuucagugacuggggaucugauuucuucacuggucagugggccacacccaaccagugaaucuagcuucuaacuaaucugugaucaaucucugcaucuugaauuaaagacagacaaaagguaaggcccaaccuaagcugcauaucacugccacccuggaauuagagcagggcuuagucuaugcagugcucaaaaauuaguuaccauggaaugaaaaugauuuuuccagucccaguuccaguaagcaauuuggaaugucugaauguccauuaaaucacuuauccauuacucccaccugcuugguaaacaagccucagacaucaccuuagacacuaucccacgguccaucuuggggccaauggacaguaggguugcccugcauuagaaaucucuuuuuuuggcugcuaccuaaaauacaaacaaucacaucugcccuccugguaagauaucaggaggagcaagcccaaugccgggauaugaaagggaagaaaaaucauuucugagaaaucuguacacucaccugcauggaaaaggugagagaggucccauggaaauguuuuuccaccacugucccgacucucugggucgucugaaacaaaucggccacuucaucaggacgcaggucauggaagcgcuccacuggccgcagcgggcacacaaggacaucuguagcaaggucuguuaaggcccaugcugcuggcuuuggguaguguucuuaccaagcaguucauacccacaggauugaauccucucggaccagggccugaacucucaaagacuaaggaaugaagaaacagauauuuaccauccacugaacuccagagaguugaaagagagcucccauacauggauaauuacacuuugaaggagaagcugugguaugcagaagaauuucuugcaaaagaaagggacauucguguacagacagacucaaguguauggugagauaauuaugcgaggaggcaagaucuauucuagaucauucucucuugaccccuauucuaaagcuguguccgcuucagcagccaaaggcacuagguugaaaaagcaacuggaauaucuacuugguuucucuagguagaacauggggauaaauuuuuaauuuaaauuaucucuuuagagaaauaagaaaauuaugcaaugaacauacaaaaguagauguuuauuuuauuuuuaaaagaguauagacauucugaaaauguacagugaacuuuauccauaacuaagagaggugccaugugguuaagcaauuuaugacaagaguuccucagacuaauuuuuuuuuuagaauccaaaagaagacauuugaagguaaaucaugaacgaaagguugucuguuuauucaaauaaagcauucuuaaugcauucuacaaguuagacaaggcaacguauuuacacuauuggucucagcaacauauaagaucugagaaaaaaggauagaaauuugauuacuucuugauaggaaauuaauauucacuguuacaccaucaauaacauuucagucacuauacacacauguaugcacacauguguauauacacacacuauauauauaaauauuuguuuaguuuuuagauacuaacaagagaaacaaacucuuguacguuuuucuguuucuuuuuucuuguuguuuuaagacagcaugcuccugccuggagcuaagcagcugaggggcauaauaaaaccauaauucugcaauugcuagucucacuagaauaucaaccccauuccgcuauugguagaacucagagcccaaggggaaacacaacugagcucagcuggucaggccugauuuccauaagagagaggggaagagaaagaagaaacugauuaauuuugcucauaaucaggaaauucaugucaaugguaaacuaggaaaagaagcauuuuuaaaaucagaguucauuuuucaagagaggagaagggaggcguucacccacagggcaucugauacuuaaaaagauaauuauccaucuuuggcaggcccgcuuuauuaucaugggucaaugaaccauuuagaaaugaagaauuuccuuucauuuccuuugagcagauugccagccuccacucccacgaagcugcuuuuucuguguuaaaagggacccuuccccauauuccuccucccugauuugaauuacacccucacuuaggccugacuucaccaaaccacagcaagggugacaaccaugcaagcuuccaacgaaguccauaagugcuauguuaggcuauguucacacacagcaacucggugggggaggaagacauuucacuucaacaauggcuuacugugaaaacugguggaauaaaucagacaaccuauguaucuaauguaaauuuaguaauaucaaugacauccaaaaauguuuuuuuucaacaccauaaaaaaacuuauuguuugucaauuuugcuuguuugcauguugcuccuagaaaaacaacucagggaaagcaaauuaauuagaagaacagcagauagcuuuuguaauucuaaugccacuuuuuauaugccaauuguuuuaaaauaauaucacagaugcaauauaauuuaauuuggagccucuuaggccuuguuaauggguaaauuccauauuauacauaggcuaugaagacacauuuacuucuggauccuguuugcuugggauuaucuccucugucaagauuucuuagccaacauguaggauaaccuuuaaagaauuaaaguuacuauauugaauugaauaaauguuuuauccaguacauaucaugugugaaaacuuguggaacugguuaccacuucucccuauaaucuagaguauagaguuuuuuuagcaauaauauuuuuuaaaggaagcgaaggucaauaguuauaauuuagguuguauagcugacaaggagauuucucacaguagaugaaaaccaaaggcgacuucuuagagcagaugagauuuaaacuggacuuuaaaaauuggggagugauuuaaccaguggauugggcuggcaaccuacucacucauccaucccaacacugcagucuccucucaguccagggucuaugcuggaacuuaggaugcuaagaugaccaggacagaguagcugaccuugaagaguucacauucuaauguccgcaacugucaugcaguguaaacagaucauuacaacacagagagaugaaugcuauugguagaaaucaguauagaaagcugugggagcacaggggaggucagaucuaauucugccucaggguguuagauaaacuuuuccaucucauuuuacauuucaccuuuuaaaguagaacaauuucuccacaccuagaccaaaaucuguccuuaaaaaugguccagaaacuuaagguuagcuucaaagaaaguuguuaagcguuccuccuuuggcccaaaucaccauuucacuuuuguacguacucuuacuuacucaaucuuuccaacaaacccauaaacuauuaauacuauuauaauucccauguugaagaugaauuauaagcaauaauuucuuauagaaaauuagaaacuugccacaccagcacacucaaaaugagauuaaaacuagaauucaacccgucuguccgauucuaaaguucauguuauuaaugacagugcugugaugucaugcuuguuagagcuuucaugacuccauuuuugccuagccucuuauuaaaacugugcccugcauucccuagucacucuguucauagaagggaaccacuguuuucauuaaauagaaggcuaugaugcaaacaugcugaacgcuuaagaaacaccuaaccuuggaaaaagaaagcagacgagaccuacaaucccacaaugaaaggaggccucagcacugggcagugaguaugccuucauccuaacagagaaucguaagaucaaaaaggggggagaguaccagcuugccugaacuggaggaaguaaagagggauacaaagcuggcauuuugccccuucucauccugacuuuggguugcuucaaggugacuugggcuccaucaugggccagacuccugagaaaguuuagauacugcagccucuaucacugggucagguugucagacacacugaauccauugcuuguuggacagucuaauuacugagaauuauggaccuucucacaacacaugauucauaucacaagagacuaccagaaacuuggcaauccuuucuuuuuguuuucccuuuucgucuccuccucuucaugcucaccaccagcccagaacugacuaucucucuuuuugaacaugaacacuuuagguguuuuugcugcauuaaaguggugugaccacaugccaagcccuaugcugaacucuugcugacacacugccaacucagaauacacacaaugaaagaaagacauauucgcauuagucaggugccuagagcuggugugguuugcuauuugcaaaugugaccacaagaaucccucccauccuacacaugcuguuuugcucucuggcuuucccccacuuuccaucaagaguugcagucuauuuccccuccccuugagugucuaucuuacuuuguguuuguguuguuauaaaagaacaccugaagcugggucguuuacaaagaaaagagguuuaucuggcucacaguucugaaggcuguccaagaagcacgaugcuggcuucugaauuugguggaggccucaagaugcuuccauucauggcagaaguggaagggaaaacaguuugcagagaucauauggugagaaaggaggcaagagagacaggagggaggugccagacccuuuucaacaaccagcucuucugggaacuaauagagcaguagagagcucacugguuaccacaaagaugacaucaagugauucaugaaggaucugcccccaaacacuucccauuagacccuaccgccaacaucagggaucaaauuucaacaugagguuuggagggucaaauauccaaucuauagcaguguugcugugugacuuuccaagguuaggccuuaagugaccuugaaaccucugauuauugcucucuuggaagccugagaccaacaugcuauaaaaaaucccagcuagccuguuaaguggcaacaugaagaaagaacuaaggcaccucagcugauagucagcaauaacugucagagaucaucucagaccuucuagagucaggagagccacugacuuccaguuucuauaucacuuaucuacugcugcauaauaaacuaccccaaaucauagagccuuaaaacaacauugaucggccgggcgcaguggcucacgccuguaaucccagcacuuugggaggccaaagcgcgcgaaucaccugaggucagcaguucaagaccagccuggccaacguggugaaaccccaucucuacuaaaaauacaaaaaaaacagcugggcaugguggcgggcaucuguaaucccagcuacucaggaggcagagacagaagaaucccuugaauccgggagguggagguugcagugagccaaggucacgccauugcacuccagccugggcuacaagagcaaaacucugucucaaaacaacaacaacaacaacaaaccaacauugauagguuuuacuaccauaagucuguggaugguuuuugcugagggucucaccuggacucacucaugcaacugcuuucagauggaagguaggcuggagucugggcucagcugcauccacuaggcccuucacucuacaugcucuuccaucccaauagaugcagaaucucugaauuugcuuaaggcuuacauugucccacauucuaucggucaaagaaaaucacaagccaacccagauucaagguagagauauucugucuucuaaaaggaggaguggaaagaugacagucaaaagggauauggacacuaggaaguuccagggauguuuaaaaauuaacaggggcccaagguaucuuggcuguccuagugaguaaauacaggauggcauuuuagaguugagaugcuccuuuuuuuuuuuuuuuuuccugagauggaguuucgcucucguugcccaggcuggagagcaauggcacaaucucagcucagugcaaccucugcuuccuggguucaagugauucuccugccucagccucccaaguagcugggaauacaggcaugcaccaccaugcccagcuaauuuuguauuuuuaguagagaugggguuucuccacguuggucaggcuggucguaaacucccgaccuuaggugauccaccugccuucaccucccaaagugcugggguuacaggcaugagccgccgugcccagccgagauggaucuuaaacaucaacuacuccaauaccuucacugucagauuuuaaaaauagggagagaaagguuacuuaacuuguucaaagucacacaguuaggagcacaguugggauuggagcucaacuggugagcuuccccaaccaaagcucuuucuguuacacugagauggcaaaacauugcacaucugccacuauuuuccaaugguaaacuuauggcagaauaaucgaccacagaauucucuccuuuaaccaaaguguccccaaauacuugccaauauaaccucugagcagucaacaccagugagaaugggcacgcgacaugagaugcaugugccauuucuguggccucccacacugccucaugaaacacagaaccaacugcaaaggacugguggagucagaacaaagggggaugcugcaaaagggagaaucuucccaacuacauaaaauuuccauuauguugccacauuuuuauucaaaauaaauuugauaaguucaaaauuugcucaucaaggauaauaauugauuaaaaauauuuuuaggaggauuuccaugacaaauacgaaauauuuaaacauggagcacugacagauaaauggaaauguacugauucagaugauuaauuaaagaugacagcagaauauuaugaucggaguugcucagacucgcccccauuuaguuuucuauaucugaucuauucuagggauucagaauauagaagucaccaaaauaaagcaaaucaucaaaauaucacugauuuugauuaggcugauuagccuguguauauauuaauaugaaguaaggcaguaucagauaauacaacacagaauuaaucauucuucugaacuaauaaaaaagagucuguauucaucucgacugcagaucuguguguaguuuagugauaagcaaggaacauuccagcuugcaaugcagaccucagcagacccuguauaauucauuauuugcucuaacaaacacuccuaggccuuguaaauguuuaaaauaauucuuaaugucacuucacaaaacaauagcaggauggacugucagcuacuuuucaagaaaauauucaauuuauuugauuuaaauagcacaauuacagagcuuugagucaaaguaggcggcaucucaaaaaguaaucuauucacaacguaagcacuuugauggauuuucauaucagaaaggcagaaauaucacccuuaaauauuaauaaauacaauucugaagaagcaucuugcuuuguuugggccacaccuuuuuucaguggggauuaacauacucauuucaguaacucaauaaaggguucaugggauauucaucaaccauaaccauaaaugacacagauguaauuuuaagcaaaugugauuuccagaauaugauaaauuccagagcagugugauuaagauaaugauaacacucugcucagagcugguucucaaggcaagcaucucacaaauauccacuaucucauguuuugcccugggauaugcuuugggucagagauaugaugagaccuuguucaucuggaggaagagaacccagguauccuugucuaggcaacaugcccugagcugcccucaaaacuccgguaccgaucuggaugcucaaaaguaagaaucacuuucaucgagagaagcaaacaguugccuuucaaagaaaguaaauugacaggggaguccgcagcccgauagcauucugguacagauucuuugguugaauuucacauauuuuucugugaacuuuucaaugcaaaguaaucuuauacugauugagggaagagcaucauaucuggaaaaaaauaugcucauauaaacuaaguaugugggaaagaaguaaaugauaucauuaaaggaaagaaacaauauauaacauuuguuugcugccuaguauggucuagugauaaucaauaacccuuugaguuaggauaauaucaccucccaauguccagauucagaaguugaggccaaaaaaguuuaacugcauaaccaaggucacguagcuauuaagugaaaaucccagccaggggcaugugcuacaacacuguuacaauguccaugcuguuucaaugccucucaagguuauaaaaaccuccauguauaauaccuacugcaguguuuacuagagugggauagcagagcccugcuuccacgggaugcuguuauacauuauacagaaaaaaaacugugcggucaaagaagauugagaaacacugcaugaaaugaaguaaaauagcucucuuuaccgcaguauucaucagcauauuuacuguacuacuaugcauucuggcuucucaaaaauaagaaauaguaugcagcacugcucaaauuugcuuaucuacaaaauaauaaugauuauuaauuauuaguaauauuguagaacacuacacaggacacauguuucagaggauguucuuuggaaaccuugagcaucauuucccaaaacacagagaggccugaguaauuuuucuguuuuuucaaacaaaaaguugaguacauguccuauuaaucacaugggcaaagaaagagagcauucugugaaaugaaauaugcugagaaguugagcauuaaaauacaucaaaugggauauggcagucauuagugcuguuugccaaacaguucagguuacugccaugucugggcauaugguaggccuucuggacccuugcaguugggugaagcucaaggaauacaggucaaagaguugugagcgaaaaugauauacgucacuucugggcuaaagcccuuaacuucuaguaugugaccgacagcuuuauuuccuucaccaagacaggcagcaaugcuuugcaaugguagcugcucuggcagugagaccccgaauuauaggucagcaggggccucugagcaucguggucacagugacuagggcaaguuuguucuuaaauagguuuuaccucuuuugcuaaccccaaccaacuuguaguagcuauuuacagcagcauguugaagaggauucugaagcucugauaaggagcaggaggaaagaacugaggaauuuauuaguuuuggcugccaccagggaggaaaaaaauauuagcguguauaccaaguaccugccauucuucaauuagacggcaauaaaaauguuuuuucaagaauucucucucccccauucuuaaugauauagaagucauuucugggacuugcaaugucucucaguaaccguuaugaaaaucuauuauuauuguuauuguccuagagauauacagaagugucuagaauuuagauaauucugguuaggagaguacugaaaaggaaaauuaacugucacucgaaagagucuguccacaauguguaaacaugagaaugggaacacaccaauaugaaaaugagcauguuguaaaaaugcucuuaggaguuaagacuugaaggaguauggcaauagaagaaauaaauugcacucagcagcugaagaaauauuuaaagauaacuccaaugagagauuauuuuaaacuucagauacacuuugcuaugagaaucauuucaaaaacucuguaaaaagcuuuuuagugaaguagagaugagaaaguaauacuaaaaaucugcaauucauugcagaucuagaaaaccacaugcaacauaaauaauuuaauagcacccucaccauauacacaguuucauuucaccaguaugugaaugaggggagugcccugagcacauaccuccauaggguggcuagagugaaaccuggggcccaaacucccacauagacaggauucuuccagugcaagcucuaucagguuuugaaauuauggauuccaaauuuagguuugcuuaugucauuuaagagacuaaaaauuccaguuucccucagaucuuccauauagcuggccaagccaauggagcaaccagacaacacaguucagaugccaucugaaggcaaaaaguagccaaacuauaaauaugaaaggaaagaaauaggaaaugagagaaagggagagaggagauuaaagguaggggugguauuuagcagaugaagccuccuuagaagagaggaaauacuccuuuauagauaggcucaacuaggauuccuggugcuacacacagagcuuaacauagcauuggccuuuaauaaauacuuggugaaaaaauaaaugucauguaggcuuauucauuguuuaaucugggaaacaauucuuucuaaugaauaauuucuucaaaaugcuccccaaacuguggguucuuaaaagaccagugaaccaguccagacucaacuuacuuaaauguaaaccauuaagaaaaauauacuucaugguaaaaaaaaaaagaauuaugaauuccuaauacaaauguaacauacccagcuaaagggauagaaaaauaaauacaaacuggucuuuccuucacacaucaaaaguagugcauguguuuuaaauggaaaacuucagaacuauuaacucagugaagcuuggaaaaguucaaagauaacaguguucuaugcuuuuuaauaacaaugaggaacccucuucuaugacagauacuaauguuaauagaaacauccuuuauuucaaauaaaugaaagagagucacacuuaacacuaauuuggcauucucacagaauaugaaucaacgucuuucucucuuaaaaucaguccuccaugagcuagcaaccuaaaauaaaugugaagauuucguagugagagguauucaucauguguucagugaaugaacuucugaaugaauuagugaaagaucacaaaguugaauauuagagaaaaggauaaagccaaaagacuuucaagaacucuguauuuuuuuguauauucauucaguaaauauuugugaauuaagagccgacuaccuggcaaguacuauauaagacacugaggauacagcacaaccagguacagucauccucucccuuccaaagaugugaaaucuagagggugagcagacaaaggcaacugacauaguaacuacugugaaaauauaaggggugagaugagaaagaaaaggugcaagaaugcaagggcaagaccguaacaagccaaaccagcuaagguggcugugaacuaggcccaguucacuuggucuaacuggaucuucaggaaagagugcaggcccuugauagccuuggucagcagucuguauuuauucgccaugcauggagaagccacugaagcauuucggagaguggagauguaugacagauucuggguucucuuugcaaagcugaaggccacugggaauaucuuuauugcagacuagguaaaagauucaaagcaggccuggccuguggugguggcaguagagaugcagagaauuugagauguauguuugagguaggagcaacaagacuuaacuaaugggggcaaaaaggaagagaaggaucaaagaggauuccaagguucuggcuuggguaguaggugaagagugauguaauuuugagauacggugggugggacagugucauguagcucaccauuuggagacuuuucuuucuugaauuuauagaauucuccagaaauaacuagagcagaguuuccuaaccugggucuacagauaggcuccagggcuucuaugaaucuccugaaauuguuugcaaaauggugcauaugugcacgcacacacauuguuuuccucugguauaaaauucuuaaauagucuccugaccccaacuaagauaagaaaucuagauuuaaaucagaagaauucuuugaagauuaguccccaagagaaugauuagaaacaggcucagacuuuugcucacuuuggcuuagaaucuaauauacccaguacuaaagaguaagaaaagaaguucacucugucugagcaaugugccauaauucacaagcaugaagccuccauaaaagacaaacaaaagauuuuuuaaugccauaacaccgaagucauuuuaaucugauucagcagugaacaauuuaagacaugucuccuccaacaaaggcagcuggacacauaaagaugauugugugauccauucaaaauuaaagaauaagcuaaaucauuuacaacaauaaaaaugcagaaaauucuaccagaaaaaaaaaaaaaaagagagagugaaaacuuucagcagcaagugauuuccaaauguuuccaaaacaggaagcaaaagacauuuuaaugucacuguggcagcuuccagaauagaguaaguuaaucaggcagccucuaaaaacaaagcagcaauucauuaaaaacaacaacugcuacucagcaaugaacuguacugccagagugucaagaaagcaaacuuuuucaagauagugauuuguaugcaaauauagcucagcauuuaucacuaaaccuccaaggccuguaaagggggggaaagaaaaguucuuuccaucugcuuacaccugucuccuaauaaaaucaacugccaaucacaggggaggcuggggcauuuuaaaaacagucaaagaaauacauucacaaauccaggguuucaaacaaaaaacuccugucuacucuuucuucuucaaaucuccuagccuacuguccucuuccuaaauuggaguuaauaucuguaccuacuucauugggauguuaaaaguguuuuuucaaaauaauagcauauuucacaccaacaaauaaaagcugaacgaaugguugguuuagaaaaaaaaaaaauagucaauggaaaugaaauccuucaaagcuucccucaauccagcaaugguaaugcgguuaugugauugaaacagugucucacuagcaccaguguuaucguuuggaacccagaucuucauucaucucauguuuaaaaugucuguacuuuucuacauuccacucacccacccaucuccauuuucucauuugaucucuguuuuuuauuucccccucauaauguaagcaucacugguagcagagucuaggaauuaaucaucuuauaaucauuuagucuuccucuccaguucuaacuuacgacuuuuucaaaauaugguugcuaacaauaaaaaaaaucucaaaaugugaaaacaaacaauggaaaaauauuguaaauauuuaaacgcauuuagaauuugcaaguuuuuuucacucuaaugucauuuuucaagcuauguuuagacagcacagaacacuauaugguuuaccuaauguuuaaauuaguagaucuggccaggugugguggcucacgccuguaaucccagcacuuugggaggccaaggugggugggucacuugagaucaggaguuugagagcagucuagccaacauggugcaauccugucucuacuaaaaauacaaaaaucagcuaggcaugguggcacacaccuguaaucccagcuacucggaaagcugaggcaggagaauuucuugaacccaggaagcagagcuugcagugagccaagauaacgccacugcacucuagccugggugacagagugaguaagacuguuucacacacagacacacacacacacacacacacacacacacacacacacacaaaauuaguaaacccaauaauccacaaagaucuauaaaaauaugaacuuacaagauuucuauauauuugaauuucauuuuguauauaacugaaaaaaaauauuuaagcaugccuaaggaaaaagaaaacuguggaaacaaaacaaauguucuggcaauucugcaacaguuucacauuuguauauuguuauuccuccugaagaauccuaaaauucacucucauuuucuuuauaugcuuagauauuaaaaacaugucuuugacaaccaacagucuucugucauggggaaucagacaucggccccauaaucucucauuaccaacaucaccauugucacugucuuuaccaucaucacuuaaaagaaaauagaaacugcuuaaauaaccacagcuaaaauaagugucacaaguuucuuacugauuaaaugcuccuccgcgagacugcaaccucgaauacuacgccauagaguucagauuccaacaccuuuaauguuucuauaaggaaaaaaaaccacaagcguucucccugaaaacguacucuuaacucagaaucucuucugguuccauuuaguuuauaaaaaaaaaaaaaagaauaauucagauugaaggauaguauuuuggauuuucaguguuauugauauuccucgauccaucauaauuuagcuaacauagaucacugccuauagagcagugcugucuaguggaacuuucuauauccuauacuguucaauauaguagccacuagccauauguggcuacugagcacuugaaauauggcugauguaaucaaccauauuuaauugcauuuuguuuuaauuuuaauuuuacauuuaaaaauuaaauuuaaacuuuacauuuuaaauaccacccuguagcuaguaaucacuuguagcuaguagcuauuacauuguacaguucaucaggagaggccacaaauuuaugguaacaaggagugguggaacuggcacaacuggaaaacacaugccccaagguggguggccaccaccuagagauuuuuuuguuccugaagaaacuagaaauuugaauugcuauguguaauucucuucuauuuaacuuuuggcaacuauaggcaguccuucucaugguuccaauaugcacauauuucaguuacuccaguuuaaacaacaccaauuccccaacaacacgguuuaaauuucaguuaccaugucacauuaacucugggucauuggguaaaguacaagcuccacuacuagcucuucaauucacaaauuaccauguagaucauagaugugcaugaugaucagagaccagucacaucacuucuuccaaagucugucagugacugaucacugcacaucugguauucagucagaggcagccagcaaaguauguaguuuuguaucccacugaucuuccagugaugaacccacauauuucaccaaaauggauaaucgaaagagggaacuggccaagaaauaugaaacacaagugaccaaaaacaaaaacaaaaaaccaaaugugacaaccccagaagugcacuuugaaucaaauguaaauaaaauuauagaacaaauaacugacuuugggaaugccaauugcgcugauguucaggagauucuagauauguaacccaaggaauuuaguaaagacaaacuuauuaacauaaauuaccaaagaauuuaugaugcagaagaaaaagauguaccagaggaagugacaucaaaaaagucacauuuuaaaaaacguccuauuucaugacauugaaaacacaaaggaugaaauauuggaaggagauccacacuuuaggagggauuaugacaaucagccaaagcacagaaaagaugccccaucuguacuguuaguugcaggauaagaaaaacaaggcaagaauuguucaagagacucucaauaagugauuuucaaagaaauaaagcacuucaauucuuaguguuucuaauguuuuaaauuacaguguacuaaauuaguauuaguucguuuuuuacuucuuucauuauauuuuucuauuucuuuauacucugauaacuuauagaggguuuuuaaugauuagagaaaaacguuaaaggucauagaacagucauacguuuucccauugauuacuaaguggacauugcaugguuuccgcuugcguggucauuuuuauagucccacacugcuguauaagaugagggguacuuguacuuccaauguguuaaaaaauauuggguggggcaaauaaaacauauagguaacaggccacaaauuuaaaaccugugccaagaacuagugucauaugugaugugcaucuuaauauuaggagagagcagaugaaggaaaaucaaggacugugacuuuaaaaagacauauauaugcagucucucuccagaaagagcagacccgucgucauaugcuccugaauucucccaccacacugccuggcaaaauuaaagucaaaguucucuuuuguuucccaaguagccugagaacugcauguuacugucuaccuaaauaacagaggcucucuaaaagaaaaugauauuuauugagaaaugggccuugucuugggaauacaugugccacaguaaauuaugaguauucagccaggugaaggaagacaaagguuuuuaaagggcaagugaggagaauuaccuaauuguuuugagguaauuauccuugguuacuaggaucaauaacauuguagcaccagaaagagguuggacaggcaguuguugggcagauguccucauagaagcauugugugugugugugugucuguguguguguguguguguguguguguguguacaaaugugauggccuuggugcagcguggcuuuuugcagagucuuuuaugauaguuuuuguuaucaggcauuuguacaugagaacgcucccgucauggccuuuccuagcucuauuugucaggguuuuguuugugacuccauuugauucugacaacuuuuauauuaucaaaccuccugaacucugaaugcaucauuaaaccuggcuguuagcauuaagguuuccccaccaaauguucucuuguacaucacaauaugacugaagggagauuacauaaugaguaacaucaauaccaugcauguucuauauuccauauggauaaugcgcaacaagcaaaauuccugccaaaauccuuauuuugacacaaaaaacagaaugcagcuauagcuguauguuuuccuucacaauguuccacuauaggcccuuucuguagugcauuaucugccgcugguccagaagcucuuuaaaaacagaggccacuuauuuuucauccuuggauccaaagaccagcauauggagcccagguuaggacagaugucaccucuuaguagacuuaucaaucccaucccaugaagguaucccuccuuccuuuucuucccauuuguuuguaucccucauagcuuauaucaaucuugaaauuuuaguacucauuuaugauuacuuguuuucuauugagaaugcaaacugaaaugagggcagaaaucaggaaugucugcuucucagcuguauucuaccuggauacaguauacugcccauagagcacuugcuaaacacugaauuggugggucaauggauggauggauggcugggaugcauggacggaugguagaugacugggugggugguuugaaaaaaugucuaagggaaugacuauuagaacgaaugacuguugaaugaauuacuguuucauuaauaaauaaaaauaaauaaauaaaagcuaaaacuauuauuuuaguaaguagagaguagaaaaaauaacuguuauuuucuuaauguuuuauaaccauaaacauaacauucucuggguugucuuccuuuucccaaguuauguccucagauaaaucuaaaaaugagaauucuuccaaugggugaucuccccugguccaguccacuauuugcugaacuacaagauggagaaguuucacuuugcagcagcaugugugaaaacagcuuggaaauuuuuguagagaauaagcucaagaagagucaacagagaaauguuguuucuacaaaacacguuuuaucucagauugugaaugcaagucugguguugaguugagggaggugauuucucacucugaucuuauugacagggauagucauggaguuuucugucaaccugggagccaccaggaacagccuauagcacauucacaaaagagaucaguauggcugaagaaaaucaaagaaaagagaaaugaggaaacaagggucaaccuuugacuauagcauugcaaaggcagucauucuaggaaggaggaaagaugcaggugaaccaacuaguaaaugguagaacagaaucugaauccagcauaugaccuguggagugacucagaucuggauuccaauuccauuuuugccacuuuuuagccauuugacucugggcaaauaaacucuuaucaguaaccucaccugcaaaauggggcuuauuuauucucauggaacugcauuucagaguaaccaaacagcaccaaugauggacaauucuucaaagaauucuagcauuaaaagcaaaaggacccccaccauuuuaaaucccuaaaaauauaacugacucaugcaaaauuaucaacagguaauuuggggcuuaggucaggaguucuuaaccugggggucccacagaggcuuagcagagggugcauggauaaaaggaaggaaacacaugaacaugaaugaaaaaaaugacacacaguuauuuuuacuaauuuuuaacuaaaauuuuguaucuuauuaaaucacagauguaggcaaugaaccacuguaguaacagcaguaccuaugaguugugucacaguauaaaucacagguauuuaaaaaauauguaaaguaauaacuugauaguuauugcaguuaccuugaaauaucauuuauucuagaaguacuuaucauuacaauuacuaucacacaauuaugauggucauuauagcugcuaccacuucucauuauuuaauauguaauaaagaaaugcauaauucacuguaucacaaauuugcuguuaauacuguguuaacugguauuaaauaacaugaauuuccuugguacuucucuauacuuaacuguccuuaauuaaaaucauuauugggugggaggguugcucgaggcuaggaguuucaauccagccugggcaaaguagugagaccccauaucuaaaaaaaauuagcugggcauaguggcgugcacguguggucucagcuacucaggagacugagaugggaggacugcuugagccuaggaguucaaaguugcaguaagcuaugaucauacuacugcacuccagccuaggugaaggagcaagaccguaccuugaaaaaaauaauaaaaauaaaaaauaaaaacauuauugggggaaaagguauacaagcgucaccaacagccaaaaaggugacugaaccaaaaagguuaagaacuccugcuuuggaugaaagugugacgggaaacuuuauaauggagaaccaggcugucacuaccuaaaucugcugaucaauuucaggauucuaagagcaggacauccagacauuaugccucccuauacacugugauuugaagcacauaauacuacuacuacaaaugcuuauaucugaaaauaauccauagacccgcagcugucuaauagaacuuuuugcgauuguuuacacuaugcaacacagcagacacuagcugcauuugaaauguggcuagagcaaagaagcaaccugaauuucuaauuuuacuuaaguguauaaucagccaccuauagcuagcaucuacccuggagcccaccuuagagcuaacuuacuuuacaccaaacacaagauagagaaacaaguuaaguaacacuaaagggaagcaaacagacaaauccguacuauagaacagucuacaggacaacugacucaguuaaaaaaaaauucaauggcauaacaauauuggauuaaaacagcacuaaaacaaauaauaaccuaauauaagguguggaucuuuuuuggauccugauccaaccaagcaaugauaaaaagacauuuuaaaacagucaaagaacuugacuacugcauuaagaaauuccuauuaauuuugugaaauaugauaauggggccaggugcaguggcucaugccuguaaugagcacuuugagaggcugaggcggggggaucaccugaggccaggaguucaagacaagccugaccaacauggagaaaccccgucucuacuaaaaauacaaaucagccgggcgugguggcgcaugccuguaaucucagcuacucaggagguugaggcaggagaaucgcuugaaccugggaggcagaggcugcggugagccaagaucgcgccauugcacuccagccuaggcaacaagaacgaaacuccaucccaaaaaaaaaagagagaaagaaagaaaagaaagaaagaaaaagaaauaugauaauaauauugccaauuagggaauuuucguagucuuuaaagauacaugcugauguguguagagcuaagaaaauacuucuagcaauugccuuaaaauauuucagcaaaaacucaaguggauaaaugaagcaaguguggcaaaauccgaaugacauuugaaucugguugaagguaaacaggccauccuuuguauuguuuuuggugcuuuuucugaguaugucugaaacauuucaaaauuaauuuuaaaugggauaaugcauuggguacagugaccaacacauaguaaacauucaguaaauguuaauuagcaaguauuagcaucaucaacauuaucauuuauguucucaaaagucaaaacuaagaucaaucaguaaaaaauacaaagagguagcuuucagcuucaucuaagaacaggcucugggaagaugaaaauacaccgucucgugagggaguagccaacagcauauucaagauaacaauaacagcagugacuuacaugauugaguacuuauaauggggcagaugugguucuaagcacuuuccauauaaccccucacucaaucuucacaacaauuucauaagguagguacucuaacugucccugcuggagcagagauugaucacuuggugaggaugcugcagaagagggucaaggugaauggcuuugcuaguugcccuuuaacaucccugauaacccugaacuccucugauucaaugaacaugucauucagaugaauugugcagguuggccagcuggcuggcucacacacacauacagggcaauucuugcuuuuacuuacugaaaggucuuuaaacaccaccuuucccuuucaaguaggagacuaaaacgucacaggaauuuaauuaucuguaggcaagaagaugauaugaucaagaaaaugcuacauuuaaacuacuccauuuacccacuuucaaauuucccaucaauuagaggggaacaucuucccuaggcagccauuugaccaagaaauguccgugguauaucuucgucaacauguuucagaauauaaauccagauuacacaaacuaaaguugguauaaaggcugucaucauauauuauaucauuuggaaagaaauauuggugaccuuauccaguaugacuguuauaaugguaauaaaauugaaucuuugaagauuacacuucuggucaaaguaguaaaaugugaccuuauucuauucaacauugacauuuauuauauuaauuuacauguaaaaaacugcauuagaaugauauuaaagcccugguuagaaauguuagaaaugggaauguucaagaacuucagaaauaagauuucacuuuaccagccauucacagcauugaguuuguuugaugcaaauuaaacuaaauuuccuucaccaaucucugauucgguucuaauuuuauuauuaucacuaucucauucauacaggagauauuuuucccaaugccucuuuaaacauuuuauaaaccuuaacucauuuucaucaugcucuggauaaaaagauaacacagagcacugaauauauaaaccugagucagaggaucaagccaucugcuuaugacggggagagucuccucagcccaguaaaaaugagcuuagcgaugaguauacaucagauagugcacuagguccuagaaggauaccaagguccagaggugagaaaagagagucagaccgccacguggguuucacagaauggccaccaugcagcaaaaagaucgcucuuguugcccaggcuggagugcaauggcacagucucugcucacugcaaccccugccuccuggguucaagcaauuuuccugccucagccucccgaguagcugggauuacaggugccugccaccaugcccagcuaauuuuuuguauuuuuaguagagaagagguuucaccuuguuggccaggcuagucucgaacuccuugccuuggccucccaaaguguugggauuacaggcgugagccaccacacccagccaaaaacauuuuuuuauacuggucaaaauuuuauagggaggucccucccuuaaauauaaguuuugcaaacuuucaguuuggggguagaacauggaaucaugcaaugaauuaaggacaagauucagccacaccucaacagauuauucuauuuucaccauuagcccaaaguccaggcuugcuaggaugggucccaacuguccuuccaauuuuguuucucacuauucucgccagcacuucaagguuccaaccaaaauuaacuuuuugcuauguauuuccucauaugccuuaguuaauauugucuucuacucugaauaucuuuugacuuucuaucaauagguuaagcuagguguugcuaugauaacaagcagucccagcauuucagaagcuuguaacaaaaaagguuuacuucuugccugcuauuuguccauggugggccagcagaucagcucugcccaucucuggcacucugauauccaggcuaagagagcaaaaaccagcucaaauacuguuaggaaccaucccaaggggaagagaaaacugcagggucuuacaccagaaguuaggugcuuaguccaaagugacacaauucacugccauaacuagucaugugguuccaccaaaccacaagaagcauaaugcuaccauacaccuggaagaaagaagaacuaaaaauauuuggucaauaccaucaaugacucccuaucuccaugugucccaaaucugauaauuuuuccagaucuaaguuagauuccaccuccuccuaaaagaaaaccacaguccuuccugcuaaaaggaaaccguucauaugguuaauauacagagcauguuauuuuaccucauaagacucucaugacucucugagaaccgugucucuauuggaauuccguguuucccauaaugccuugcuagauaaauacugcuugaaugauugaacaaggcugucuguauaaugagaguuucaucuccaaagacuucgaauacccuggaggcuaguaauacgugguaagcaauaaaacuuuauuuuuucuuauuuauaucauaaagauacuuaaaacaauauuaaaaugaucauaaagaugaaauaaaaaugagcccauagucccgccacccuaaaccaacaaauguuuucauuucuuuuccuccugguccuauucaaagggcauccauuuccuuuacauagcuguauucagggugcauacaaagagagaauucuaaauagaacagaaguaacugcccagucaacagguuuuguuuguuuguuuguuuguuuuugcucuuccccaagauagagacacauugggccauauccuaauacugagacuuauuuucugcaauaaaauuuccguuaauuuaaagcuucuaagcuguuuaauacagucaccaucauuaggaaauaucaguguagucuucaccacuacuuccucuccuuggcucaacacuggaagaaauugccucuagugaaaggagauugacuuccaacaugagaagaaggaagaaaaggagaagugugugcuaaaucuuggacaguucuggggaacaucguagaccaacgucaccuugucacgguccgacguuaagacaucauuaacaagagcuaacaaccaacauugaaguuuuaaccucauucgugaauuuaucugauuauuauuuugcuccauuuagcucauccaauucuuuucauuuuaucaugcacucuuuuuauuuguguagucugaguugaaccuuuucuaaaacaagguagaaaauacauacauaaugcuucaaaaaaauguuuuccauacugccaaauaggcacuaggaagucucaccagaguugauaaacaaucuagauggccauuuaacccacucagcuuacuuaaaaccaagucuuucuuuuuuuuuuuuuuuugagacggagucuugcucugucgcccgagugcaguggcgaaaucuuggcucacugcaaccuccgccucccagguucaagcaauucucaugcuucagccuccugaguagcugggacuacaggcacgcaccaccgcacuggcuaauuuuuguauuuuuaguagagacaggguuucaccaugauggccagccuggucucgaacuccuaaccucaggugauccgcccgacuuggccucucaaagugcugggauuacaggcaugagccacugcacccggccuaaaaccaaguaagucuuaaaauuuguacucagaacuacuuuuuuuuuuugagauggagucuugcucugucacccaggcuggagugcagugacaugaucucggcucacugcaaccucugccucccggguucaagcaauucucccgccucagccucccaaguagcugggacuacaggugcauacugccaugcccggcuaauuuuuuguauuuuaguagagacaggguuucauuguauugcccaggcuggucuugaacuccugagcucaggcaaucugcccgccucggccucccaaaguguugggauuacaggugugaggcacuguaccuugccucagagcuacuucuauacugagaauaaauaaacacccaaacaccuuucaauguuauuaaauuucagaguaaugacuuuuugucuauuuucuauuuuaauagcugauagauuaguagguuuucaagcuauauuuuaaaauuuuauguucaguuuccuaaccacugccacauguacacauaauuuauacucuuacauuuuugaaaggguuuauuauuuuaugugcuauaguuauugaucugaaucaaaucuuucuuacuugauucaacagacuauagugggaauaaaaugugacuauuuacgaauguuaaccacugcuguaauucauaugaaaucugccaagccuauuauauuaggaauaauguuauauauuuuaucuaagagucugauaacaccuaccucaagucuaaauauucucugaaaaauuugucagaauaaaacaagugcccuuaaauaauauuuucagguauaacugcagacaguugcuuguacguuugucuuuaacuuuaauacugucucaauaugcaugaaacgcuugauaguucaauaguuguuuucaugaguugugccuucauuaagguacaaaacauuaaacaccuggaaugcugcucgaacuauuccuaagggagaaauuuuggugacaaaugaaagggauacauuuuuaagcugaaaaaguugcucgcuacugauaaaagaauuuauaucagaauauuccaauagagcagaagaaagcaacaugaaaagaaaauuaacauucauuaagaaacagcuaccauggugcgaaacaaagaucacaaagccaaaacugaacaacaaucaaauuucuacacaaaaaauaagacacauacaaugccuacaguuccgauugucuaaugcuguguaacaaacuacccuaaaacuaagugacuuaaauaacggucauuauguacugccucuuaugguuucuggaggggguggucaggaauuuuggaucaucucagucagaaggucuggcucugaacuuucaugacacuccagucauaccguggcugagacuagggccaucucaguggcuucuauauguaugccugaaaccuaagcuaggauuugaauaguuaggggcaucccucucuggcuccuuaagguguuuccaugugcucucucccauacgguggcuucaagguagccagacuuaucauauauugccuugagguucccaagacauauaucucaagcuagaaagaaaaccaagaaaagccaaaguuccuuuaaggaccuagucuuaaaacucauuuggccuuacuucucccaucaucugagcagcuccacuuuuaucuguuucauacauggggcuuuggcauaagagcauguugaccaaaggcugucaaaguaaccaaacauaaaaaguuuaaaagcuaguggcugggaugaagucuaaugccccaaacuucaacaaagcuaggugauggaaaaauacugcugaggggaaggcugcuuaggugaugggcaagagaguccuuggagaaugcagauaaucaaaacagcaccuaauuaagguacagauaauugagagcuggauuaucacuaagauuguauguauaaagaugcacuaaauaucuuauuuucaauuucucuuauuuuucuauacuguuauaauagaaauaauguaauaacagcaaaagcaaaaaauaguccuauaaaguguucacauggugaauucaauacuuucacacugggaagaugaugguggaagauaguaucucaggcagugcaguccaauggaagaucuuagaaccaaauguauugaguugaaaacauuaaugcugucauuucugagccaucuuaacuuuggcaaaguaauuaaccugucagagucuaaauguccucaucugugaaauggaagaaauuaugaguucacaaauuuacacugaagagucacugauccaccauucuuuaauucagucauaaaauauuuauggagagccaaauauaugccagguaugauaugguauggaaauacaauaaugagccaaaugccuacaauaaucaaucaccaaacaaauguuuaucuuaagaugacacccauaaacauguccaacaaagauagugucaaaaaauugaugucaccuaaugaauaauuuccuucuuucuuuuuauuuauuuauuuauuuuuuugagacagagucuugcucugucuccaggcuggaguacaaugaugugaucucggcucacugcaaccuccgccucccaggcucaagcaauucuccugcuucagccucccgaguagcugggauuacaggcauguaccaccaugcccagcuaauuuuucuauuuuuaguagagacgggguuucaccauguuggucaggauggucucgaucucuugaccuggugauccacccaccucggccucccaaagugcugggauuacaggcaugagccaccgcgccuggccuuuccuucuuucuugaccuuccuuucuucauaccauaacucagugauaauuaguagggggugaaacagagccauaauacauucauuugugaaucuccccuguccuccucacacuuaccuuuucucuauucccuucucccaagccugguucuggcucucucaugcuucagaaucugugaaauugguucggagggcuucaagagaacugcggaggcuaagccuguaucauaaagauuuaggacuaggggagaggaagcgaacacaaagaaaaguuggaccauguaagaacuagaaggagagacuggggagcugguccuggagugacuccagggcaccaacauguaggggagaaauacugcugaggggaaugacaugauuucuguuucuuugagagauucaagacuggauuuccuuuuaauuaacaugggguggcugaucuauacuucuugaaggcaacucuagguggggguaaaccaccuggggccucaagauuuauuaggaccucacaauagcaaaccuguugcuccccuaaaagcuagaaagggggguuuacaaaggagauaaaccacaggugucagauauguauccaaaacaucucucugaaggacuuuucucaauaaaaaaaagcuacugaugcauuuaaaauuaaguaauaaaacaagaaguaccugugcaugaaauauuuuuacaucucccaccuccaacccugaagccauccuauuagcaaccuacccuaugauccugacaugacccgacagaaggagacuugcagauccaacugcuccucagacucucacuugcacagggggcauuuucaacauguccagggagcauuugcugccuugauaaugaccuuugaggagaggaaaccaacucagaaguaccuucauccuccuuuuaguuugucuuuuauguuuuuuucuugagccaaugacuucuuucagacagcaauaauuuacacuucaggaaaaugucaaaguauagcaaugcccugaauaauaauuaccgccaagguuggaaugaagccuuucgaagaaaugcuaaguuaauuagccacacacuuguuuaccauuaggccaguggagaaaacaaggagcacaggaucagaacaugccugcaacauauggucuuuauuaauggcggcaucucaauuagucuaugggaccccacuucugucaacccagagaugaucugaauaaagaaggagaagaaauguucacaaagcugucauggggagaagaugcuaccugagaccacucaggacacccacaaaagaaacuuggauuucuguuguuuucugucauaccuucauacaugaaauugccucuuuuaaucuuuccacaaugcauuuguuuugggacaaaggucaagagaagggcagauuaggaaauaaggagguuuacccauuauuaccaaaaaucuauuuaaaaaaucauguuuccaugaauaucucaauuuaucccuucuaauucuuauucucauuucugaaauauauacuuuguuuagcuuuuuggaaaaauccacauuuuaaagaaguauacaauaaaaaaauaauacuccuuauuuacaugcuucugcaaucauggccgccuuuccacagaacacucucagacgaaggcccuuuugugccggccuacuuagauguuaccaaagguguacaaaaacgcaucucuugcagauggcuggaagauagcucugagcucuuuguguucaaucaaucccccaggaaaaggcauuagaaauuuauuagaagcagcucccuguucuccucaguuucugagcuuggaaaaagcacacuacacugaaaaagcauuuugaauggaaaauguaaccugaaguaucuuacuuuuuucuuuccuccauaguccuaccaucgauauauccuuuguaggacucuauuaguuugcuaggacgagcauaacaaaauaccaaguaccacaaacuggcuggcuuagaaaagagacauguacgaucccacaguucugaggacaggggccuaaaccaaugggucaccaggguugguuccuucugaggacugugaaggaggauguguuccaggacucucuccuuggcuuguggauggcugucuucuugauggauuuccucacacugucuucccucuuugcuugucuguugcuaugucuaaauuucccuuucuuuaagaauacaagucauauugcacuagggcccaccccagugaccucaucuuaaccugauuaccucuguaaaggccgucuccagauacacucacauucagaggcacuagggauuaggacuucaacuuaucuuucuuugcaagggauacaauucaacccauaacagagaugaguaaaaaaaaaagauauuaauguucaaaaaauuaaguaaccaaacauaaaaacuuuaaaagcuaguggcugggauaaugucuaaugccccaaaguggaaagguaccauugucacauauuucaaagaggaaagguaccauugccaccuauuucccuggcuguuuguuaccuugaugaagugucuacuguggcaaggcauuaugcauggcacugggcaacagagggaaaaaaacauggagccucuaugcucaugaauuuacccucuccuuuuaugccagccuuuucaaccugggggaaaguggacuggcuagaguacuaaucaagcugugaaggacuuugggcuucuacuucauucucccuugcauugacagcuggacaguuaaaagcagcaacaccaacagcugcacagcacccaacucaucaacccacaacaacggugacaucaccuaaguuagcauggaaguggccagucugcuuuugccaauucuuugggacauuaaacccaugauaauacuuuuaauauaauucugugugaaccaauaaugaugacaaacuauucuucuugccugguuggagauaauaaguaacaauaccuccuauuuucuacgaacuguacuuuuuuucuagcaccgugccaggcacuuaccaugauaauuuuaugccauuuucacaaggugagacugauauuacuagcuccauuuuacagauggagagauuacaugucuugcuaaagcuaccagcuaauacagaguaaagguuaaaucugaaaucaaggugucuagaaaaucaaccccaugcucuugagccuuacacaauagugucucuuucaaccuuuugaaccugagcacuuaugacaacugcccaguauauguguacacauauucugugcauguuauagauagacagauagauagauagauaaaauaucuauuuucuccccccaaaaucuaugacuaaugcaauaaaccucccacugauuagacaguuauggcuuuuucucacaucuccaucagugacauaacauauuaagcaaaaaaguccgacccagcugauuaguauuugaugugcugaagagccuaauguuucuuuauaugaaacaucagacaguggcagccuacuuaauuacuagguugacuuuaugucuucaaaauaauaaaacagaauaauccaaacgacaggccaacguggugagugauauuugaacaucuacucgacccuaaaacuguuaaagcaaaaguacuuauccaaaauccaauacuuuccauuuuucuuuuaaauguuguaagucaaaaccagcuaaauugauuuuuugccuuugacuucugcugaaaaguucauuccuaagcagauuacauguguggcuuugcagcucagaggaaauuuuacagccaaguaaaacccuaaaaucaggaaaacauggguuugcugaauacaguagaaagacgugacagaucuuaauuauaaaagaacaaauauaucuugauagaugaacugucuuuugugaauuaagacucaaaaguuuuaacuccuugauuaaccguuacccauuaguaauauagaaaguugugaggcaacgucuucaaacuucuaaguagaacagagcacucccaaagcaugcagaacccccuguaacaucacucaacgcauuuucagcaugagugcccaggguaagccuuccucacaauguugcaaagcaaaucgugucccucauucccuuuucuacucccagcacuccuugguuaaguguuuuaacaggguaagugaugacgguacaggaagagaagaaggaagaggaggagaaagaacaacaaugauaucaugguaaaggccuguagaaauugaucuaccagacaaaacucaagagcucauaugauacaggauuuugcuugcacauggucacaauuaaauaaaugaugaaaaugagacucaaauauagauuguauaccucauuccacuguuacaagcuuucuucuaaaugaggaaucaucaaaaccaaacagaagugucuaucuuaggucaccuuacccucuuuucugauuguugaaauuaaggcagugcaagaaaccuggggagacacuggaaaguguccccaugccaagcccugugagcacaaugagcucaugaaagaaaagcccagagccaacaacuaauaaucgugcuuaaaacucaucauuuaagaauuucaaaauaaacacugaucaauugaaguuauuuugacccaaagucuuacguaccuucuuuugcuuguccauauuggccaucauaaaaaacagcaaaaaaaagaaagaaagaaacaaagauggggaguuguugcuuaauggguauacaguuucaguuucguaagaugagugaguucugaagaucuguugcacaguaaugugaguauguuuaacacuacagaacuguacacuuaaaaugguuaaaaugauguauuauuccauuaacuuaaaaugguuaaaaugauguauuauucucagguaugauaaagacauaccugagacugggcaauuuacaaaagaaagagguuuaauggacuuacaguuccacauggcuggggaggccucacaaucauggcagaagacaaggaggagcaagucacuucuuacauggauggcagcaggcaaagagagaguuugugcagggaaacucccccuuacaaaaccaucagaucuuaugagacucacccaccaucaugagaacagcuugggaaagaccugcccccaugauucaauuaccucccacuguaucccucccacaacacgugagauuuggguggggacacagccaaacaauaucaaaugauaaauuuuauguuuuuuuaauggaaaauaaaauuuaaaagaaggaaaaagaauucucuccccuucccucucucccuaccucccuaccuugcuuucuccccuccagggaagacaugugccuccaggauggaaacaaauggauugaucuggaaaauacuuaggaggcagaacugaaaaaauuugaaugugaggaugagaaacagggagaucaugggugauuuccaagucucuggaucaacugaaauggagaauggauaaggaggaacaccuggaggagagcacgcuuggaaaggcauggugaguuucaucuaacuagagaucaccagcaggagucugcccuguccaucuggagcccaggaaggaggguuaggguggagauucuguacauuucuacagccaacucuaauuuuugguuacaaucaaagccuaugcccuucuaaaaccuuuuucuuccaucacuaaugaucagcuguguuuccagaaguaugaauggauuuauccuauauuucugccuaauauuucauauaugaauacuucuaggcaggcauugggucauauguguaaaacgaaagcaaguacuuaacacaauagaccauucaauaaagcugcuuuucacaugcuucauuuacuacuuuccauugccuuuuucgcaagcaauuaccaucucacacaugcccaguuucaccauucugcagaaccaaauguugaauuuaggcaaacauaggguguucaauaaacagguggauuuugaacagaacaccaaugaauucaggaagcacggucaaccagcugcgucugucaauggaauaaucaguagcuggcugcaucugugcuggcugggcugccaucgguguuuacaagcuggaauugaagagggcucggccagcugacagcagaaguuugcgcagcaccugucuaaaguauauaugacugccuccaggcaaucccauuaguucuccacuuucauggacacuaggacuuguucacaaauuuagggggaaaaauaaaaaagacaaacagagcuagccucugacugagaaaggacaccugaaagagaaacaaucccauauggagaaacagaacaagggggugagaaugagaaagacaagaaaucacucaagaaagccaguaauguuuacagauaguagaaaaauuuugucuguaaacagugggcuugguagcauuuuuuuaaaucagagauguucuggagaaauauguaaagaacucagcccaagcuuucugaugccaggcagggcauaaguaguuuacauggaaccuucugacuuguuuaucugacauaguaaacagcuuucucugaucccacugucccuuuuacgcauuacaagauaacaaaaaguuaugcgauuuuaggaaaucaaguauauaaacagggcuauucucagcacauccacugaauauuaagugcccacuuuuaucugcuagaacuugaugugugaagguaaccaacuuaaaugcacugaagagauugcauucacacagugaauagugacauuuugcuaggaauuuguuaaauuuuauaaugcaagcauacugccguaauguuccacaaaacguaacagucggugcacagcaauacugcccucugguuugugagggcuauuuccauccucaauucauucuagcaggaaaaagaaauuaaagauaugauagaaugcuauccacauuguuauaaugcugguucuuucugagguuaguggucacacacagugcuauagaggcgguuguucuuucuugugccuguaacugcugagguuaaucucucagugcuuccaaaugcauauggacauuuacacauauggacacugaccaauccuaaaagaaaacucaggauaaaucauguucaacuucaaaaguccagcagcuaauucaaagccaugcucuuguagaaggagccauugaaaacaacagagaaaccagacaacagucuuuaacgucuuaucuuuguuuaugauucuuaagaccacaccuggcgugaaccgauaugcuaggucacccugguuccucaggugcauuaggcauaugugagcagugaaacuaugacaaccagaaugcaacauccaauuauaaugauuagaauaacaacaaacacuuaggcaauaauuauuuccauucauucacuucaucuccccaauaacucuacgagguaaguacaauuauuauuccccacuucauggaccacucagugccauacuaagagucccagagccaguaacgagcagacuagauuuaagaucaaccccaucugacuuagggguucugcucuuacuguuguucuguaccuaaagcuaucugauguauuuuaaaauguagguguaucaguuuggugggguugccauaaccgugaguuggguggcuuaaacagcagaaauuuuucuuacaguucuagaaacugaaaguccaagaucaaggcaugggcagguuugguuucuccugaggccucucucuccccuuggcuugcagauggucuucaccgugugugcaccuuccugguaugccuuuguguguccuaaucuccuccacguauaagaacaucagccagaccagauugggacccaccguaaugguuucauuuuaaguucucucuuucuuuguuuucuucuuuugagacagagucucacucugcuguccaggcuggagugcaguggcgugaucucagaucacugcaccuucugccuccuggguucaagcuauucuccugccucagccucccgaguagcugggacuacggacaugugccaccacgcuucccuaauuuuuuguauuuuuaguagagaugggguuucacuauguuagccaggaugggcucgaucuccugaccucgugauccaccugccucggccucccagagugcugggauuacaggcgugagucucuacgaccggccuuaaguucucuuuucaaaggccuuagcuacaaaugcggucacauucugagguacuguggguuagggcuucggugugaauuuuuggggaaaccacaacgcaccccauaacagcagguguguuaacguucuacaaaacgcaacggugggugaauuguaggacuucccucugcuuuaugagggcuuaauuguauagggccuuauuuuggaucuuuccacauucaacaaguucugagaaugugauacuuggaaaccauguucaucagaagagugaaaggcuuucagguaaacguccuuugaucuuuuucaccgugaugcccuccgaugacauuaacugugguaguaaccagcaucauucaguugcuguuuuagaaggaacuuaaaaauggaagauuugaaaacaugauugugaaaccauaauuuugcacugaguccaguauuaacaguuuuucaacagaguuaacucuugcugcuuuuuguuuuaacccugagugucuagaacugaguugggcaagcuccuuaacccacagcacaccagcagccuagaacucuccaagaugucacuuggauuuuccuucugaccugccuuuccugaucccuugcuaccucacccuauagacauaggcuuacuuuucccuaauauuuuccuguacuuuaacgcauagcuguguuuuuaugaaaaauaaaauacugggguuuuaugcucaacuuauuuaaaugauauuucacuacaaauuauguucuucuucuauuuguuuacaucauuaugcuuuugaaaaccaccagaauauguauguguaccucuggaucuaagcuguuaaacauaguagccacuagccacaugcagcuaccgggcauuugaaauacggcucaugcaaguggaaaacuaaauuuguaauuuuaauuuaucuuuaauuuaaauuugaaaaccuguaucuuaauuaugagaauacuuuuaaauauuuuuggaauaucuugaugaaucuucuuuuuucaguuguacauuuuauaaaacuuaaauaugaaucaaucaguuccaaugaaaauuuagccucugauuuaagauguacuauaaaauacacaucagauacugaaaauaguacaaaauaggaauguaaaacauaucaguaaguuuuauguugaugauauacugaaauacuacuuuacauauauuaaauaaaauacagcauuaacaugaucaccuaauucuuuaaauuuaaaaaaguaaaaauaaauuuucuugguacuuuuuuguguggcuacuaaaaaucuuuaaauuacacaugugguucacauuauacuucuaccagacaggggugaucuagguuuuaauuccucuaacuacuacaaguauucuauaauaagcauaaauaauaauuuuacuucauucucuuaucagcaggcaaauagauuguuucuaauucuuuaccauaucaaacaacccuccaaauuccuguuuuuaugcauccucacuaauacuuauuaugaucuuucuuguugcuuuuggucaacuuggugguuauagagcaguguuucuuauuuaaauauucaugucucagaauacugaaaguguacauauuagccauucaaaguuccccuuucguaaacugcccauuuauaucuuugcuuauuaaaaauuuugaauucacaucuuuuauuuaccaauuaguagaaguaaaaagauauauucccaguauaaaucucuuguccacuguuagacguaauuuuucagcuauuauacguaucuccaauauuuucuuagcuuguacuuuguucauuuuucccauaguuuauuucauugaacacaaaucuuuaauuauaauuaaauuccuuaaauuuuaccuuuauuauuucaagaaauucuacccuaguaagaaauugugaagaaauuucaucuuuucuacucuugguuuauaguuucgccuuccauauuuggaucuucaguccaucaugaagcccuauagcacuuagagcagcagaugguugccaacauccuaggcuuagguacuugccauuugagaaucugaacaaaacugaagacuuucuuacugaaagaauguaugugcauaaaauacuauauauauaauuucaggcuguucccagaccucuacugcaagcccuuucauguauccuuaugcaguccacagaauccaggcgcaggauccccgagucucacagauucuacucucuauucaaaaacuucauuguauuuuucauggcuuugcucaccaucuuuuucuggguuaucucauauucucaacuaguuuaugagcuccuuacggacagagaccuagauccaggcaucuccaagauuuuucauggcaccugagagcugggagugcucaauaaauacgccccuuagcaagugauauuccagaaaucagacucagagaagagaaugugguguaaggcccaggggauuacucuaaagaggccuccauuaauucaugcauucaaucaacagucauugagcuuguccacuguuucagguccugggcuacauggaagauaaucaagggaaaggccacaguuuguguccucagaggguuccuauucuagaggggacagcaaaggagaaguaauuauaacacggggcaucaaugcucugcuaaaguaaggaaguagggagcuucuggucugcauaacaggaggguaccuaauggggccuuugagguaggggaagguugggccucucagcaggagucauguuuaggcggagacucacaaaaaugcauaguguuaaaaaaauuaaauuuagccugaggcugucuccguaauuugagucccuaccuaaggaacugcagccuaaccuaacuuagucuauuaaacacaccgaaagccuaauuuaggaugcuuuuuuuuuuuuuuuuuguaacagcagcugagcuucagccaaucacaggcugccaacugaucagaccaugaccaaauaaggugaacaccuagacauaacuuaaggaggaggcaggauuugacugaggaggcagggcucggacaccagaucaaaucaaagacuaccuagaacagggacagaguggaaguacauuuccguaagauaugcccaccacuggugccaugccacuuuaucucuccagcacuuaauagauucuaccugaaccccucacccucaacugcuauuaacugaaccuggaaaucugaguaucuauaucuguagugcauuaaugauucuauauuuugcacccacuguguauuaaugacacaaaaguggagguuucccuucaaugcuuugauccaacucuaagcugccaaguccccaaggcuguaacaguguauacaggauucuacuugugagcaaggaaacaaaccauauauggugacuucucucagauaacaacauacaggaaaaaaauaaaacaaacaaacaaaacaacugccuaaucugggaagguaggaguacugacccacucugugaaacaaagauugguuggguaucuccauuggaacagggcaagaauaucucuacagacccaauuuggcagcaauggauagauaucagauguuguggagccucuauuugcaccccaacuggacuaauuuuuguuuguggccauuaauggggaaaagucauaccccauauucacucuugacuaccccaugagccacuuguuuuuaggaguggcuuucccuuguauauaaaaaacuuggaacagaggugaauguaggauggccacucuugcuucucuaggggucacagucuauaaucccauaagaaccaagaacaccagaaauaaacaagcaacagcauuaauucuagcaggaaucagagcagcaauagaacgaguggcauccuggggcagcuuugccuaucacgaguacacccugaaaaacuagacucaaacucuagaaucccuagccaccaacacaggucauguacuaaagggaauccuagaguccuuagaaucuuuggcaaauguacuucuugguaacucauucugagggcugcccgauuaguugacugcucuuuggucaaacucuguuaaauuaaacuugucuacaguuuuucuuuuaccaguaggcagcucaucugaaaacaguaggagggaaaagagggaauccuagaaaucgaucugucauaaacauugugaacuggcuagagugcuccugccuuuuccugggaaucagaaaguagcagccagacaggaaaccaaaccaccugaucuuuuacaaacaggaaucagaucacuguacugccacauuuaaagccaccaggggcaucccaucuaggaugggaugggaaaaaguaugucuaaaauauauauacauaguguauauaaauauauauuauauauaauauaaauaguauauaaaauauauaaguauauauuacacauauaauuuuuucuuaguauaaguaugucccgcguaauauuugcaauguaacuuacacuaacaaaguauguguuauuuaucagaaagucaaauuuauggcaguuaaaccugccagcccaaagcacuuaaaauauaaaauuacacuuaaaauagagucuucaguauuauauuuucucuggcuuucaucuuagugugagcucugcauuguuccccaugcuucaggcaugcugaccagugagaaugagaauaagaaugccaagcuccaucccaucuuagcaccuuggcuucuguaucuucuuuccauuuagaauguguuuucccucuuucuuagcgugguugguuucuucucuucuuucaaauaccaguuuagaugucaccuccauagagaggccuucccuaaccacaccaccuaaaguaggcuaucccaauuauuuucucucuagauacauauauauaugucaguccauaaacauuuuauucuuucacuucuaaacuguugcccucaccauuaugucagagacuucugccuuuugcaucuuugugucccuagcccuuagcaaaaugucugucacauacgagauacucaacaaauuuuuaucauauaauggaaaucuuaaguuaguauuuucucuggugcuuccaagacaugcauuuugccuagacauguuauuguucgucaugugaacuggcuauggcaaaacacauugccuucagagagaaagagccacacaaguuggaaaggaaaggucacaaggaugaaagaacucuaucaacauuaaugccuuauaaaaaaaucucuuaagagauaccaaaagauggaaagaaauugagucuaucauuugaagacaucccccacccccgcuuuuuugcuuuccugcaagucauaucugagucauaccuaaggcacuuuggcugugccuccuugugguccucuccauuucuuacuacuucaucucaucacuuuaccaccuucaaagaguccuuuccucauauaaccucacaugauguucacaggauuaaaaaacuccaaacguucaauagagaaacaacauuuucuuaaaaauauacagacagacauaugcgaauucuuucaacaugcuuauaaaucuauccacaacccuacucagaguaugcuucaaauguaaaucagaagccauauauauuguauucuuccaagugauuacucuggaaaagaaaaaucacacauauuuauugagaggagaacaaauuuaauaauuuugcucaaucaucaaaaacauuucuaaauaugagcuaugauaggaaaaaaaucaguuuaacuuuacauaugaauuauuuuccuguuuuaaucauagaauuuuuuaaaguuuuggauuagauucaaauuucuucagagaacuaaaugauaaguuugcaaacaauuacuggaaagaaauaaggacaggugagagcaaaagaaagaaaaacgguuacagaguguaaaacuauuuucaagcacaaaguuaaaaacuucuaauacagaaccuggaaaacacuuuaugugugugagauaaaugaaagcguugaggucagauuagaaaaacaaaacaaaacaaaacauagcuucuacugacaaauguaaaugcacccugugauccuguugccaaugaaguggcauugcucugauguaccacucccaucccaacccaagcacacacuugucaaugagcaccaggguuuucaaauuauccagaacucuaucauaaugauggagcuaggaaguucuuucagccucuuaacagcagcgcauuauuuucccuauagauaauacugagaacauggcaacacuucugccugaucugcuuauuaauaauacccaacacagcauuuauuagauagagaacuacuagauguuaggugcuggguuaagcacaggaaaagaaucaacaaauucuacaucauuuucuuuguuguguuggugguggugguuacuguuguuuauaccuucagaucucuuucuacacuaaauuuuuggguagaaauguuuaaauaucauccuuagccuccgcaauaauaauagcauuucaucacuaucacuggugagaaauuuguguuuuauuuuuguuuacauuuuacauuaagaaauuaaugaagugggaauggcuaccuuugcuguauacuccaaacucccacugaucuguguguggguugcguguuugucuagagaggacaguugcccaacacaggaaaaaaaauacccugucauuauaugauuuuucacagaacuaaaaagaaauaaacuacccccauuccaaagcguggccuccuaucuuuuugcuacaccucauauacuuuucucacauggcaagaaggguacccuugacugcucagugccucucccuccucuugaugcugagaugcuccaaaacaccacugggguucuucaggagggauuucauugucaacuccagcuugcaguacagggaagugacaucuagagugggccucuuuuugucacuuuccccauacuaccacacacauaaaaaugccugucaaacacuguccuacauacauggaugagaaaaagaaauaagcacucuacuaugaaagacucuaacuagaaaaagcaaggagaugccaacugacaaauguauggugauggacuuucuuuuuuuuuuuuuuuccaauucucagauuuauuucugaggcucucagccaauuucugugucauaaagauggugcaguucagagcuuaauugcuuuagcacuugcaccaagaaaaacuguauugcaaacaaugaagaaagaagagaggaaaccaacauuuucuaggcacuggccacguggcaaccaguguacaaggcauuuagagaaagcuuuuugauuccauucaauccuggaaaccaacauguugaagggccagauuuuucaccauuuuauagggaugcaaacuuuagcucagagagguuaaaugacuugccaacagucacacaacuagcacuuagaggaacgggaaggcuaacucggagcugaugcugcagcuuacacucacuccccacucccacgcaacacaaacucuuucuaggcagcuucgaagguaccaaacaaguggcuccuaaggacucaguaaacauuccugucagcuggccaagaugaauauuuuggauaauguccagacacgugaaauaccagcuuuaaguuguggaagugcuucaggcacaaccaagucucauuuacguccuuuaaaaaauagucaugaccugcccccuucacacacugucauucuucuggaagguaucugagagcacagcucugcaaaugccaagagcauuaugcaguuuccauacauagggcuuccugagucagguuuggcagggcagggguucaguguacaauauuucugccuuauuucuuuaaguuucucuuggcuacagcucuuaagagacacacagagggaauggauucuguagaagauuucucccagaaauuuugguguagauuagaaagcuugguuugcuucugguucuauuacuugagauuuauuuggaacuaaaagguuuucugccugagaguaaccauuuaauauauuggggaggggggaagaauaaaaugcuccuuuuguuuugcuauuugcaccacccugucccgauucuauuguuugcaguaaguuuuguaagagaaacucuucugcacuccuuauuguguuacaaguuuagauguacccaaaccaucagcaguuagauuccaaguauacgcuuuugauugauucaagugcauuacccgggagggugugugcuuugcucuguuguucuuccagccaacucccuugccagcugcugaaaugaugccaccaccggucuccaugucaugcagauuuuacacccugauaccaggaaagcagaagcauuucucaaaagacuuuuugcuggcuuggcaggaaaacagaaauugcuuuuuaucaaaaugaaaaagguuuucuucaugggaaacagcaaaagcaguuugaaagaggggccaauacuuuuauccuagauaagguguuuucagcagagcagacagaaaaacauguuuuccuuccuuucaugacaucaaucagauccccaaagccagcuaccuuuauucacagaacagauggagcgguaauggucccagaggccacucuuccuggucuggggaucuugccaucccugccugaaaguucucaaauccaagcucugggaacuugggaugcuuuuuucugccucucccacacuccaagaggaacacauccacuauuaugcaugucuucauucuuuguccuggguggaacuucugggggugggagaaugggugauaaagggggaagugggauucacuuugugaacaccuacuagaagccaagccagguacauccuaugcauuauuucauauaaaccuuaccacaaaacuuugagugguauuauuauguccauaugacagacgccaaagaaguagacuaggggaguuaaaugaaaucccaaaagucauauacuaauauguggaauacuaguaaaaucuggaaugugaacccugccuggucuguugcuucagagcuuugaugugccaccaacaaacacuuccaugccucucugcuuagaggcccaguuuaaaaugcuauccucuggauaaauaugugguagguccauacaauggaauauuacucagccaugaaaaugaaauucugacacguuacaacaugaaugaaccuugaaaacauaagcuaagugaaauaagccagucacaaaggaugauauugugauucugaaaccaacccaauaaucccauagauaguuuuuuggauagacguagaaauugaccuuuguggucuuaaugcuugaaguuuauauuuguuuuaacugaguuccuuccucaggaaaugaccuucaggccucucgaaaaaaaaaaaaaaguauuggcaaacugaaacucaccagaucaccacauuuugacaaugagaugcuggaccccucauucucaggauugcuuccuugccucucccuaguuccuguuuucuuauacauuauuacauuucuuccuggcuauauaaaccccugguuuuacauagucugguuuuggucagggaaauggauuugagacugaacucccuucuucuuggcaauacucaucaucucagugacugguuuucugcacggcaaacagcaggaccuagaccgaaccccuaguguuuugguaacaauuccacuucugugagguaccuagaauaggcaagcuuacagagacagaaaaguagaacacagauuaccaggggcugggggagggagaaaguaguccggggaauagggaguuauuguauaaugaguacagaguuguguuuuuuuuuuuuuuuuuuuuuuuuuuuugagacagagucucgcucugucaccaggcuggagugcaguggcucgacucgaucucggcucacugcaaucuccgccuccuggguucaagcaauucuccugccucagccuccugaguagcugggauuacaugcccagcuaauuuuuguauuuuuaguagagaugggguuucaccauguugggcaggauggucuggaucucuugaccucaugaucugcccgccucagccucccacacuguugggauuacaggcgugagccaccgugcugaccguguacagaguuucuauuugagaugacagaaacuucuggaguuggauagugugaugacugcacaacauugugaauguacucaguaccacugaaugacacaguuagaaaugguuaacaugcuaaauuuuauguuauguguaguuugccaucacacaaaaauguucccugcuuuucccuuugaaagaugccacaucugcccugauuccaaagcucuuucuuagaauugacucccacuagcuguaaagugacacaaaagaugaucuacuccaggcaugccaacucaaauccacugauagugacagcuagcaacacuguguuaagaaagauuaugaggauguuuucagggccaaaaaagauaaauaacaugaucgauuuguaaaaauccccucacaaugagacaucgaaauguuggauaaaauacaacaaaauauuaauuguucugggaaaugugaauugggaaacacagaccaaguggcaaaagcuugggcagagagucaugguauucagaggccaugauggucaaauacagguugaucuucuaaaaacauaggaaccgagugaguaagaaaaucaaggcaacuaaaacgaagaaaauguuacaguagguagguagucaggcgugauggggcaggagagggcccucccaacacccccaccaggaaagccacgcuaccaucaggugauggucaggugguuguuaacucucuuuaaaauaauaauuugucacagccagcaccagggaaagaccgucuuccuauauugauaggaaacaccuguaacugguaaucagcaguuuucaggaguugggcgagugagcacaagcaugcgcauuaagagacaaaauggcagaauaugguuuucuggggcauuccacuggaaaagggaagaaagccucaggugggcauacauacaacuucuuaaacacacucacaugcucaccucccacauguuagcaggccacacacauguggguggcccaccuuaagagaagaaccaugggaaaagggacacaaggcccagaaguacaacaacauauaaaacccacgucaaaaggucaaacguuacaugugaccuucacagugccugcuugggucucuuccagauauacuuuccuuucuuuccugugcuaaagcuuuuuaauaaacuuccacuccugcucuaaaacuugucucagucucuuuuccugccuuaugccccucagcugaauucuuucucaggaggcaagaacugagguugcugcaggcccauaucgauuagccgccaguaacccaaauauucauugcccccaacaaaaagagcagagguuuucugugccuacgagguucaugaaugagggcugccuagagcuccccccauucuuguugggucuccccuucuaguacaagacuccuuguagcuuugcaauaaguuuaccuuuuccuuauaaaacuuuacuagcuauucuucaaaucgacaaugguuugacuucaacaggucuucauggggugaucacaucaugugucauccauagaggguaauuugaacuuauaagcauuaaccgugcuccaugaguuguuguuuuuuguuuuguuuuguuuuccuuuugcuuugauaaacaacauacccagauacaugggggaaaaaugguagucauccaauuucuucauauugccagacucacagcaacaggaaagugacguuauuaacccuggggagccucuauaacuucuuaaaccauaaacaaaaauaaagaacauaauggaagguauaauugguguuaaaaaaaaaaacccaaauguuuucugaauuccauccucauguuacacacucaaaaaguuucucuguaaagaaagaaaaucuuugacucaagaaucaacuuucuagcuaucucaaaaccaaauuauaaugaauuuagaccguagaaucaauacugggggacuaacuaaggaucacuaaauccuguguuauugauugcuuggagaaaacuaucuuuuuaaauaugcaucacauaacaaaguucuuuauuucuaagaacuuucuccaaauccucccaucacaugguuuauguaaugauuaauccuuuguauuaacuacuuuaugugucagaaauauuaaaaugcauauuaacuguuccugggaaaugguucugcaguuucuccuaaaaguauacuaccuacuuugaauaaguuacaugaaaacuguggcacauuugggaagaaagcagcuuaguaggagaaaaaugagauuugcaauuauaagaacucaauacaugggugucuuaggcauuuccagauuuuaaaaaaguauaaugacuuuucucccccagugugauaccaaaaucaauggaaugguuuugguuuguuuucuacuggaguguaccaguuagauuuaaucacagagggaaaaaucuuguuuugauuucucuuauuaauuacuucuuggaaaaaugcacuguagcauucuuauucagaauuucaggaacaaaaacuuuucacuuuucaaacugcaaaugaaggugggguaaaugugugaaggagcuaagaucuagauauauuagaguuucuaucucugaauccaggaaggacuuuguuuauagugguggaaaucaagcaaggagcuauugguugguccacacaaugccuagguguuggcugucaugcuccauucagacccacaaucccaaugaaaccugucacuuucaagagugcaaauaauaggauggggaaagaguguuagaguaggacguuuucuaacaagagcccaguggauuccuaccuuucaucuaauaaauuucaaugguuuaagagagcagauccauaggugccacacagcgaaaggaccuguguaaaaaucacagugagacucuggaguaagagauggaaugugauggcccgaggcccugcccuccaaccuugaguccacaacauacgaccucuuuaaaaaacucccuccagaagcccuacaguuuccucucugguuugcgucuuacugcugaagagucuguuuguagagauggauaucugacuaagcuagcuuuccuuuuuuaugcucuuucccucaagaaccaaggguuuuucacauuccaaaauaaaaugcaaacugagagcauuuuguauuuuugcauuucgauucccuguuuugucagugaguaauuauagcaaauaaaauauugcagcugaauguaaauuguuaggcaaccagaucacagcaggauauuuuucuuccacaaguuuuacaucauagaguguuaaauauuaaaauauugcaagucaaguaaacagagaggguucuuugcucaaaacauuaauuuuaaacaaacauuucacuguuauucagaucggaugcuaggaaacaaaugacauuuucuuucaaauaaggugaauagaucauaugaaaggaaagcagacaagggaaucauacagaaggaagggcauuuaugacacgagagaugaauuucagccagaagaacaggagagaauucacauguaggagagaaagcaaaagaaagagaaauuggcaaaacaacauggaaaagagcaagaaaugagaaagacugacuuacugcuagaaggggaaaaaaugaagauacgucucaugucagaguacagagaccugacucaaaauaaggcagcuggggaagaaaugaaauucuuucuaacaucaugaauuucuguuuccuuagguuauuaccagaaagguagaaaggagaugaauuuucagaccuccaaaagaucaccaaucaauaaaauaccaaucaauaagcauugauugaguaccuaaugugugcucaacaaccaaguacaaaauuagacauggccuucuucugagguaccuuacuauggaguugagaugaggagaugcugaaacaaugaaugagaguggaaauguauucuaugcuguggagugaagaaaacacacagcucaggauucaaugauaaugacaaugagggugguugagaguaacugucguaacacucuuauuuucuaagcaccuccuacauuccaaguacugugcuggaugcuuaauauuuucauuuccaacauuuaaaacaauccauuaagaauuaucuccucuagugaagaaaauaaagcuucaaaacuuaaguugcuuguauuacacaaugaguaaaugguagggccugaauuuaaccccaggucucccaacccaaagaucacgaucuuucuucuacugaagugcuggauuuauccuaagaaggcauucuucuguuaauccuuacaccagaaugccagcuaauuaaaacagaaacaaaaacaaacagaaacgcuguuugagaaauguucuuuguaagggagaugaccuaacaugaauuuuuggaugaaauuauaauggauauggaggaguuuuguuuuuuugguuugagaaagaaucuucaggaaaacauauagaauuugcaggagagucauguucauuaaaccaucucagaguuaaagacuggagggaauagauguuaauagccauaaaggccuugcagaaaaaggcaaaccuucuuuuccaguaggagagaagaagugaaaagggauggaggaggagaagagucaacugaggagcaagaaauguuccacaaugagaccgcuucacaauaucucccaguucacaacuaaauuaaaauaaugccuggggagaagacuguuacagauacaugcaaacaaauugcacauccuguuaaguagggcaaaacagacacuuggacagagaaaccagaggaagacaaaauucacagagaagguggagagaacuuuaacuucucaugaacuguggaauugguaguuugaguacauuauaguuagaucuccauugagcaacaaggucccgacugacaucuggucuacaagaucaacuuucuggcaauacgguaaauuuuuugacaguuacuaaaugagacugaauauaagcaaaauaaaaaucaucuuguguuucaagaaacugauauacuccagauacaucaccauagcauauggagauuucuuuaacuagaaaaaauaguccauccaaauucacauugguugaggaagccagaacacugacuuauccauguuuaccacagcucaucugccuucccucccuuaauaaaagcagaggcccagagugacugccaaacaaaaucuaccuaaaaaacaugccauucaauuuuuuuagaaggccauugaaagauaagcaaauuaaauuaaaagaaaggaaugaagagauuuuccuucugucugguuguugagagagaacauuucuugcauauccagcauuuggcaaucucuuagcaaaauggcaaauucacaaacccuuuaacccagcaaaugcauugcuaagaauuugcccuacagauauacuuccaaauaguaugccagaauuugugcaagaauguccuuuguaguauugcccauaaaaacaaacaaaaaaauggagaagaaaacccauauaccauccauuggguuaaacgcguuuugauuuaucaauacaaaacaauauguacagcuauuaagaauaaugagguaggucugcucuucaagauauacuaugcuuugaaacaagcuaagugugaagaauguauauaauaugccauuuaaguaaagauuuuaaaggcuccgugucguuuuguuuagaugucaacaugugcauaauuucuuuuucugaaaagcuacagaagaaacuucacaaugguaauauuuggaggacaagaggccagcaugucagagaagagaaggaaaggaaaguuuucauuuuccucuuauaccuuuccuuccugccugaaguuauagguauggcuaauuugauuuaaaucaauaauauuaaugaaacauaaaaguaaaauaauuaccuaguaauaauaaaacuauguuguuuauaacucuuauuugauguuuggauucucagaauuuacuucacugaacuccgaaaugggugguauuuuugaaauuuuuagcugcaaugaaagaacacaguauaacugaugcaccccacccccaaccaaaccacccucauaccuuguccaccacugccaucucuaucuugcauuugaaaauaugcagagaagacucuguuuccaugcuacagacaguacuucuagaauuuugaccgcauaguaaacagucauuguaucauccacacccugaaugaugagggacagggacagacagaaccuaccuaccaugugagcagcucuagagcugucauagcuauagcugacucuagcucacaaagcagacaugaggaaaagcaaaguuugcaugugcacauacacacaacacaagcacacugagaaugaaggagaacaaugugagacuauacuggucaaagaguauuuaggaucugccaaauaauccaguuuuguuuguauuuucauuuacaucccuuucaccuuaaccauuuucacaguuaucaacucucuaauacacugacacaugcuguguuaggcacuucgcaaguauuaucucauuuacuucucauuuaaaaugccauugguuaauaucauaaucuucccauugcauaugaagaaauugacacuuaaagauauaacacuuacccuacucaaagucacacaucuacaucuagcaagugggagguggcauucaaacauaaacacagcuggccucaaaggcacuaugacucacuguauucauuccugauucaagucucaugccuugcccugagacuguucuuuaggacauaaauugggcaaagagcaaucaacucacaaaaagagaagaccuuccagaccaaaacuaggaaguuuggaaaaaugagaaucaugaaaauaugcguauuacacauacagccagguugaagaagacagaaagcauuagaauguggaggaaccuuaugagcuagaaugcuuaguacuuaaagaaaugucuuugggaucagccaugcuccugggaugaauccugaccuggccaugaucuaacugucaccuuaaccaugucaccgagaggcuuaaccugcacuuacuucuuucaucuguaaaauggauggcauaauagugccugcuucacagaggcauggugaggguugaauaagaucaugcacauuaaguaccuaggacccaguaacucucuguaauuaugcuguguuugagaucauaaagcucuuaaucauuauaaaaguaccugagaaauucuggaaugcuauaacaggaaaacuucugaaaauauagacuaccccuaggcaagcccuuuguuuuacacagcaagaaagugagaccuaaucaguuagaggcaagaugcuucucaagucagucuauugaguuuuuauuuugcacugaauuacacaucuacagagcuuccuguagcaggaaacucugcucaguuugcccauugcucauuccuaacaccuuuuucuccugccuguucccaucccauggccaacuacucauucucucagaccaucuugaagccagugaaaaucugcuggggaauacucgggggaagcauaugauuuuccaguagcaacacugcugcugccaccucucucccuuucuuccuaccgugaauuugaucaugguuccaggaaauaggguggccaucuugcaaauaggcagauuaaaacaaucacuaagacacugccuaccuccaggaggucuucuuguuaccaaagaaaauacaccccuauuuuuuuaagcaacuguuaaaggcaggguuucuguuacaugcagcugaacucauucccagaaaaugauagaaguccuuuuuccauggacauugacacagucuaggaugggaugguggggauaguacaggguacucaccagcuguuggagggaaauccccagguugugagagcucuuuuauuuaaaaaaaaauuaaaauguaagucaaacucaggcuuaguuuugaaguucauuucucaccuuguucucauuuuuaucuugauacuccgaaugaauuucccaacgauaucuaagagcuucccauucccaggcugguccagugauuuuuagugaaauuagguuuuauugaaagugaguugauuuuuacuuauuaauguucugcuaauuagagcacuuugucaauaucuccaugcaugcauuauauucucauguccacagcauguguuuagaaauauguggauaacaagauggagaguuagacuguucuggcccuaaugaccucccgcccucucaaaacgccaacauaacuucuggucacguaaucaugggccaccuuguacuguucacugacuauuuguuauagguugauuuuaaucccugacaaauuuuuuuuuuuuuuuuuuuuuuuuuuuuuuuuuuuuuuuuuuuugagauggagucuugcucugucacccaggcuggagugcagaggcacgaucucggcucacugcaagcuccgccucgcggguucacgccauucuccugccucagccucccgaguagcuggaacaacaggcacccaccaccaugcccggcuaauuuuuuauauuuuuaguagagacgggguuucaccguggucucgaucuccugaccuugugauccgcccaccucggccucccaaagugcugggauuacaggcgugagccacugcgccugacagacaaaauuuuuaaaccugugaauacugacacagcgcuucauguuuugcuagucacucucagugccuaucacagagguaggcaaaucaaaaauucucaugaaguacuagaaaauagaugcaccugucccccaaaugcacagcauaagaagauacccagggacuaaaagcucccaacuccaaaauaaaccuauucaugaacaugagucucuauuccuuugcucagggaauucagugcuaaaguagauagcaaauauauuuauauuaggggaaauaucuaaaaaauggcacuuauagauacauuugcuaaauagauauggaagucuaucugaagaccuagcacuaugccagccauacaacaaucucuucacaaauauguauugaaugaaugaaugaaugaaugaaugaaugaauaagcacacauacacagcagaaaaacagacuaugaaugaauauauauccuuuccccuaaagaaagauacucuaaaacaaaugggcagucaaaacuacaaucucucauuuaacugggaaaaguaaagaacccucuauuucaucuuugauuuccuccuuacaugauguacaaugcaaagggcuugcuagucauauuugucaagagagcccacagguacuaucuggcucaucacagcuuaacuuaucaauugccauuguuguuugguggauauugaucugggaagaccuuguaucuugcgaaagucacuucuacagcaacucaucacuuuuucuuuuuagucgacaugaaggcucaaguguugugguauacugggaauuuccacgcgacagccccauuccaucauuaaauacccagugagagcuuguuaacuagaugaaugucccaauuaaaccagcacguucuugucgcugccuaacagugaugguggguucagacuaacaguuugaagggcaauaacuaaaaugguuugaggagccucaaguguaguuucaaugguuucacacuuauccauucauuuguucauucaacaaaucacucaggggcccagcaugguggcucacaccuguaaucccagcacuuugggaggccaagguggguggaucauaugaggccaggaguuugagaccagccuggucaacguggugaaaccccgucucuacuaaaaaaacaaaaauuagccaagugugauggcacacaccuguaaccccagcuacucuggaggcugaggcaggagaauucuuugaaccaggaggcagagguugcagugagcugagaucgcaccacugcacuccagccugggcaacagagcgagacucugccucaaaaaaaacaaaacaaaacaaaacaaaaagcauuuuuuuggcaggucccaaugucuauuuccaagcugaaaauguuugcuuucccaaaggggcauaaaacugugauuuuucuuaacagcacaguuuaaguggucuugacucugcaucuuaaguucccaggguuaagcuggagaucuugagaacaagaaaagaguaaaaauagcaacagugcaaaacuccagacaucauguuggcuccauacggcuguguggguugugcacugugcaaguucaguguguuccauuacuaggaccaugauacaaauggcagggaagugguagaaaccccacccaagggguauccuaggcccauagugcucccuaguacaagggccacaaacuacuaaauguccaaaaucacaaguaaaaacuguucauuuugguagaggaaauacuugauuucauacacaucuaaauuucacaauuaaagucucaaauaaaaagcugccaaguaaaaaugcucaaugaaacauaauuuuuuccucuaccugauuuuuaaguaaaacaggcaaagaagaaacaaggcaaugauugaauagaaaugcuauucuuguuuuaaaaaaaauuagacgguccuaagaaucuaugcuaaaugauuacauuaauaugcauaaaauacauaaaacauauguacaaggauguuuauuguaagacuguuucucuauuacuaaaauacagaagugguuauauaaauuaugguacuuccauacaugaaaugcuauuaagucaauaaaaagaaugaguaaacuuguaauugcuauccuaaggacaaagcuccaaaacauacucugaaagacaaaaagguaaucauagaaaaauauaauaugauccuguuuauaaucaaaucuagauaauguacauaaagggauauuaagucaugaaacagugcuuggaaagauacacaccagucaucugacaguaauaaccuaugaagaugaacgaggaaguagagaaauuucauauuuuauauauuguaauuugaacuacuuuuuuuuaaauaaugaaaaguguuuguguauuaaguguauuauaaaaaauauccaaauaguucaaaaugacaguaaauuacagguuauguauaguuuaaucccaaccuguuacaauucaugacaaaacaaaugguuuaaaguuaaaauuucuaauguaaccuaugucaauuacacauucugacaacauauauucauugagcacauacauuacauaaaacacugcuccaggggcugcagguccagcaaagagacagguaaggccccugcuuguauagcgcuuuuguccaagacaguaaaagagacucauauauuuuaaagagauuuucaguuaaccaucauuuucauaguaaauaauucaacuaacuaugacauuuugggcacuguggcugagagguuugcugugacucuaguaaaguuucuucuuggaaagacauucugugccauaaagagcauucccugccuaucaaauauucauccuucucagccaucaaucaacugaaguucccucaaacagaauccauaaaacagucauacuuuccauccuuagagggguuuacaccuuuccaagcacuuucacacaucuacgguguccuaagagaugggugacuaagaugcaggagcaaaauaauauaaauuuaccauauaaaaacuuucuucugucuagcacacuuuucuccucgcucuuuacucgcucaaguuuugcugguccuucaguuugcaacuuagaagucaccucuuccagguggcauuccaggcugguauagggauccccccuacaugcuuuuauugcucccuauugccuccauucccucacaagguguggaccaugcugcuuugcaaugaccaacuugguggccacauccaagucacagggcucaggaucaccuggagugcccuggguccaaacucacccucaagaacugacucaccagguaggugaguaucugacagucauauuuacagaagcucuccagguguucugaagcaguuaaucccaagauaugaugauggagguguggaccaugucugucucuacaucaccaucauugaagccacggcuucugacagugccugauauauugcuggugcccaauaaggagcugcuccuuuaucuacugguucuuucaaaaaauauuuacugagcaccucagcaugccagacuucuggugaaugacaaaaugaaccaaucaugcaucaugacgaugauacagcuuucauuaauaagacuuuuugaguuaucugauaccugaagcaacuacaggaacccaauccacaccugucccucuguccccugcuggguagauuagggaagacaaacaaagauuugggagcuuuugucacauucuuuaggugcuuccgggaugccaccaguggguuccaacugcucagcuauguuuagaggucacaggcaaacagagugggcccauugcagacugcgaggcagggugccucuguucaauauaaggauauaguccaugagacagaagguuauuacaaugagguugccuggguuuuccuccccaguuuuauucuguacgccuuuuagguaaauuccuuaauaucuuucuucaaaauaguuggauggcauuugucuuaccuuuaagggauucggcuaaaauccacuugagugcuggcgccuaggcagggaacaggcagcaauuccuacagguccaucuaccugaugacaugaagacuaguuuaugguuaacaaacuguuuuucacucucuuuagaagagaaaucucugucaaaggucacauaaacuuuaccguagucagcaaagccccuucuuauaggauccucccucuauauuuccacccucaucuagcacugucuuccuugcuugccaugcccuaguccugcuguaucaauagaguagagccaccagccacaugcggcuccugagcaccugaauuguggcuagcccaaacugagauguaccagaaguguaaaauacaacccagauuucaaacacuuaguacaagggaaacagaaggugaaagaauccuauucauaauuuucuacacagcuuauauguugaaaucauacuauuuuagauauaucgaguuuuaacaacauauuauuaauuucuuuuacuuuuuauggugacuaccggaaaaacuaaaauuacacaaguggcuugcaucauauuucuaccgggcacugcaaccgugucuguauuggccucuugauuucuguacuauaacaagcauuucccccacuucugaggcuguguguuuuuuugucuucacaugaaugacucucuuuccaugucuggcaugccugacugcuguucacccuucuaaaugcagcuuguauagcaucucuggaauaagacuuguugaaugucuaucuguuuaugaccugcagcaaaguuagccaaaaugcucaaaagggggacagaauugucugcccagacuuaaggcuggggcuccccgaagcugacuuuccagugauaauaaaauguccccacccaaaucucaucuugaauuguagcucccauaauucccguauguuaugagauggacccggugagagguaauugacccaugggggcaguucuuucccaugcuguucucaugauagugaauaagucuaaugagaucugaugguuuuauaaagcggaguuccccucuacacaagcccucuugccugccaccauguaagacguuccuuugcuucucuuuugccuuccaccaugauuaugaggcuuccucagccacguggaacugugaguccguuaaaccucuucccuuuaugauuuaccaagucucagguuugucuuuacuaacagagugagaacagacuaauacagguaauaaagacuugaaggacaugagguaggaaggaaagacaaagguagaggaggagaaaccaagaguguuaccaagccuuagccugaugacaacaggcaguugcuugaagagagacaaacacucuugcuuuaagaggaauaaaucaaaguggcuucggauacauuaacccuagcuugucauuugagaagacagcccuuuauauuuagaauggcuaggaaagacuccuucuagaugauuuggugcuaauguuaagaacaucacgcaagguguccaguucgauggcugucaacaccuucucuaaaccuuguggcccauaccauaucaacaacaaaauaaagaaaccaaccaagucaacaacaacaaaacaucgucaacaacaacaaaacaucaccaacaacaauaaaaauuagaauauuuaagagccugugcaugcuuacuuaugugcugggcacuguuuuacacauuccauauauuaacuuagucuuuccaauuaagucuucaagguagccaccguuauuguucccauucuauagauggagacugaaaccuaaaaaagucaaggacuugcccagcaucacugagcugguaaguggacgaucaaagauuuaaacauaggcaguguggaucccaagccugugcucuuaacccuugcagcauauaccacucuacaucuucuguacuauucucuauugacaguaucuaugaagcuagcgcuucaugguaucaggauaugauacuuucuuaauuauucauuauuuugucuauguaugccuucuuuucccagcuacagcauucacuguuugaagggagagauucaaccaucuccuucucuggaccccacacccaacuuauccuguuauaggcucauggucaacagaugacugcacuguguuacuaaaugccagggaauacacagaaguugugacugcuuacauauucauggaagaaaaccccaacuccuaucauccaaguuugaaacuaggucuucuuuccuauugggggaaauuucugcaggugugaguaauuagaaaauuaaacauuaauuaacaauucaagugacugauuguguuagcaaguugcuugcuaaccauacagguaaauauugugcccccauaugauguuuaaaaauaaggucccuugagcauauuaaguaguagagaugguugacucaagauucaagaguuuccugaccccuuuaauaugucacauuuuaagucuguauauaacaaaacuauugggaaaggggauugccuuacucacucaccuugccuuaucaucuuacaaaauaucuuauauuaaaagagagaaaaggaugacagcucuguaucuaucaccuauuacucauuauccugggacaacaaacagccccagaaucuuucuuuaaugaauauaggcucucauaguacaugcuuauguucgucucacguuugcucucucucauuucaaaacccuauuucucuucugcccuuuaugucuucaaaagagacgcugauauuaauuaccuugcuucucuaaccccucaucguuuucagccccaaacaaucagcuuccugcuuuuaaucuucuaccaaaucuauuuucucaugaucuaccgaagucacccuacuaaguaaguguuucuggaaagguauuuucagugcccauuucccuugaccaaccuguggcccuugacucacuggaaaaaaucacuccacuccugcccuuuguaauauuauucucagcuggaauucuagccucuguccugcaaccuccagcuugauuuuacaauauaaacacugcuacuuccuaacaaguucaccagauauacgaaauaacccuguauuucccacugaaguaaauuagauuguuguucaguaaauauucacucucucuuuacuucuuauuccugagaggaguauacugucacauuccuuugauaucagacuugauuuggcuuaagacaugugaauggagcaggggcuuaaaaugucaugugcauuccugucuuucacuaugagaagcagaugucuuaguuuuuugcugggucuuggagggugacagacacauggacuuaacucacacccuauagucaaaacaagccaagcuggcccacagacacaagaaucagaguaaaugacucuuauuucaauccaccaaguacuggggacaguuugguacacaugaguuuuaugaaacaguuaacugaugcacccauacaaauguuaaaccuuuguucacuggaacaaagguuggaaguuuucuccaaccuuuguuggauggaaauuuucucuuguuccucuacuucuaugguauuaccucucccaugccacuucucuaacuucauguccuguauucucucccuuauuauguuuuaaacuccuuugaagagcaaagcaucaaaaguucuuaucccuagacagacacaaauuaaaauuugcuuauucauucauucauucauucauucagcaaauguguggauuuuagaaaugaguuucugucucaaagguauuuaauacaacaccuggcucagcuucauggacuagagacacauuaucacugaggucacguuguuacuguuuuugcuacuccugcuaacuguuccaaaggggaaaaaaaaacaacaugcacuuuaaaagcaugauguucuuguuggcagaaauuacaauaguuucuucucuugguguuuacucccccaacacuuuccucagcucuuuauuucugauauucaauuacccuuuuucugccuggcuuuucucacuuucccagaagacuuacccugggaaacuuuacuguuuucacugguguacauuugcacuaguugguuuaauuaccaagugaaucuacagccucucagaacauuugacacgucucccuuucacuggauccaagacaugaagcaaugaaaacgaaugggugaauguuacagcaaacucaaccaaaauuuauuuugccuggauucaaggauuaggcuaacaugcuagccaguuucugccccccuaaaaugucacccucuggaaugacaaaaaccuuaauaagauuuggaaccaaaguuccuaugaccagaaacugcucaacauauaugcgucacacacaggaaauaaaggcacauuuuaaacuagagcugcugggucaucuuuaaaauagcagacugccugucaggagaaccaauggaauaaucaaucacucaauuuaaaguggggagcuccuuuaaaaugcuagggugaugggguaugggcacaaagugaauagcugugacaguacaguuccucagccaagauccacgaauguaagcaccagugggaagagcacuagaccaagaggcucaaaaauauacugugaccuucaacuagucacuuaacaagugcucauuguaucauuuaaaaaauaauacaauagaacuccaugaauccaauuaaauuuaauuccauauuauucgaguguuuguuuaaaaugauauuucucaaagcaauggucaaaugaguuuggaaaucaguagauuaaagaagguuaagcagguuucuguuccaugcaacuucucaguaacuuuaauagucuacugugcaccgugaagcucucagaccugguggaugugguauggaacauuccccagacuaauaggaaucaaagauccuguuuguuuaccauggacagccuuguagaacuccuauucucuauaauacauggccaucaauuauagaagacacagagauacuaaagagaauaguuuucuuggguccugguccugaggccuggcauucucaugaagcugaguuuaugcccuccccugugauuuaugccauaccucugaauccuuauaaugaugucccuuuuugaucuuaagauggcuuuaacugguaacuaucauuuguaagcaaaaguaccuuauuaaacaagaaaaacagcuacgugugaguucugaguaaauauugcuaauuuaugucuaucugcaauuguuacuugggcugaaacaaaaguuccagguaaguaugauagucauuuugccagaggagccucaauaaucccugagcugaaauacuuucauacaucaagacguaaucaucuaauauuaggaaagccauuaagaaauacaauuacuacuggaaaugaagaccuuuuacaggagaacagacaugaugguuuuccuuaaaagcucuucccuuuuccacauccacuuucuucuacuuuaaaaugaaagugacuucauuuucaagugaccuuuuauaaaguccaaacaucaagugucguaaauauucuaaguauucagaaugagguccaguacuguaauauuaaguuggauaugccagaaacucagaaaagccuauuucucuuuaaauagccaacuuauaaaauuauucauauugucuuccuggauucccauuauguuccucgugcaagaaagugaaaguguuuuauacaagccacacugugggguaauauggccaaacuaagagcuuucagaaggauucuucucuuauucucuacuucugcuucugcugcugcugcuuuuuuuaaacaaaugagaucagaggcauacugugauuagcaaugcauguuuauguagugagacaccagauuagaaaugauuauuaucaugucaccuaacagagugauaauaaugguacucugagaugguacagcucagcuguugaggauuccuacuacaauaauuauuuuaaaauuaauuuugaagagaaaaaggaaagaaagaaagaugauugaaaccauuaaagcaauccugauaaauaagaaaaaaaaacccaaacacuauguuuuauuccuaaggcaagcacaaaaaauaaaauaaucaccaaagugagacacgacugacugaaagguaaaaggaacauucauuuuccccauccaaggaaaacaauaacugaaaacaauuuaaggcaaaaaguuaagcuucuauucugagcaaaggagaguuggacuguauuuaugugcuaauaaucuauuuauaagaaauaacugauuaaauaagauagauaaaacuuaguagacagaaauauauuuuuuucauagcaaacaaagcaaucaaaagagaaguguugcugaaaauauugacaauuaaaaaucauucaaggacucugaaguauauuucaggcagaaagagagcagccuaaggaggacuuauuacaggauugaaagcaucaccgugaauucauaauuuuuaauauauaaacugagagauauggaaauauauauauaguauguguauaaguacacaugcauauaaauacacacgcauguauugccuaccucuacucacagagaggcugaagcaaugauaccccacuauaaauuagcauaccugauguccagaucuugguuucuaaauaccauucuccaaaaaauaaaaauaaaaaaggaaccagaccuccuuggagaagugguuggcuccauuaaugggacaggacaggaacaagaugagauuagaauauccuguggugccacaaaguuacaaauggcuaaaaaaaaacaaagaaaaaccaaaauuguggggacaggucaaaagaacacaugaaccagaaugaagggauuccccuggcuaaauagggacauaaaauaaaauaaaaacugauaauaucccagagacuacagaauuaaaaaaaaucuacgauuuuacuucacacacacacacacacacacacacacacacacacacacacacauauauagaggggggggggaggauacaaaguaacauguaggaugaacaagucuagagaucuaauauacaauaugaugacuacagucaauaaaauugaauuagaguuuuuuguuaaauaaguagauuuuagcugcucucuucacaaaaaaaguaacucugagauaacagacguugauuugcuuuauguaguaaccaucuuauuguauauauguaucccauaucauacuuuaaaccucaaauacacaaaauaaaauuuauuuuuaaaaaaaugggaggugggggagaaaagcccuuccuuacagaauuucaagucauaaauaaggaguaauuaaauuagaaaguuaccauuuaacaaucaucacaaaaguaacuguuucagguaagaaucaguaguagugaaugcaaaaaaagaauggguaaaaguauaagaaaaaacauacuacauuuucuacaaguauauuccuauaagauacuuauugauuacaaaaggaaaaauagcaauuuuccaauggagaaaccugguagacaccacaccaaccaagugaucaaaguuaauaccaagaaugggagaaaggagcaucagugucuccugauauaaugcacuaagaaggauauaauacuaccucuguaggauucuggccaauaugcaaaaucugauucuaaccaugaagaaaugccacaucagacaaacucaaauuaagaaacauucugaaaagcaauaggcugugcuuuucaaaaaugucaaggucaugaaagacaaagucuggggaauuguuugagauuaaagaacacuaaaagacaggacaacuaaacacaaugugugauccuggaauggauccuggacccaaauaaaagacaauggcagcauuuccauaaggucugcagaccagaaauagcuuuauaucaagguuaauuuccugguucaguaauuacacuauguuuuucuaagaaaaugucuuguuuaaauacacuaaaggagcaaagaggcaucauguaacuugcuuucaaauauuucacuaaaaauuauauauacauuuauacacauauaacauauaugguacacacacucauauauaggugagagagagaaaauauaauggaaguaaguaaaguauuaauaucuggggaucugagggaggaggguagagggauucuuuacauuaugcuugcaacuuuuuuuuuuugcaacucuaaaauuauuucagaauuaaaaguuaaaaaagaaaagagagggagcuugacuuaauauugcagcuguaccauaaaguguucuugaacaagugacuugucuucauugaggcucggcucccccuuugcaaaauagagacaacaugacuucacagggugaucgggguggacaaacaagauggugcugcaaagcuccaacccaagagcuggccccugaagcacacaguaaguauagcuuguuuuugguaaauccaaaauacaacaacccauuagagggcguuacugucugaaagcaguuugggggcacccgaggugaugugcaggccgcagagacaaugcuguucuaggucaggagcagaaacacaggcuccucacacaugcuuuuaaauggggcuuuuuacuuucuaaaauguguuucuacacaauugaaaacaacauuacuuuuuccagagugggaggaugaaagcaaucgugggugggggcuucuugagaagagggguuauuuuuuuuacuuuuaaaaaggucucagaacaguuaaaaauaguuuuuccuuaagcagccucccucugcucccugcucccaccagcugcuccuucucucagccugcccuucucuuugucccuucaccauuuuccccucucuccuuuuugcuuccagucacucauaugccacccacuccugagaacccuaccuucucuuauuuuuuuguuuggcuuuguuuugaaaaaaauauuaaucccaaaugaacaaagaagauacgugggaaggaaauaaauggugagcucuuccuuacuucaccaccugucaaguuuuaaguuuuuccuccaacucacacuaaccuccugcgcaaccauaaacuucagugcuugccaaagcccagaaaauucuaaguaaaaagcagaaaaugaaugcagggaagggggugcauucuuauuguucaucagaucugaaaaaaauaaugcccagaaugucaaaugauauuacacuauuaaaaagguacaguaaagaugugcuaaugauagauuuuuuuucuacuccaauauguuguaaauauuauaaacuaucauuuacugucauuacuuuaaugauguagaauguugaaaacucaaucuggguuaauuuacaaauaaguaauuuugaaaggagaaaaaaauaucuuuucuauuuccguguaaugucccauuacuugacagucaaaauguggauacagccaaaagaaaaauaaugaaggucaaggaggaucaaaauuuaccugauagaguaccuaucuguuagaaaucacuuuccugaaauaccuucucugauuuuagaaaacugaaaaaacagaaaauacacuaccuuugacaaugcuugcgauucaggguugugcuuguguaugggggugggagaaccucugcuaggauaggagaaagcugccagacacaaguucagauuuaauagaaauagcuuucaaaucaggagucuagccaucaaccaguuuuagauggacagucccaguuucaaguaaauaaaauauuugcauauuagagccucguagcccuacuuagcugcaaguaaauuuucugagauuuacucugccuugcuucauuucauccaggcacugauuauuuuuucauucuuuauucaccaaacauuuacuaagcacuucuuuauacaauaaauucugagcaagguacuaagacaugaagaauaaaacaggucuggcuggagacugcacgaaauugccagucugucugagccuguuugaauucauaaaguccccgagaaagaagaaauaggugaggauuagcaacccuguaagagcauuuacaaagaagggagugcaaaagaagaaaauagcaccacagcucaggagggcaaugguauuacuuaccaagggugcaguuuguuugaugacaaaucucaaaacugaaugcagugauuguguuagaugcaaacacuuggaugaaauagaugacuguucuugugaccuugccaggaaagaggaggagugaaagagagggcuagaguucuagucuccuuucugaguuuugcauucauuggcaaccauguaccucuagacaugggagugcaggcaucuaucucuaucaagguacaugacauguaaugaaaggaagggauagagaccaggcaagagaaagcaaagagagagaaauagacagggagauggaaugagguagacaaaucuuagaggaaugcagugcuucuccaaguuuggugcaggaauguucccauuagaaucaccugaggggguuauuuaaaaugcagauuccugggcucugacccaggucuggugagccugaaugucuguggcugggacucuaagauuugcauuuuauauacguuuuggggggugguucugcauauuaaaauuuaagaucagaccacucccuaaauccaagggugcuauuuuacuguuuacuugaccaacaguauaaaugggugucuucaaagccuugucaccacaaccccaugcagccugauccacuuacuucucuguaucacacucccuccucucccaccaaggaaaacagagugauccugaaguuccuuaaaacucaacucaaucuacugcuccucauuaguaauaagguucuguucaaggaacuauuggcuaaucauucauauccugauugagauaccagcauauccuacccaauuauuaacuauggauggacuccaaccaggaaauccaaaacuauaugcugcuuacugaaugacaauaauaaauguaggcucuuauuuaauuaugcugcgguuuauuaacuauccgauaauaaggaaaaccccuaguuuauuauagaucuguggggugugugaauauguguguguguuuugagagauauauacaggacccuaaucagagagagugccaggaauaacagccaugcaugccaggcaucuuuuccuguuucuuuuucaguuacuugaauccaccugugauaaacuugccaaaagaaagaggaaguacaauaaccacaaacguuaagugauuuuuuuuuuuguucuacaaacucgaugaguucacugcauugucuacuuaucuguuuuuguaauuucaacuuuuauuuuugauuucggggugcacauguggguuuguuccauagguauauugcaugaugcucauguuugggguaugauuaauaccaucacccagguagugagcauaguacccaauagcucuuuuucaauccuugacccccuccuucccucccacuaguccccaguguuuauggcugccauuuucauguccauguguaccauguuugucuguuuaacucucacuuauaagagagaacauguaguauuugguuuucuguuccuguguuaauuugcuuaggauaaugaccugcagcugcauucauggugcugcaacagacaugauuucauucuuuuuuuauggccauguaguauuccacuguguauguguaccguauuuccuuuaucuaauccaccauugaugggcaccuaaguugauuucaugucuuugcuauuguaaauagugcuacaauaaacauacagguagauguaucaguuugguggaacaguuucuuuucuuuugaauauauauccaguaauggaauuacuggguugaacaguagcucuguuuuaaguucacugaaaaaccucccaacugcuuuccacagaggcuaaacuaauuuacauucccaccaacaguguauaagcaucccccuuucuccacgguuucaccagcaucugugucuuuuuggcuuuuuauuaauaacuauucugaauggugugaaauggucucucaccgugguuuggauuuguauuucucugaugauuagugagguugagcauuuuuucauguuuguuugcugcuuguauguguuguuuugagaagugucuguucauguauuuuguccacuuuguaauagggcuguuuuuugcuuguugaauuguugaaguuccauauagauucuggguauuagaccuuugucagaugcauaguuugcaaauauuuucucccauccuguagguugucuguuucucuguugguaguuucuuuugcugugcucaagcucuucgauuaggcccuacuuguuaaauuguguuuauguuacauugcuuuugaagacuuugucauaaauuauuucccaaggcugauguccagaaagacauuuccuaacuuuucuucuaggauuuuuauaguuuaaggucuuacauuuaaauauuuagucaauuuugagguaauuuuuguauauggugaaagguagggguccaguuucuuucuugugcauauaguuagccagcuaucccagcaauaacaauaggguguccuuuuuccauugcuuaauuuguugacuuugucaagaucaggcaguuggaggugugagguuuuauuucuggguuuuuuauucuguuccauuggucuuugucuguuuucacgccaguaccaugcuguuuugguuaauguagccuuauaguacaguuugaagucagauaacaugauaccucuggcugucuucuuuuugcuuaggauugcuuuggcuacucgggcuccuuuuugguuccaugugaauagucuuuucuaauuccgugaaaaaugacauugguaguuugauaggaauaccacugaaaaccuguauauugcuuugggcaacauugccauauuaaugauacugauucuuccaauccaugagcauacugugcggucuuugauauuggguccugacuaggccaagaagacagagauagacuggucccucaaaccuuuucucuaaugucuggagaguacauauuuuaugcuuuucaguauguauggccucuauugcaacaacucaacucugccauuacagcauuaaagcagucauauauaauauauaaacaaauggguguggcuguguuccagugaaacuuuauuuacaaaaacaaauagugggccaaauuuagccugcaggcucuuguuugccaaccccagcucaaaucauccucagacaaaauuuagggagcugcuaauaauaacaaggccaugcucugcuauagugcuauuaagcuauugccucagcaucaaauucacccuuugguauucucuucugugauaacuggcacguuuauguauugacaagaaagaugaccaccacauauuaaguggggaaaaaaucacacuuuuuauagcaauaucacuuuuuuuaacaaaauaugauccucuauacguacauacauaauguuguauaaggauucauaagucucagaaaggauaauacugaaagguucagagggguaaccucuggaaaauggaaucaggaguaggaagaaaagauuacucugauuuuuugcuuuacauucuuuuguagucuuugaauuuauuuagaguaagcaaauauuaccauuguaaguuacaacaauaaaaaggaauaaaucaagguggagucuuaacagugcugaaacacuuuuguuaauccauuuccccaguuccaaccuaagcuuuacagaggugcuauugucaagcaaucacucauucguucacucuacacauauaauaggcauccacuuugggccagacccuacgcuaugugugaggaauucaugaaguuuaggaucuagguggaaaaacauaauuauauaagcuaaaauuguaauuaaaacaaauaauguacaugaaggagagauggcaucacauuucuuuauuaauauauuuauuggguauuauaucccauuauugcuggaggauaaaaucuaugccagggaauauaaaaagaugagacagagaaaaugauacgaguaaacacgcugaggacuuuagacucagcauauagguguuugguuccuaccauaucaucuacauaauuuccuuaaaacugcugugaauauaaaaucacaacagcuguuuuaaagagacugaaauugaaauucaaugaaacaaggcauuuguaagucuuccuuggcuuucuacauugauagugacuuuuuuuuuucuuuuucacacucuuagaaucagggauggguuagauguuaugaucuugcuguuacuucaggcaucuucuguuaucauucucccuagaggccaaaggcagagaccaugucuucuuuucuauauguuggaggcacugucuuuugaguuauaugccaaacaccuucucuggaauugguuugccacuucuagggacuggcucccugucgccauguuuguguaauaugacaacagacuuaggcaagugauccuagcugggccagaauuccuuccucacacacucaaaacaggaacaaaagagaguggucuagauuuuacaauguauuaacucaagggaugaagaauuccuuauaaacuagacagagacaaagaucuucagagauaaaagacggguacagacaagcagagagaagauuaccaagagcagaucauucuguccaggugccucugauuuuuugaggucuagguucuuccaaaggcccuacuacauccuuugcuuggguuuuuuuccauaugacaucauucuacacuuacauuauaucuucccuuuucacugaagcaucuauauauaaauuaaagcaucacuaacugaugcauguguauauauuccaagauguuuaauauugcuuuccugacaguagggauuuuuaucugcagugcuucagagccaaagcaaauucuaauguuauuuuuuuccuccggaauguucucccagaaaguuucuaccaguuugcuacaaguugaaugccacuuguugucauuucagaaccucauauacaguauucuuuaauagccagaaacacaauuauaggggaggucagaagauacaucuccaaagucuucuaaguguucucuccugugcccuacaggccaaaaugguuuauauaucaaaugaccuuggacaaguuguuuaucuuuugaguuucaguugucucauuuguauacaggcaauucuguuggcucuacagugcugcuggcaggauaagugacaaacucuuuggaaagucccucacacacagucagugucauuuaagguggcuccuccugugagauuuugcaauuagggauaugaucagucuuaguccauuuuuuguuuuugugaagaaauaccugaggugguauaauuuauaaagaaaagagguuuauuuggcucaugauucugauggcuggaaaguucaagauuggguaucugcaucuggugagggccucaggcuucuucaucaucucauggcagaaggcaaauggaagccauuguaugcacaaaucacauggugagagaggaagcaagagagagaguaaaaggguggggggaugccaggcucuuuuuaacaaccaucucuucuggaaacuaauagagugagaacuugcuuaacccaaaggacaggcaucgaucuauucaugaaggaucugcccuccugacccaaacaccucccccaggccccaccucccaucauuggggaucaaguuucaacaugugguuuugagaagacaaacauccaaaccauagcauuccacuccuggauucccaaaacccauguacuucucacaugugaaauacaauuguuucaucucaauagucccaaaagucuuaacucauuucaaaaucaacucaaaaguuuaaaguccgaagucucaucugugacccaagguaauuucuuuccagcuaugagccuauaggaucaaaaauaagauguuuguuuucaacauacaaugguuucaugggcacuggguaaacagucccauuccaaaagggagaaauuggccaaaagaaagagaaaacaggcccugugcaagucugaaacuuagccgggcagacaugauaucuuaaagcuacaaaauaaucuucuuugccuccaugcccuacauccuagguacugcaaggggugggcuccuaaugccucaggcagcucugccccuauaacuucagugggugcagcucaaguagcugcuuuccuugguuggaguugaaugccuguggcuuuuccagguugagguuacacacugcugcugcugcugguggcuguauaauuugggagucccuuugguagcuccacuuccauagcuccacuaggaacccugauagagauucugugguggcugcaccucuguggaaggucucugucuaugcuuucagagaucuaugagucaucucuaaaauccucugaaaucuaugagucaucaagccuccaccacccuugcauucugggugccugcagacguaacgucaugcaaaaacugacaaggcucauggcuugcacccuccagagaaggagccugagcuauaucuggggccauuugagccauggcuggagccagagcagcugggaugcagggagcaacauccagaggcagcccagggcagcaauacuuuaggccugucaccugaaccauucuguccaucuacaccucugggccuaugauaggaggggugguugugaagaucuuugaaaugccuuaagggccuuuuucccauuggcuugacuacuagcaccuggcuccauuuuaaucaugcuaaucucuuuagcaauuucacuggacugggcaauagcauuggauuccucuucugaaaauguuuccuuucccaccaaauggccaggcugcaaauuuuccaaacuuuuacacucugcuucgcuuuuaauuauaaauuacaccuuuagaucuuuccuuugcugcuuuaauucagcauaaccuguuaaaaguagccaugccacuaacugaggucuuugcagccuagcauuuucauccaccagauaccccacccucaucacuuuuaaguucgaccuuccacaaagcccuaggacauggacacgaugcagccaaguuauuugcuacuauguaacaagggugacaguucccaguaaguuuuucauuuucaucugagaccuugucagcauggauuuuacagucuauauuucuaucagcauuuuggucacaaccacuuagccauucucuaagaaguucaacacuuucccuugucuuuuuuucuucuucugagaccuccaaacucuuccgacugcugcccauuacccccaaccacuggguacuaauuuucugucuuaguucauuuuguaucgcuacaaaggugucacugaggcuguguaauuuauaaauaaaaggauuuauguggaucacaauucuaauggcuaaaaaauucaagauugaauaucugcaucugcugagggccccuggcugcuuacacucaugguggaagaugaaagggagcuuaugagcuuauguauggagagaucacaugacagagaggaagcaagaugucaacaaggugcuagucucuuuucaacaauuaguucccuugggaauuaacagauggagaacucaucccccaaaggcaggcauuaaucuauucaugacggaucugccuucaugauccgaacaccucccaccaggccccaccuccaauacuggggaucaaauuucaacaugugccuugacagggacaaacaaaucaagcaugauccuuagaaacaccacaugguagaguggaaagaguauuuaaauguuagucaggagaccucuauucuaguucccuguucucacuaacuaguugcacggccaugcugcuuacuucuuuccaagaaaccuguaccuucaugcauaaagugcuauucccuaugcccgaguaucauccuacaucaucaugucauggaaaccccaacucuaauucaugauucaucuugaguccugacuucuucagcaaggucuccucaguuuccacaaucagaggagaacauuccuuuuuuugcauaaauaaacacuguacuuggaucucucuuaugggaguuauuaggcucaacccuacuuuauagaucuagcacuacucaauuccuucuuauuuacuuucuaaagacaauucaucuuccaaaguuauagaaaaacaaaguuuagcauuugcugcauauguccaacaaacauaauuaauuggauaagaaacuuggcagguaauuaguacuaggcauaccauuugcuuuuuuaugcccagaaccuagaaaagugccugacacaugguagguacucaauaaauauuuauuaaaugaaaaaauacccagacuugguuaggaaagacuauguaaggcaacaauuucaaggguauaugcuuuuaggccaauucaguuugccaaaaucuagcccuugauguuaaaaggaagcuggggcuuacagaaauggaggaccccaacgcuaauggcaagggcagaaaucaucauuuaugagacauagucucuuguuugguggggaauguuugacagcuagcugcauaauuccacacgguuccacaggagaugauuuuggauguggagggaacacuccaagcacacuucuuaugaagaccuauaaucagaggucuuaacaaacacaagugauuaauauuuguugacuucaugacacauuuauuuucuuuagagcacuuaccacagcuuacucuaacuuuauuaaacuuuuuaguauauuuuuggguuuuuuuuguuguuggugguauccucaauaaacuaugaguucugugggggaaggaaccaugauucccuguccauuguuguacauccacuacacagcacagaguagaugaagcucaacaaauguuggaugaauaaauaugcauauaguaugauggauggaugguugaguggauaaauggacggaaagaggccagcuagucacccauacaagcuucuggguuaugaaccuaaauaauaacacaaguucaacagcaacaaaaauaaucccauuccauuauaggcuggaugaaaggcuuacccacugucuuacaccauuagcgcugcucuaacaaaauaccugacaaugggugauuuauaaagaacagaaaauuauuucucacagaucugggaaauccaagaucaagguccuagcaucuuguuucugaugaggguagucuucugcuuccaaaaugguaacuuguuggcagcuccuucggaggaaacaagugaucaccucccaauggcaacaucucguaauauuguugaauuggggauuaaguuuuaacaugcaauuuggaggagacacaaauauucaaaccauagaacccacuuagagaugacagaauaacgaauauauaugaauuaaaaugaauggaacaacaacaauaacaacagccaucacuuauguagugcuuacuguguuccaggcauugaucuaaaugcuuuacauauaugaauucuuaauuccuaauacaaaaaagugaguguuccuucuugaucuggagccaagacugcaucuaucaaaaugggaaucugaucaucucucccaucugccccccaccccacguacaucaauggucuacaugacaaugcuacaauuaauuccagaaguaaacuuaaccucucacuaagugcccaaccaaagagacugcaugguuucccaguaugaaaaugugaaggaucaauucacaauuuguuuccugcaaaacugucauuccucucuucauacccaucacuggagaaauuacuuuucagaccauucuacagcuugggaauacuaaauaagcccuaaugaguucaaaagucgguaaugacaguacuaauucaguggccuguuugguagaaagucagucucccuucuucaaaagcaaaauaggauuaucaagugagcugggagcauuuucuuuacgugauugauggguagaaaaaguaaucaccuuugaagugccacaacauauaauauaucuccuguguucucuuucuucuucugacacccacaaguaauugaagggaagggagccucuuagaaugaccaacgaagugaaggugacaacccuuucucugcuaucuaccacuagagugacaugcuggggucuugaauaguugagaacugacaugagugucuuugaugggcugcuuugaugcuugguucagaguguaccugccaccagucaggccacacagacuuugggugaaacauacaucuaaggagacaaguguuacuacuucuuagaagcaaagggccugugcaccugugaaagaagaucuguugucugagcucuggggucgggguaagguccgcaagguggaagugaaggaagucaaggagcaaagcaaguugaagcagguaagaaacacugaauaugauuucaaaacaguuucucaucauacucauccauaaugaccgauuaaccacaauguucagacugacaacuaggagaucauuagccucuugaccucagcucacugaugcagaagcagacagucgucuccuuggaaaaggcacugcucuacaguagcuuacuuuguaaggggauuuuugcaacuacaaguaauucaacugaaacagaguugacacucaaaaaccuuaagaagcagggauuaucaggcaggugaacaguuuuauucuuaagagcucacucuuucugaacucuccuaaagcccauccaggcaaggacauaugaguuuguuaucugaaggaagaaaaaugcuuugaagaagauuuauaaagaggaagggucuuugguuuauugacaagaaaguaaaagacuuucuagaguuguaagcgaaaugucgcuguucagguucuagaacuugcuggcuagagaacagauggcugccacuuguuggcaccuggagugacaaggaguugaggaaggaagagagugucauccaugugaucuggcacagaacauucuucucuggagccacucuuauaaagaagagacuggcauguuugguggguuuacuguaugauaugguuugaaucugugucccugcccaaauuucacgugggauuguaauccuuaauguuggaaguggggcacggugagaggugauuugaucaugggggcgguuucucacgaaugguuucgcaccauccccuuggugcuguucucaugauaguaaguuaccaugagaucuggcuguuuaaaagugugcggcaccucccaccuugccuuucuucuccugcucccaccacaugagaugccucacucccccuuucccuuugccaugacuggaagcuugcugagaccucccuagaagccgaagcugcuaugcuuccuguauggcauacagaacugugagccaauuaaaccucuuuucuuuauaaauuacccagucucagauauuucuuuacagcaaugugagaacagacaaauacaccauaguaccuccaaccugcuaauuaagucaggagucucccccugguuggcugcuacccacaggcuccacuacuggugagucguagaagacaaauaaaggcauuuuaaggaauaguacgacaauaaucucuagauacaucugcaaucaaguaacaguaaccccucucagaagcuaugccaguauguugcagauacugaacacacaucuguuaaaugaaugaaaaugaaugaaagaauaaaugauuauacaguguacuuguuucauaauuguaacugguuuauauugauuugguuauaucugcuugguaccaugugaguuuugauuacauaaagaucuacagucuuuguaugacauggccucagaacacaagucaacuucuucaucugguucucaaccuaagaaauaaugaucuguugcaaggacaggcuggccaugguagaaguacgaagcaacauuuuaucuacauaguacuuuagagguaauguaagagauuuucaaaaucaugcuuuuacaaugucuacauuaaggucuggcuuuuaacuaaaaaguaugugaaacaugauagcauuucuagauugauuccauucagaggugcuuuuauuucacacauauaucucagaccaaggguaaguaugguaagaacaagucacuaggaggccagcaagagaggauuaaugaauggaagaaauggaaaggagagugaaacacugguaaacucaucccagcuccagcaagaggggccaagauaucugagcuagcuggaacagcacaauaauaaaaauaauaacaauaaugacauucacugugagcaaaagaacucuguaagcaaaucaaaaauaucagugcuaagggucuuaauagcugauuauaaugaacuuccucauguaaucucagggagcagaaaagagaaaauagauugugcaucuguucaaacuaaacauauuucaagcuggaaccagcuuggugccaaagacaucucugucacagagaagaaaaaauuccaaauggaagaaaaauuccacuucaugcucaaacaccaugaacuucgacaggaaaauuagguaaccacugccucacuuacaaggcaacgcaucaguuuccuauggcugcaguaacagauuaacacaaacuuaguggcuucaaaccacaccacuuucuuaucuugcucuucuggaaguugggggucugacacaggucuccaggugugggcagagcugacaccuugagccugacgcaggucuaaaaucaaguugugcgcagaggugacuuccuuuccagaggcuucuuuuccaguuucuagaguccaacuacauuccuuggcucguggccucuuccuucaucuuuaaagucagcaauaaugggacgaaaccaucucacaucacaucacucugaccugcuuuucugccucccaccuccacuucuaagaauccuugagauuacacugagcccaccuggacagucuaggauaaucuuccuauuuuaacaucagcuauugagcaaccucaauuccaucugcaaccuuaauuccccacugcauauaagguaacacagccacaguuucuggggauuacgacauggaggucuuugguaggagggggguauucuauccagggauccccaaccgccgugccacacagcaggaggugaguggcgggugagcaagcauuacugccugagguuagcuuccuaucagaucagcagcagcauucauuucucacaggagcaagaacccuacuaugaacugcacaugcgaaggauuuagaaugcgggcuccuuaugagaauuuaaugccuaaugauauaggguggaacaguuucaucccgaaaccacucccuccaccaccgggucugugggaaaauugucuuccaugaaacaaggucccugguguccuaaagguuggggacugcuguucuauauugccuacuacaggcaucaauguuucaaauuuacuuaaaaaucuguucagguccagcuaccacaaauacaagugagugccucucauuugugaaaaacuguguauguguaaggugugagaauccuaucuuauuuugcuaggcagagcugacuauaugugcucucagagcccccagaauuccagaaaaccaaaauuuaaaaaaaaauauugaagauuaaaaaacagagagacaguguuacccagugaaguuucuaagagaaucuacccacuaacagacuuuuccccaucucaaguucucaaucauucauuuuguuacauuuuuuuauauuugacaaaugauaucuaaugcauuucauugcuguuagcaguuuagacacuuaugagaaauuaaaaccccauuaagugugaaggcaucuaaacaauaccagaucugccuuccacugaauauauuuugggaugacaggucugcuucaucugacuccucaacaagaacagcuuaugaaacucacaguuuuagugacagggcccaaccggcaccuauuuuuguaucaccuggaaaaaaaaaaugcccacauaggcaauacaucugauacagaaaugaaauuaaauagaacaauacugaggcaucaaccacucagauccauuucacuguuuccuauucugagacaaccuaauugaagguggcauuccaagguuaaauccuagcucugacagcaucuccugucagacaccugucaaaauguaauaagacaccugugaaagggaagugaugccaaagccacaucauuuuccccuacaccuugauuccuaacuugcaggauucaugucacccagcaaacagagugguagcugggugcugcuggcacugugccaccauuugcaggugagggagggaagggaagggaacacaaggggugggggagagagagagagagaagaagagagagagagaaggagagagggagagaaaaaaaaagacaacacugcaaaaggaagcacccaagcguuuuaaguuuagcaaaugauuaugagcauaaaaggacaacucugaacggacuugaauuuuaggauucaucccuagagucuugaucaugaucagaagcagggaauuauuuuuuaauaucuguuuuacauaauuaaggggugguagcuuucaugcaaaugaacgcuuugaaugcucacaacaccaaaugggcuucauuagcuuagcugggcaauuaugaagcaggaaguaaaaagcugagauaaagacuuaucucaaaaaggucugaagcagggcguguugauagccaagaggcacaacgaugcauuuuguacauuuauuaccucggaggcaaaacuucuaggauucuagauagcuuugaaagcagugcauacauuccauuuaacacccaaaugaaacagguggaauguuuaaagaucuguagaaagucuugaaaucguucccacacauuggaagguuuuaccaaaccuucucuauuuauucuaagugcuuuuucuauuguuuuucaauugcuucucucauuucccucccguguacauuucagagaaaauuggagagcuuaaaaugcgacuaaauauaaccccugcacuaagcaaacagugaauaaauccuuaagaaauuauuuuugaagcauauucuuucugauuugauuuaaaaacugcaauaucacaugugagucuugcucaggagaaaggcuauuuguucacaagacgaccaagcauguagagggaaagcugagggugaagggacugaauccgguucucagcuauuucaauacagauguuuuucuagauaaucggccucauuguaaguuaaagaaucaaacauaaaucagaucucucacaggcugagaaaaggcaaaacaacagccuguucguucuguaaaaggaccauucuaguuggccuaucugguacaaccaccuuguuuaaaagacaguaaacugaauccagcaaaaguuuauugacuugguccagaauauuacugagccaccaccacagccaggcuuacaucccagagcuccuguuucccauccugggcuguguauauucuuccacgucaccuccccagguggcuggcuuugagaagaagggaaucauaaaaagaccagaaauaacauauacaccuugaaggaguugacacaggauuuuuucuugaucacuuugcaagccagggaccucuggccagugacacccugcccaggccucacucggccaugcuacuugcuauaggagauggcccgcccacuuagcccgcucaggccgagucugacuugcacacuaguucccaaguucuuguccugcgccccagcagaaugaggauacacugacaaucaaagaaaaagucagggaguuuuauugagugaugaaaacagcuuucagcagaguggggaugcagggguggucccccuaucugaaggcaggaaaguccacccaauuugucugagucuggggcuuuuauaggcucagaauaggggaggggcaggcaguagguaguacucgaaaaagcaacauuagauugguucaacggcauuauucagaaagaaucaaccaagaaaggucaggcaaacagaaacgcaaguucucacucugggucgcagguuucauccaggaccagcagucuggucuuucagccuucaggcuguuucuguugguucggaggugggauuucacuggggacucaccucuaucugacuagguauuuggcugccuccuacuguccucagagucaucuguucaucaguuuguuuucccuguaccuuccuuucucacaaacauuccauuggcagauuucuguuuuguucuguguguuuccuuuccuucuccccaguucaagcugaggcagacgcauggacaaagaaaaacaaacugcuggcuaaauacagagcagagagugucauggaauguuuacagaggaaaugguuuuaggaaccagagaguaggaaaagcucaggcuggggaaggggcaggaggaugcaagagggaaugacuuuaggguauaaaaggaauggaaacggccaggcacaguggcuugugccuauaauccuagcaccuugggagacuggggcaggaggauuccuucaggcuaggaguucaaggccaaccuggccaacacagugagacccuaucucuguuauuauuaaaaaaaaaaaaaaaaaggaauagaagaacucgaguccuuaaagaauuagggucuccauguagaguaccagguggccaggugaaaacauacccaaauaucaaguaaggacacccauuggccagcacccccaaauuuuaguccaguuauuacacccaacuuggacuggcaauuuauccccuacagguaacugaacaucuuauggucugggaaaucuaccagccccuccaaacagaagaugaggagcuuaaauggaauaguaggaagggggagcuuuaccccuugaccaugaugggucuaaauaaaaugagcugggaauuucccuaggagcccaggguagugcuacaaagaggacacacugccccugagguauacuguguucauuugggagcuaucuagucccaguuuuccaagacagacuccagggaaaacaggucuaccuugaacaacaugaguuugaacugugugagcccacuuacacauggauuuucuuucaccuucacaaccucugagacagcaacaccaaccccuccucuuccuccuccuuuacagccuacuuaaugugaagacgauaaggaugaaaagucuuuacaaugauccauuuccacuuaauaguaauuauaauuccucuuucugauuuucuuuuuuuaaucuuuucuuaauucuaccaauuaauuuuuucuuuuuuuuaaaauuuuauuauuauuauacuuuaaguuuuaggguacaugugcacaaugugcagguuuguuacauauguauacaugugccauguuggugugcugcacccauuaacucaucauuuagcauuagguauaucuccuaaugcuaucccuccccccgccccccaccccacaacaggccccggugugugauguuccccuuccuguguccauguguucucauuguucaauucccaccuaugagugagaacaugcaguguuugguuuuuuuguccuugccauaguuugcugagaaugaugguuuccaguuucauccaugucccugcaaaggacaugaacugauuauuuuuuauggcugcauaguauuccaugguguauaugugccacguuuucuuaauccagucuauccuuguuggacauuuggguugguuccaagucuuugcuauugugaauagugccgcaauaaacauacgugugcaugugucuuuauagcagcaugauuuauaauccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugacaugguaucucauugugguuuugauuugcauuucucugauggccagugaugaugagcauuuuuucauguguuuuuuggcugcauaaaugucuucuuuugagaaaugucuguucauauccuuugcccacuuuuugaugggguuguuuguuuuuuucuuguaaauuuguuugaguucauugcagauucuggauauuagcccuuugucagaugaauagauugcaaaaauuuucucccauuuuguagguugccuguucacucugaugguaguuucuuuugcugugcagaagcucuuuaguucuuacuaauauuuucuuuucucuagcaaacuuuauuguaagaaaacaguauauaauacauacaacauacaaaauguguuaacugauuguguuaucaguaaggcuucugguaaacaguagucaaauuuugggagagucaaaaguuauauguagacuuuugacugccugggagucagcaccccuaaccccugugauguucaagggucaguuguauucuguuagcucaccaauguuuaccugaucuuacacuuguccuaacuucuaauauggaaaggauaggccaaugauauaguagagugcuuagauuugacuguugaccacuggcucucaaagccucuccaguauaacugccucugccucuucaccccaucucccacugugccuaaaacccaacacuccagccaaagaguaaucaugcgcuguugccugaacauaccccauacuugucuccuacuagucuuugcucaugccagucuuccuaccucaaaggcucucccuuugcucuguuuaccucuugauaacuuauccaucuaccaaccaagaauuuuuaacaucugaaaugauucacaaauggaaugggaugggcucaaacgauaaaaauaauaauggcuaauuuggugucaggaacugugcuaagcauguggaauacauuauucucauaauuaccuaagagggagcuauaauaauccucauuucauagaugaggcccaggagggucaaagaacauuuccaaggucacucagcugggauucugacccaaucaguaggacuuuagagcugggcuguuaaccuguacccucuaugccucuaaugguccuucuaacacugugacccuggcauuuuauaauguaacuguuucuccccagaucccuuucugaaugcccccaaugagguguaagcccuccuuacucuggaaguuaucucacuggccucacccgacauauuuacauacuuuuuucaucucaccaaauacagauggucccuaacuucaaugguucaucucaaauuuuuuugacuuuuuaaugguuuacugggaguauuaaaugcauuuuaacucaugauaaguuuauugggacacagcuccaucauaugucauagagcauguauacuggguaagcuucaugaaagcggaaacucuggcugauuuacccacaaucagacugucugagcugcagcagauauuaaaguauuuuucgugaaugaacaucuuucaugcuucacacaguagaagugcuccguaaaugguugugguguguguugaauucuguucaaacaauuaucaggaacaacagucacaguuuuucacaguagcacacuggaacccccuuucuucacugugagugcugcccugacccugacaaucaggucaacuggacagucuguucucaccagucucaauauaggacugaaaagcuaucuucuccaaccaaguuguuuggaucaccugaggucaggaguucgagaccagccugacccccgucaauaugguaaaaccccgucucuacuaaaaauaaaaaauuagccaggcauggugguggacgccuguagucccagcuacucgggaggcugagacaagagaaucgcuugaacccgggagguggagguugcacugagcugagauugugccacuguacuccauccugggcaacagagcaagacucugccucaaaaaaaaaaauugugauuuuuugaaaccauuaaauucuucacuggugucaugguacaaacaaaaucacuugcuuugacucuuggccaaguccagaauugugucauuuuaaaaaacugguuuuuaaaaauccuaaguuguuuccaccugcaggcauaggcagaggagccuucgucccucacuacgcugaccccgagugguuccagucccaucauuccagaaaccccucucuggucuuguaucaaaaacaccacaaaucacugggauugcucugucaugggguagaaggggcucgaggacaaaguuuagcuuaaaaccagagugaauuuauuucuauuacauaugguuaaaucaugacuucuuuucuaaucccuaaagcuaaacaguagagucaugcuggagacacaccaucaucuaugucaaucagacaaaauuaaaacagagaccaacaucuccuuguuucauuuaauuuuguucucuuguuacugcaugugugacaccaagaaccacuugaccuuuggacaaaaaaguaguuauauauaagccauguauggcuaagguccuguuuucacaggccaggaacauguaacagcucuaauucuuguugacucuauuucugaaauagagucugaauauguacacuucuuucugucucaaagucuacccccuaggccagaccaccauugcuucuuaccuggggaacagggcaguaucugcucuuaacugaccugccggcccccgcucccuauucuaauccuuucuguauacagccgccagaagggcuugacacaaauguaaagcagggaacccugacccugugcuucaaugacuuuucaaugcauggagaauaaccaagcacauuaccuggccugcaaggcccugcauaaugugauguggcacuguacagauggccauguccaccucgggccacucucccucacaccuccugcacccugggcucacuggcuuccucucacaccugagcacuugcugcuccuuugaccuggagcucucuucuuucagcuccccaggacuggcucuugcucauccguuaaguuucagcuaagugucaccuucagaaaguccucucuaccuaugcuuucuacaaaggucucugccuucccucacccaccccaugcuauuuucuauuacauuacguauuuuuuucuuccugcuccuuuuuacacaaacugcaaugauugucuuuacguauugacuuacuuaucuucaauuuucccuauuggaauguaauuccaugagggcacagcccuuguuuaucuucuuuggcauuguacccccuauuaaccugcaacacaucacauggauguaaacaguaucugugcaaugaauaaauuaacgaaugccaaguuccaucacauuccaaggucugucauuaccugggccccugccauccuuuccagccuuaucaaccagcgcucucccacauggacaauuacgcaaggcacacugagccacuuccuucaggaauaggucacuuuuucuugccucugaaauuuuauaccagcuguugccucucgcuaggaugucuuucuucccuuccucacucaagucuaauucugcucaaggaucaguuuaauuguuacuuccucuaggauuucaaaagaauuuuugaaugcaccaaggcaaaguuaaauguggcaacaaucugucagaaaagcugccuuuuggugggugagucccagaaguacagaaaucauggcuaaaucguaccuuuaucuucaauacaauaccuggcacacaauagguguucaauaaguguuaggcaaaugagugaguuuaacuaaauuauaacuuccugagaacuaacaacaucucaaucacuacgcucaguauagauugaggcugagggccgccaauguuggcagcagcaaagccugcuuaaauauaauaacuacagcugcauugcacagaaguccaguuagugcagaagcauaaaguuuugagggugugugaaaggaacaaagacaaaguucaggugagacauggaagcaacgagaaaugcaacauggggcgaguaagccagcacuuucugcuuucacuucuaucacuuuggaaacauuuaguccagaaugaucuggggguucuuacuuaugguucuaagacagccuccacauuccucagcauguccagucacaaucaccaucuccccaagaaggcacaaaguaagcaucuguaaauccauaguuggcuauuuuggaaaauuaguguuaaauaagaauaaaaaaaaaaaacccuucaccuuuauguguaauaaagcacugcuuaacaaucaaggucacccaugucaauaacacuccccaagcaaagcuucauaucuuuuuaauuccuaggcucauaaagaccauugucacuuacaucauuacaggauucaagggagaauaacauaaagagaaugugcaggauaauuuucaaaauaaaagagaaaaaaaugacacaucuacauaucaaaccacacaagucccgugucugauaaaaucacaauuauagauuuggugcauuuaaccagucauacaugccaugcauuugcgaaggugccauaugggggaguuguggaaagucaaauaauuccuagacuuuuucuuucugagcacaugugacaaugaauauuauuuaccccuguaguauagaaauuaugaagcuuaagaccccauugcuucuuuuuaauaaaagcuaacacaucacagcuuacugcuugacccagcuccuuggucuuugcacguucuccucucugggcagcucucucucaguuuuacccccuaccacaggaaaggagacagcuguguuucuagacuugacagacuuguuuuuacuugauaaacacauuguauauuguaggggagaaaacgaucaccccuauuccccuccuuaguucuuaugugggcucuuuggcccgaucuaggaaccaaauugacacaacacagauuaacaaagaaaggcguacacauuuuauuaauuuuacacauacaugggaaucuucacaagacagugaaguucaaagaagugaccaaagcaacaugcuuuuacacguuuuagacaaaaacaaacaaacaccacgauaaauuugugaagaaaugacaggauaaaaagggaucuggcuagggaaaauaauuucuaugggagugaccaggagcuauaugaauguaaaacaaguagaagguaaggauuauuucaggaaguuuauuugcucagacacauugcagcaccuaaucacagucuccacugauaaggaauauucucuuacccuuguacggagaaggcagcccucccaaaagaaucuuuauggcuugcuacguguagaaaaagacuggucaguuagcccucugcaauuauacuuuuuccaacguuuucagcucgaaauaaucaacauaccaauucgcauauucugggauggcauguccuucacugcuucaggaauauguuuuccuuugugcuuuacuuggauauuaaguuccaaccaauuuuaauuacaugucgcuugugcauaauauugccacuucuaaaaagcagaucacuuucugaguuagaaagcuuaucugcuuucccuccuuauagacacuucugaagcagaaaggaaguaauuccuaugcuccuaucagauaugggcucauauuucuguuucaaauuuaagucugugaccccuacaugaggccaggauuuugagaagagugaggaagguagacucuuuuuaaaccaugccacaggcaaaaacucagaacucauuuuggggaggaaaaaaaguccuaucaaaccaguauacuauaaauuaaacaauguagcaucaaagauaacuuuuccuuuaguuguuaccccugaguggucacguagccauaagaaaaucaccuccuugucaacacaucaucaaucaaccaguguucauuaaauaccaacucugugcuagaaccugcuugguauaaagaauucuauuuuguguucaaugugugcauucagugcuuugauuguaauuaucuuugaaaugacccaaaucauuccaaacaacuauaagugacuuuauauucagaauagcaaaaagcugacuugaacacacaauguaaaagucuugaagagagagugaauuaaacuuuuuuuuuuuuuuacaacaaucagugggcuuauagaauagaaagagaaagagggggagagguuuuuaucuuuuagaauugcaaugcagugaauagugauacuagaagaacaaucaccaaaagauuacagaugagaacuucagaugaaaauaacaaugaaacaaagcaaaauucaauuaauggccuuagagaaggugagaucagaaagagaaacugaaaguuuuuuagacuucucuuuaagacagauaaaauuuagaauuuuuaaaaauccauaauaaaaaccagaacaaugcuaccucgccaaaguugaguucaaauuuagucacuucagucaccaagaauccaggaaacuuaguuacuaugggaacagagguccuccucuucagaaaggagggcaguguuucuuucaaauuccaccagcuaaauucaagaucaaugaugguuguuuaauauccucucuugaagcucuuacugucuuuaguauacuuuaaaauaaaauaaaaacucaacaauaauggagcucaauuaagcauaauuugugugcuucaaccuuuggcugggugacugcucuguaccguucacacuuguacuguagagcauugcaauuuuuaauuaagaucacucauucuauuuccccugaaccaaccaauguugagguuauuguuuggauacaaaacucuccaggauacggcuucacuuaacaaggacuuuguuucuuucaaguaccaggcacucacugguucugaguauaggcugccugcccuacuuuaaaaugcaucucaacuuuauuucagagacaguaagauuucauuguuacucuacaggacuuagaaauaaaugcaugcauguacucacacacaaaaucucucgauaauuuugcauauaauacaguuuuugugcucuaugccaacaaagaacagaauguuuaguaaaucacagagaaacacuuuuauuucuugagacugagauauguguggcuucucuacuuuucuaggaauuacauuuaaaauguaagaggacaagaccucauucaaccuuuuaugccuacuuuagugaucagggugaaacauauaagaauauugcaacaccaaagcugugugucacuacucagcuaaugguaccuauaaagaaacuucucuuaauuagcuuuacccugaacuaacuuccuuugcucugccauguauaauuaaauauguuagcaagacagaaaugugagauguagcagcuuucacacccaaauuuccgacuccaaauuuauaaaaaguguggauuuuuuuuuaguugaaagcccaucaugaaguauuuuacuuuuacucuaaaaacuuucaaaauuacauuaaaagaagaaaaagaaaaugggcaggaaaauuaguaaugagagaugaauuuucagagaaaagaauucuacaguagucccuccugaucugcaguuucccauucagugcuuucaguuacccuugguuaaccaugguccaaaaauauuaaauggaaaaucccagaaauaaacaauucauaaguuuucaacugcaagcaguucugaguagugugaugaaaucucauugucucucacucugucucuucuggagcgggaaucuuuccuuuguccagcauauucuggcuguauaugccacucaccuguuagauacuuaguagcuaucucuguuaccagaucaacuguugugguauggcagugcuuauguuuaaguaacucuucucuuacuuaacgauagccccacagaagaguagugaugcuguaaauuuggauaugccaaggaaaagucccaaaguaucucuuuuaagugaaaagucaaaaguuccugauuuaguaaagagaagucauaugcuaaggguggcaacaccuauaggaagaauaaaucuucuauccaugaaacugggaaaaaaagaaaaauucaugcuaguuuugcucucacaccucaaaccgcaaaaguuucaaccacaguucaugauaagugcuuaauuaagauggaaaaggcauuaaaucugugaaaggaagacaugaacagaaauguguucguuccuacugauggcaauuagguucgguaccaucugugauuucaggcacccacugggggucuuugauuguauccccuguggauaaggggguacuguuguauaucaaacaaaaucugaggugcccagccaaggacagugcugcuucccagaagagaugagacuccccuauccuuucuaucuucccaaagggugcauguaguguacgcccauuggucucucccuuucaggagugaauccaaaagccacaauauugauggacggcaggaaacguccaguaucugggcucugaagaaccuugaggauagaauccagcuccaaucauacaguuccucuguauggauaccuuaaacaaaaguguauuuuauccuuuuuaauuuggcaucccuuagaaaugugaaacuuccuugugaaaacugcucuuuaaggaaacgaaacuuuuuuauuguaagccuucccauugucuguauauaauuaagaaaagaucagugauaguucacggugguuuuauaauaggugaauuaaucaguuuuaaaaagcugaauuuuacaugcauuugacaaccaaucugggcacuauuuuccuaggaaaaggcucauuugauuaaauaaauuuuaaccuuuaaaagcuuuaauucuuuuuuuuuuuuuuuuuuuuuuguacacaaaggacucuuuugugaugguuggaucaacuuacacauccagagcacaugugcauagauaaaacuuugcaguaaacuauccuguuacagauagcuuuucuuacacauaaaaauacauucugaugagcaaucuaggggaaacaaaacuaaaaaaaauuaaaauacagauauacaauucauauucuaaucuuaucagaauaaccuacuguuaaaacacaaacugaggcaggauaaaauuuuaaagaguuuauuugaucgaacaacaauucaugcauugggcagcuucuaacuggaagucauucacgagcuccacagagggaacaugauggguggacuuuuauaggaaggucacaaaaguaaagcaagucaguaugugacugguuauagcucuauaauugccuuauuugcucuaucccauuagaaagucacuaaauauauauacauaaguuuguuggcuacuuccaacuggacaggcuuaaguucuguuuuccuuuaauauaggcauuugcaaggaauagcuuaaguuucacuuaagcuuugcaagccaagcaagguuuaggucacuuaugaggucugauaucaucuguuucuuucaggccuagucuccauuuuaauuuacuuuaacacuauccauaagaauauuaaaaacaggcagcagauaugcagauauuuuaucaauacaaccuuuuauaaauacaggaaagaauaguguugacagucuaaauuugcuuccuugaggcauuaucuguuugaccagauuuaaucauuuaauuugaaacaaagaaacaaauacuacucugggguugcugugaaaggacauucagaguggacaaaaccucuuuaaacuuuucuucaagguuucaucuucacauauauguuaguuugguuacuuugacagauuggucaacuuaauccaauacaguuuuauggguccggaaagugcuuugcuugacuuugaccguaugugucaugucaguuaaguuaaaagcuaauucaauguguccacuucgggguuauuuccaucauaaggcauuauguuuuuacuuggguuguaugggggaguuccucugaauugacuagacagaugggagguuuagacacaguuuaauauucuguacuugcagaagcaacuauugagagcuuugauuacaacuaaauucaagcuagcucaaaaguugguucucagccauuuaagucaaaagguuagguaaugucacucccuccagggguucauuguccaguuuuucuguguauucauuuuguuuuuauuucaugccuaucuaguacccaccccugugucccaccuaugccugaauucuuacuguguaaacucuuuuggaugggaaaugaccagcuccugcuacugaccacagcccucccucuugccagagccugaaggacaggggacuccuagcucgacagaucaugcuaaaauuauaccuugugcuuagcauuucuuggccuuuaauccugucccaguuacuucucuuuuuuuuuuuuuuugagacagagucucgcuuuugucguccaggcaggaguccaauggcuugaccucagcucaccacaaccuccaccuccuggguucaagugauucuccuaccucagccuccccaguagcugggaucacaggugugcgccaccaagcccagcuaauuuuacauuuguaguagagacgggguuucuccauguuggucaggcuggucucguacucccgaccucaagugaucugcccacuucaaccucccaaagugccaggauuacaggcgugagccaccaugcccagccauuccuucucuuuucuaagauuugaguucucauuguuaaucugguaauuuucuuuuucacaccagauaagcagagcugguuucugcauugcuaacugggagcuuccuaacuaaaagagccucacaaacaguuaauucugcucuagaugcuguaaaagagggggacggggguaggggcagggagagagagagauuacagugauaaaaugaaaaugcuguuucagccaggaaguuuuuucucccccaucucauauauuaaaaugggccugauuuucuaacuucagcauaaaagcccaguaagaaauauuagcucuucaguuaaugucauucacacaaggaauuuaucagcagaguuuguguuugaacuuuucaugucaucucacgcaucucagaggguauuaaacuccauaaaacacaaucccaaaagugaaauauuucccacuuuuacucuauaagugagucuuagggaacggaaaaaaaaauuccaugucuggcuuauuccuaaagagagaguaaauagagauauuucuugggccaaauaaugagaagaaucacaacccuuaggguuuauguuccaaaggccuccaaaucccaacagguccagcaaagcagaacagagaaaggggcugaauauacaugaagagaauaacagaagcaagugguuaaugguuuccuuaaaugcggcagaaaauggcuuauguguaccuaaguauccuauaguacugagacuuaccaagaagaaaaggugaaaauggaacuugaggccccuggaagacauguucuuagcuuugccugcuggcuuucugcauaaaucugaccuuucugcaggugaaguucuucuuuacagcccaguuucuccucuuaguuggcuacugacccacaguagcagccaaaauuaaaccaaugauguauuucucguacuuccccaaaucacuuuucuuuaaauaaguuaauaauaauccaaacuugcauuuuucagcugagugcuuugauacuugcuucucaaaaaacuacuuggaagguaaaggaguuuucuuuucgagaccucgaucagaaauacuccaugauucacgcacucaguuaggccuaaauuagcccaauguuauggcuauaaaggaaacaggaaaccuguguuccagggacaaucuucuucaucacucuauucccagcguccucucauaugaggacacgggggguugggcuaccuccauagaaugauaauaaaaguuugccuccaaaauaauuuggaauuuuuggguuaagcaucaggacauuucauaucauguaauauacuaacauucaguauaaaucucuaagcaggguaagugggcucagaauaagucacaaucucucaacucauuucaccaucuugaaaauuucuuccauggagcacaaagaugaacuaaguaaucaccacauuccucgcaacauuuauacuuucugaucaggacaaaaugauucuaaggagugauuaaagcaggguaagagagucuucucacccuaaugaauccaaagaucaccaaauagacacccaguuuauggcuuagugauguaaaacaggugugauucagagccaaguuuacguaaguucaaauucuguuuccaucuuugguagcugugcauucuuggauaaguuacaucaccuccgagccucaguuucuuaaucuguaaaacagacauacuaacaugacuucauagagguguuugaaauagauuaucuaaaauaagcaccaaguguuacauauaaugguuauuucaguuauucauugauuuaauucaauuaccauuaagguugagaccuggucaucauuacccaguuaaggaagggguuugacauaaaaaccacucaagauuucuucccacuuuaggacuuuaugauugccuuuaauuuuucauguuucaauuauguaacuaaaaucuucuauuccauauauaucagaacacaccccaucuaaucucugcuaaguguuucucuacucugccugucccaugaaacaauucccaaagccuaggagagucuccugugauacagauaccaaaaugacgugggucagaaguaacucauacauccauauugucagaggugaacuauacaaaauacugaguacacuacagagugaucugauaggccaagaagaaaaaaaaguaaucugauagaccgagaagaaaaaaaaaguauauguuguuucucuacuaaagaaugucaccgcauauugauuuuucuagucuuuuacaaagacuguguucagaauuuagaucaguguuagagaaauucacuuauaaauucacauauacccguauauaaggauacaguccuguaucuaaggauaaaguccuagcuuaaaucuggaaugaguaaaaacaaaguguaaaguuaaaaaugccccucugguaagacaaacauaugcuuuucacccaaaggugcaguuaaagaauaacaacaaaaguugguagugagaucccucuaaaaccacugauauauaauagacuccuacugacacccuagaaaaaugaugccaacccaugcagauuaguuucuuccagcaauguaauuacccauuucuuuggggcuaucuuuccuucaauggugauuugagaaauaccuuucauuuauacuccauuuugcacaaauaaacuacauuuaaagcucuauaauuagcuguccuuugcuacuguaaaauucaguguuuuuguccaaaaggaacagacuauugauuuacaaagaagcugaaaugcugucaaacuacccacugaagaaguaagaaaaaaguggucccuaucuuggcucugccucuagacuagcucuuguccuaccucagcuuuguauccacauaccgagccuucuguuaagguuuagacuugcacagccaaggccucccaggcaucuccccauugacaucuaagagacaccucaaauuaaacauccaacucuuugccugaaacaccguuccuuaagggcuuuccagauuagcccuuuuuugccucuauuauuuguaucucuuaaaugcuuacuauugcaagauguagaaaaucccaacuaaaacgggcauaaaccauaagagaaauuauugucucacacacuaagauaaguggcucagugaagcuaaguaugggauuauuucucuuugcucaugaaagcaucaaugugucaguuggguucaaguacaagaaucagaacccauucuagauauuuuaagcaggggagauuuaauacagcaaaguuggugcuggagaaauaacuuggagggcugaaaguacaacucuagguagagccuucaguaaggacucccagaacaauaucccauugaccucauggaacuuguaaggagccacuccuccugaagcugucuuggagccauaguaaaaucaagaacuugucaccauuacaacugacucuacuaaugcaagaaaccauagaaugcuuaucuguagcuguggucccgaguuucagaagccugaucauagcgcugccacugcugcuucugccaucccaaccauuucguaaaacucagaaagcuggagagugggcagaaaaacacgacugcagggaaccuggacauugccacagcuacguuuaccagcagaaacagccaaaggagggcugaaauauggccuccacauggcuuucaccuuccacacaucacauauacacaucuaauuggagaagacuuuuuuugaagcuggcuaaaagagaaucugagaaaugaugcuuuuaguuuugcaacaacuuuaacuugaaugaggauagaauggaaacuacauaaauucaucuagagcauacgaaaauaccagcuuccugggugagucuuuacauaggagcaugauggaagcaagcagcaaucaaggcugccacagccuuugauauguucuaacaguagagaagaaaaaaaucucuuuccuggcuauggcauagaaggccuuccuuuacuccuuauggaaccacuuuaagccauuugcugacucacagucgaauaccacugaccauggaaugcuaugggcugauuggcucagauggacaaucuguugagugucaaccacaguguagucuauagugugccugcuuacauaacaucuaaucauugagggcuuuccugaccauccaaucucaaguagccucuucuccugacccaugaauucugugucugcuuaccaauagguaagucuucauggcacuuaaugcacucugaaauuaucuugccaauuuacuuauuugccugcuccuuaucuccuuucccuacuaagacgcaagcucugugaagguaaggauccugucuuuuucacgucuguauccccaacacuuacagcagcaugaaacacauaccaagcauucaauaaauuguuuaaugcauaaaugaauaggcuauaauccauguacuacagaaaccuuaccaauaaaaugcuuauguucuucccaguuaggccagcuuagcaguuuauuuaaaaggggaugagaaagagagagcuguucaacguguguguggccauacacagugaaucuacuaacugguuagucuuuugggauucaguguuacaucuacuaugcgccagucacuguacccuacuauuagcgaugcauaaaucagaaaucuuggcccaaaggaggacuacugguacaugaagauuaagauucuacgaugacagcugcauuggaaaacaguaucaugaaaaguguuuuggagacgggugcacaacaaugugaauguacuuaacacuucucaacuguacacuuaaacaugaucaaugauaaauuuuaucauugggccgggcgcgguggcucacaccuguuaucccagcacuuugggaggccgaggcgagcggaucacgaggugaggagaucgagaccauccugguuaacauggugaaaccccgucucuacuaaaaauacaaaaaaauuagcugggcgugguggcgggcgccuguagucccagcuacugggguggcugaggcaggagaauggcgugaacccgggaggcggagcuugcagugagccgacaucgcgccacagcacuccagccugggcaauagaacaagaccccgucuccaaaaaaaaaaaaaaaaaaaaaaaaaaaaaaaaaaauauauauauauauauauauauauauauauauauauaauguuauauguaucuuaccacaauuaagaaacaaaaauaaaaauaaaaaauacauuauaaaacaagcacaaccuuuuauguaaauuacuuacuuaauccucauaaucagacaagguaaacaguaugaauauuccuauuuuaaaaauucugacccaguaagguuaauuagcuugaucaaguuuauauagcuacuuaggagcagggcugcgacuagaauuuaaaaaucuccaacuccuaagaucaugagcacacagauacacaaauaagcaauagcaucauguuuucaaacagucuggucucuucccuggcucugucugaaugacagacucucccauuguuucuuguaaacaggcaauuaauuguacacacuaauacacagaaauggcccuuaaaauaaggaagaacaagagaaauccuuuuuuuuuuuuuuuuuuuuuuuugagacaaggucucagucuguuucccaggccugagugaaggugcaaucucagcucacugcacucuucaccuccuggacucaagucauccucccgccucagccuccugagcagcugggacuacagguucaugccaccaaguccagcuaauuuuuguauuuuuucuaaagaugaggugucaccgucuuugccaggcuggucucaaauucuugggcucaagcaaugcaccugucucagccucaugggaaaucuugcacugaugggcuaaacuuauucaaaaagaaaaaucuuccuuaaaauuaaaaaugaagaguaauagcaauuguuggaaguguacugauucaaggguauccaggucaacugacagaagagagaggccagaaaggaaucauaguauacugaaaagccgcugucugauaaaaguuggcaaggcagauucuaggaagaaagagcucuucaacaaacaauggcuaacuauuuaaggaaaauauguuacauuguuuucucaucucaugucaaauauuaaaauuaaucacaugcuuauuaauaaaauaagagcagaaaauugagccauauuauacacagaagaaacuuuuaucuggauuaaaauagauuuuaaguauaaagaucuuaaaacaaaaugacaaaggaaaaaaugaaacauaacgccccagaaaauuaaaacuuucagcuccccaaagccauuaucaauaaaaugaagugaaagaauagggagaauauguauugaaaaaaguauuaaagacgaagagcuaacaucuucagacagagugcuauucaaaucaauaugguacaaauccuuuauuagaaaacuaaauuuaaagcaugaguaguucacagaauaagaaauauaugugguuaacuaccauaugauaaaauacucaacuucacuauauucaauuaacuacgauuuuaaauaauaaaacgguaauuuuguuggaaaaauaggcagaguauuuucauuuauauucaagucuucagaggccacagguauaugucacuauaagggaaaauuggccuacauaucaaaauauuuauucauagcguucuggcaacuuaugccaauguaaugaucagagacccacacaaagauuaguuguaaaacauuugucacaguuuuauguauaaccauaacaaaacuguaaaaaacuaaaugagagaacaaauucugauacacaaaggugaauacuugaaagacauuaagaaaucagguuuucaauacuucauaaaaugaaaaaguauugacauaguaaaguauaaaaaaguagaacacaaaauguacaaacacgaauagguauuaugugcauguauaauacauauauauuauaaaucuacaaagaccuauccauauaugcauauaugcauuuagauaggaauuuuuuaaagcacuggaaggaaauuuacucaaauguuaaugaugguuauagaugagaaguugaauuaauguuaacucuucucuuuauuucucuccauuuuucaaauauucuuuaauaaauuggaaguguauuagaaaacauccaaugaugucaugaacacucauucccuagacauauuaaaucuguuagcguuaacuauagacuaguguacuaugcuaagguguuaugacaaagaaaaagaagcaguagacagauacaaagacauuccugacauuaggagaacuucuggagaaagagacacauguugguacaaaggcuguaauguaaguaaaguagaaauauaaacaaaaaaagcaugagaauuauauuguaguugaaagccagaaaggcuuccuggaaaaggugguguguaacuuuuauaugaaaaagcuggagccccaucucauggaacaguggcacaaaguauucucgauagcgggcaucaccauuugaacucgauccucagccuucaauaaaaaucauaaagcccaucuucagagccccucuuuucuugcuucuccauaaauuauguacuuuccucuuuucucaccuccuugagauacuguuuaccuaggaaugagacaauucauuuuuuacagcccaucaugaacaauucugaaaaagaauccccucauucauuacaagacaguaugaauuaaagcucaagaaugaacucuuccuggcauuucuaauuaaauauguagucuaccuauccucuaauggugaaauaaaaaguagccccaauauuaaagcaauuccaaggaucaagcaagcagguaaggcagauuggccaagaaggaagagcaaggcacugagaaaucacaccaugacgcaaaugacuuucucuguugauaugaaaauuuuuuccugccauaggugauguugauauucuaacaauuuuaaaacacaaaaaaauuaaggggaguaacaaaauuucccuucuauuuuuugaguuauuuaccgcuaacaaucuccccucuagaaaaaguuacggaaauauuguacaaaaugcaccauggguuaaaaaaaugauuuaaauacaggaaauaauuguuauuaaauacaucuucuagggagauccacucugucccaauccuuaaauuagaaagucagcaaaaagaugaacugaaucccugauguuaauuguacaggcuuacuggauuagaacuagagauaauuaauugcuaaauuuuaauaugcauuggacuaaauggcugauaagauuuccaguaguuggcuugaauuccagaagggaaugauuauuucuuccccggccugggagcccuacaagccgaagacauuuaaaaugucuguauuuggaaugaaagaaguuggguaaauaguagaauagguuacagaauggcaaaaacuucuagaaagaaaauauggaaguucaaauugccuuuucccauuugaaauuuagaauauaauacuguauagaaaagaggauuuaaauuuuuuuauuuuuauuacagcuucagugauuagcauuccuguacuauaaugucaauauuaaauccagacagacccaaagucuauuacuuccuaucuaaaaaaaaaaaaaaaaaaaaaaaaagacacuguuuaucaccuagguaauuauauuuuuuauguucuuaagaauuuaggagcuugcuaugguuaauugggaaaaaugugaauuaugguuaagucgugccuuuuuuuauuaaacuuguaacaaagcaaaugaugaagaaccaacaacuugccaaugcugaggguccagaugaacagacgcgcagagaaugcagaugagcugauuccauuaaaaaguuggcugcaaggguagaugaugaagguuaagaagauguaggacuauagaggccaccagugaaaaggaaaaaaaaauccccugcuuccucuguacaaccuucaggauguucaaggaggaagaaagaccaccaacugcagggucaguacccagaugccuuaggauauccaugaggcugucaggcaccagugaaaaucaggucugguugugcaucagaaucaccuguggaguuuguuaaaagaugggauucugaccuccauucuugcaaaaugcugaugauccaagcggugaguuugagaccaaggauauuauuuaucuuuuaacaaaccucacaguaaucgugaauguacagcaagguguuauaauguauuuugauaucuuauuuuuuagagacagggucuuguucuguugcccaggcuggagugcaguagugcaauaaugucucaccguagccuccaguuucuggguucaagcgauccuccugcuucagccuccugaguagcuaagaccagaggugcacaccaccauauccagcucauuuuuaauuuuuuuuuuuuuuuuguagagacagggucuuuuccaggauggucuugaacuccuggccucaaggaauccuccugccuaagccucccaaagcgcugggauuauacgugugagccacugcacccggcccuguuuuaauuuuuuaaauuuaacuuuuaaaauucaaauauagguagcguuuugguaaucucuuauuuuaaucugaaugauggaauaugucaaggggugacugacaguagggaggcauaauacugucaggagcuuccuacagugcuuucuucaauuacuuuagaaucuuuggucuccccagagguaaagugacucgcccaaggucacacagugaauuaacaaaaauaagaaacgaaugcuaauauuagaaaguacauaccuccuauaauuacuugcuugggcaauaaacuagaaguuaguaaauauuaagaacuucaggguccgggccuguaaucccagcauguugggaggcugaggugggggcggcggggggggggggguggugaaucaccugaagucaggaguuugagaccagccugggcaacacggcaaaacuccaucucuacugauaauacaaaaaaaaaauagcugggcgugguggcgggcaccuguaaucccagcuacuagggaggcugaggcagaagaaucacuuaaacgugggaggcggagguugcagugagcugagaugcugccacugcacuccagccugggcaacagaggaaggcuccaucucaaaaacaaaaacaaaaaaaacnucagggucauuacccuauuucuucaauuuuuaauuuauuuuuuauuuuugagacagagucucacucugucauccaggcuggagugcaauggcacaaucucagcucacugcaaucucucccucccagguucaagugauucuccugccucagccucucaaguagcugggacuacagguaccugccaccaugcccagcuaauuuuuuauuuuuuguagagacaggguuucaccauguuggccaggcuggucucgaacuccugaccucaagcaaucugccugccuuggccucccaaagugcugggauuacaggcauaagccaucaugcccagccuauauuucuuuaauuuuaagaugccuauuuuauguuuuuaacauaaauaaaugaagaugcaucuuguaauugauauguuuaauauggaagcacucauuuuuuccaaaauaugaaaucagugguguacuuacaacuaacagcauuauaaaauccaggauauaugggagggguauugcauauuuauuguuucuuugaaacaagguuuucuaugaauuaauuuugucccuguauggguacugucaucgugucggguaaggaaaucaagacucaccugugcuagaaaccuggaaauaaacuguuggcauauacuugccuccuauggucagcaucuaaccacucauugaguacuggugacucaauuucuaccucuucaggcuuuuuucccuucccaguuuuaaaacuucaaccgucccuccaguguagcacuaaucaaaucuaccacagagcugucacauuuauccucauuaaacacauacuugauuccaugacuuccuuuuuauaaaacucuacuggcuccccagugcuuucagaaucaagcccaaauaccaucaaauggcauuuaggguccugugaaaucuguccuuacccugccuuucugguaucacagucaucagcugcuucuucccugcuuaaaaaaucagccuaaucaacauuccugaagcuuacggcacuguuaccacauuucuaauaguuuaaacuuucaaggcccagcuugaacaucacaccuuccaccaaccuuuuccaguccucucauuaaaaucaauuucucccaucucagcauucccacaauauacagcacaaugagcauguagucuugccugauguaugccugucuguccacccaacuggacaguaaacucucuggcagcagaaacugggccuuaaucauuucaguuuccuccacagagaucagcacagugccugcacguaguaguuauuugcuaagcaugaaaucuuuaacaaagccagaauugauucugaggcaggguuaaagauauuauaaauaaaacuucacugaacugaaauucauagucccaugcagggcaccugcauauuuuuauuagguuucaccauggaaggcauaauuuuagguauuauuaugcugaugaagcacaaucuuccugcuccaacuuggccaaacccagggaagcaauuuccuauuugauuaagaguacgacagcagcgaggacuggaguauaaaaauuuacuguaggguugagaauguaagcuuaauuguggaucaaaugggaaacauucuaaacagcauuuuuuaaaggaaguauuugaacagccuauuuuaaaauauucaauaucaucuucagcaauaggcaaguuuuggaaacuagcaaguuucaagacagguacucacucauucucucuucugcaggauccuaaagaugguccuggggacuaucaguuacuuaaaugucucagguuauuaauucuuacuuuaauuauaucucagcuaagugauuuuuuuuuuccaccauuugcucacauagcagcgaacaacuuuacacuguuaucagucuucacauagcaguucccaaauuuugccuuuagguuuauaucaugugcaaugaguuuuaaaaggcuuucuccacaaaaucauaagagagccuuaagaguuucauucucugccugaccuccugaaacccucaaaagauaauuaaagaaucaugaaaucuucuugugauuucauuuaaaaaacuuuuuuuaaaucauugaucaugucuucauucuacuaaaccauuuaagaagugggcaauuuaaacuaccccuauaaugguucacuagccucagcaaucaaggcuguaagaagacagaagccuauguccaacauuauuauuaguaguaauuaucuguuacauauuaaugcuacuaaaguaaaaugugaucuauauauaaucgauaauaugacuauaauaauguauauaacaauccaauauaguuucccccuuuaucugcuguuucacuuuucaugguuucaguuaccugcagucaacugcaguuugaaaauacauguguacaggccgggcacaguggcucaucccuguaaucccaacacuuugggaggcagagguggguggaucauuugaggucaggaauuugagaccagcuuggccaacauggugagaucccaucucuaccaaacauaaaaauuagccaggcgugguggugcgugccaguaaucccagcugcuuaggaggcugaggcaggaaaaucccuugaaccaaggaggcggagguggcagugagcugagaucaugccauugcacuccagccugugagacaaagcaagacucugucucaaaaaacaaacaaacaaacaaaacaaacacacacacacacacacacacacacacacacacacauuagcccugugccuaaugucacagugccaucccuuggucccacuccaacaacuauguaugaaauaaaccugugauccuaucagucauaucccuucuccaagccucccuuucugaaacucuaugccucuaauucuaugagacauuucacaauguuguaucuacagucaacuaagaaauaauauauuuggguuuauuucacucuuugcucaaaccaaggauaauuuaucaggccugcuaaguauaaucugcuuuccuaaguauugugagaaauaugaaacagacuacacuugcaaaucuuaaauugugauagaagaaaugagagaaugcacaaaaguuuucuuuucuucagaagagaaauugcaacuaaaaaaaaacgccuagagauaauaaaagagacguuagaaagcaacacacaacugucaacucaaauguacugcuaauuacucuagaaagaaguguucagcauucuaauaaaaacauuauauuaguauaauguuugucauuaacaaagaguugcuuacaaccacaucaacagauaagauccuaugauacguguugucuggggcaaagcagggaauugugggaaauguaaaacaaauuuguguugaaucccggcccucagggaacauuugaguucaugaaauaaaacuaggaaucagaaagacugggcaagauuuguuuugcuaggaauucaggauacaugaauccaugaggaaacaugaacgucuuggaacucgaacaggagguggugguaaaaaucuaggaguuagguaaacagugucuagccacaagaacagaggagggguuuaaaccucuaagagaucauuuuaugggaaaaagcagccccuccugaaaacauucaauucaggacacgaaggacagauagacacucagagccucagagaaaaaaguaucuggugaaaucucuucuagaaacuuuggcuggggagaguuuggaauguugacuuaaagacccacagugaagucuagaaaaagauagaggcagcuuguuacaauuuacaccaacaggaaaccauuuagaagggaagaauaaauguuaguuaaacuuuaaagauuaaauuacaaauuuacucaagugauuuuaacuuuuacugcacaaguagcaauuuuaagucauaagggaucugaaauguuuccagaguuuuaaaauggacuguuuuacacaagugaaaaaaagauuuuggcuucuagugcugagcacagagcaauccuaugccuuguaaugggcugguauaauugugcaguuucauuaaaauaauuuuauuacugacuuccuaguuuucuguuaauuaucauuucagaguaagaaaaacuauuacuuuuaaagccuauauuaaaguaggcuuaagcaagcacggaaaagaaagccagugagagaaaauauaaaaagaagcuauuaauauuaacaguuacaguuggacacuuguucauuucauaaaucuuugcaguauuagcaagauugaugagaaguaguacaaaugagaagcacaugagauaagcgaucauuuguuaucauuacugaaauauaaaguaugauucaguguuucauaauggauguuaaacuugauuuaacauaugguuggcucauuugcugaaaacuauccuuaaagacauaaacucauucuaaagucaaagacauugucuuaauaacagucucugaauuaucuuucuauaagagacugaguaaccucaauaaauacaaacuuagggagaaguugugaaaaggcuguuccuuaaggagaaaaaaagcaaauguguuauauacucugauucauuaaacauauuauagagaauucuaaaauaucguugaaagaguaaagaauuaauguguuuuaauaccaacacagagucuuuugaauugauuuucaaaugaugaguagagaaacccaaucacugcugucagugcuucagcagcuaccuaagaaauccuccuuugucaacuucauuucucuaaucaugagagaacgccagugcccacuuuaaguuuaguggauuaagcagaccacugcaagugcugcuaaaauaauuuauaaucuaucauuauacuucaguagugauaguauacuacugaaugagaauacacuggauucucauucaaccuggaaugagacacuuaaaaauauuuguuacaugaguauauuccuauccacgacuuaguuuugucugaauucucacuuccauuaacagaaaugcacuaaaaauauauauauauauauauauauauauauauauauauauauauagagagagagagagagagagagagagagagagagagagagagagagacagagagagagagagauacaaagucucacucuguugcccagacuggagugcaguggcaugaucauggcucauuguagcuuugaacuccuggguucaagugauccuccugccucacccuccuaaagcacugggauuacaggcaugaaccacugcaccuggccuacauuuuuuuuaaaacaacaauuuauguaccuccuagagacaccagaccaguuugaagacuagccgucuucaacagucccuguagcaauuaugcucagaaaggcuuauuucuugagcuagcaaguaucugcccuaaaaccagguucauuaauaaaaugucuaucuuucaaaaaaaaauacuugaaucuucuguuuucccugauguuugugucuuucuucauccuuggauaccuauucuuauaacacagcccaugcucaucugaaauaagugacuucaagucagcuccauuauccugcauccugccugcaaaaaugaucuagauauggggaguagugcuuccccuuguucuauacacuauaucaauauaaguuguuagacugcaucuucuuuaaucaaagugucaucuaauucacauuuagccaucagaagcaugucuaccaaagagcaaugcagccaaauaagcuuuaugcacccauccuuagguuauacuccuuagcuaauguuacucuuauuuggcauugauuugauuuauugacaacaaaaauacccauguuugacaccaacuagccuugaugugccacuauuacugacucucucgacuuugcucccccaauuuguaaaaugagaaguccaagcuuucagugauucaugaaagcagaguccacugucagccuggccacacaacuagccccugaggaucuugcuaggggucaaaacccacauauuagaucugauggggcccuccaaauucucuauuuuaguaaguucccaaaugcuucucacgcaugucucuuacagaauagauauagcugaaacaaucuacaauauuauauacugaacucauucaaccauuagcucaaaggaaaugcaugcuaaaccagcugcacaauccacucuguggagaaauccagcagccacuccaagaagcugaccuccaaaggucauggagcaagauggagaugaagagccagccagggucuagaguucccacuuugcucucuuaccagcuguacaacuuuggacaagucuguuaaccucucagagauuaggauaucuuuucuguaaaauggugguaauaaagccuaccuuagagggaaauugugcaaauuaauuuuuaaaauacacauguaggccaggcguaguggcuuacgccuguaauuccagcacuuugggaggcugaggcggucggaucgccugaggucaggaguuugagaccagccuggccaacauggugaaaccccaucucuacuaaaaauacagaaauaagccaggugugguggugcaugccuguaaucccagcuacucagcaggcugaggcaggagcaucacuugaacccgggaggcggagguugcagugagccaagaucaugccauugcgacagaacaagacacugucucaaaaaaaaaaaaaaguguauauauacauauguguguauguguuuguguauauauaugugugugcguguguacauauauauauguacacacacacguauguauauguaauguacuuacaaaaugggaggaguagagacacucgggaggacugcauuuggcuuuauucauuguuccuucugguauagcagcuaacacacagugaguacacuaaaaaaacaaugcuuugaagaaacaaucuaauccaacuacccaugacacguguuauucauucagaacaguuuauugagaggccucuuugugugaaacacugugacaguccauuugcuccuucaaaucucuuccuccccuucuuucucuguucugugcugcagaaggcugaucuauguggacuacacugacaggccccuugguguucuggcuucuccugcaaguuggccagugagggcuucauaaggauaccaaaugagaggaaaaacaagaacuuggucugaucuagcagaaagaucagaccaaggccccaaucacagagaucuccuguuucucccaaaguacucuguuuucccaaacaucucuccuacuguguugcaguaccacucccucaccuuaucccuuugggcuugagucuuuaaaacuccacugcuuaccauccccagguuccuguacuaaccuugugguuccucuaaaccccaccagugccucucuauaucgucccuuuauaaagaaguucucuggagcgcagccucaguugaguguacccucucuuccaguuggaagucugauauaaacaauguguuugaaguuagggaauacaguaacaaacaaacaagucaugaucucucauggaauucuaacuacuaccacugucauaacaaacagcuaccguuuauuggacacauaucccauacaagcucuauagaaguuguauaccugagguugcuaucaucaucucuguuuuucaaaucaaaaaaccaaaccuuggaaauauaaaacccacaugaguaucaaccaacagaauuugauucacaacagaacucagauucaagccagagucaacccaauccacagcacacgcucauaaaugcugaaguauuaccacauuuaccucaacaaugucccugccaaauggaucuucaaugugagucauaagaaauuuuccccaauccuucuccccaugccagaucuggggauuuucagaaagccuagugugaaaauucaggagaccugaaaugugcccucuuaucauaucuacucaccaacuggcuugugaguuuccuccucuuugagcuaauaccugcagggaggugcgcgcuuccguaacuaguggccuuuguucuaaccaccaucucugccauuuuuccugugaaauuucaagauaaaugcaggcaagcaagggagagagcccuuggacacucuucucuaguauucuaggacuuuucaggccugccuggugagaucagguaccuuaucacuagcuucuacuugugcaaucucccaauuacacaagcgaucccaucuagauuuacaaguggccauccucucugacccacaggccagagaacucagcccacgcaauguuuuuaaaauagaccccaacccaggggaggcugacaggcacacagcugcaccaacuuuauuaaugaguacccagaccuuuagauaauugauuuccacuuugaucccagccuacgcauuucuaucucugauaucuaaauagcaaaucauguuaucuuacaauuaagugauaaucuucauggcagaaaaguugacaggucuauaaauggcuucugcaagugauuaaaauaacuuccucccccuuuccacccagcccuggaaauguucuacaacuucacaaggcuauuacuuguuaauaaacuccccaugauaugaaccucauucauauucaacaaguuuacauacuaaguuacucuccagaaaugauauacaucuuauuuuuuaugcuuaaauaagaacauuuuauuuauuuuuuauaucuauuuuuuuggagaaagggucucacucugucacccuggcuggagugcaguagcaugaucuaggcccacuguagccuccaccuuccaggcucaaggauccucccaccucagccuccugaguagcuagcacuauuggcgugcuccuccaugucagcuaauauauauauuuguauauauccauggcagccaauauguauacauuuguagagaugaggccuuacuauguugcccagucuggucucaaacuccugggcucaagugauccuccagcuuuggccucuccaagugcugggauuacagucaugagccaucucaugcagccugcaaguacauuuuauuagccuuaguaaguuacacaaagucagcaaaaccuuugacuuuaauauucaaguaauauuaagauuguuaaauuuugcauguauaugcauggauaugaaguauauacaagugcagaguaacuugaagaucaguguugaaacaacauugaguauuuaauaugaaaugagaauaaaugacuaaaagaagauaaguuuuacuucaauaagugaauugaauauugaacccugauaugguuuggcuguguucccacugaaaucucaucuugaauuguaguucccauaauccccacauguggugggaaagacuuagugggagguaacugaaucaugguggcuguucccucaugcuauucuugugauaguaaguucucacaagaccucauguuuuaagggacuugaccuuucacuuggcucucauucuucuccuuccugccaucacgugaagaaggacauguuugcuuucccuucuaccaugacuauaaguuuccugaggccucuccagccaugcugaacugugagucaauuaaaacucuuuccuuuauaaauuguccagucucggauaugucuauuagcagcaugaaaauggacuaauacaaacccuuacuaugcacugaauucuggggcaaguacccaagauauuacagcaaacaauacccaccaaucugcuucuauggcagaacugggccacaugcccagaaggcaaguaagaauuacucugcaaccaacugaucaccauaguaacugagcaucagguagaaagagugcugggauugauuagcagagucugugauuuggauuggacauagaaaugauauaguccauuccauguaugcucaaugaacacugcacaggugaacagauaaggcugugaccuccucugaggcaagcucccugguuauuccaucuccauauaccucaagacuccuaacacaguucuuugcacauaauagacauucauuuugcaggacagauaccaagaugaauugcuucaguuuguuuuuaacaacguaauucuauuuccaauuuagauaauucauugauuucacaccuuuccuuccugguuacucuauacuuaauuuucccuuuucuucuuuccuuuuuuguuuguuuuuuuuuuuuuuuuugaaacagagucuugcuccauugcccagacuggagugcaguggcgcaaucuuggcucacugcaaccuccgccucccggguucaaacaauucuucugccucagccucccaaguagcugggacuacaggugagugccaccacauccagcuaauuuuugucuuuuuaguagaggugggguuucaccauguuggcagggauggucuuuaucuccugaacucaugauccgaccucucaaagugcugggauuacaggcaugagccacugugccuggccucuucuuucucuuucuaaaagcacaucaauuuacauuucuacaucugcuuccuacaaagaauuuccucugaaugaauucaacaaguguccuguacauguaaauauauguaugaaucuuuuguaccuauccaugucaaaggguuuuugaagccaaacugaaaacuuuccuagacuacauguugauguucugaauauccacauuucgaggcucuuaacaaagcuguaucaaacuccuuuucuucugaguaauauauuauguacguaaaguccuaggagaugcccuaagucuacuauaagugaauuuacuuuuuguuuucugcuuugcuucauucauccugcuuugcuuuuuuucucaucccaaauauaaacaucuguuuuguuaucaaguuaaaguuaaggagauauaaaacccucucagauuaauguacagcccauuauugaauucuggaucuuagugauauccaauauauuaucaugaauuuuauagaauauacugaacuuuuaauucuuaucugauuuaucuucuuaaugaugcuuagauuuccauucaaaaauccugucucuucucacccuuuccacacugugucuguuuuugugcccuuuucuagaguuuuacauuucucuuuaggauuaucucucucuuucucucgcucaccuacauacacacaccacacacuccauguccaaauucacagucuaagcauuuuggugauaugccauuccucuucuaccuuuguuagaaguuccucuuucccauggaaucaauucuaccggaaaaaagugaaaaggaaccuuagagagcaaucauuaaaggugcaaagggaaagguccccaugucugggagugucucuaaccagcugugugauacgugccauguaauaucuggcuuugguuuucucaucucuaaaacuggaggguaaaacaagacuaugucuugaaaccuuucuaauucugaaauguucacuauuaucaguuaacauuuauugugcuuuucugcauggcaggccucaggcuaacggcuggcuauaacuagcacuauccaugcucacaacaacuccauaaggaaggugccacgguuauccucauuaugucacugagaaaacugagguucugagagguaaagucauuucacaccugaugggauauggauguaagacuggaacucagacggcaugacucucagguuacagauucugcaucacaugcucauaucaacugaucuguauuuuuauacaacuucaaaaaugaaaacacugggcaugugaccuauaaauaaugaaaucauauacaaaaauaaagaaacaccccacauuguugaaaaauuauuuccuuuccaaaaauuacuugaaagggcaucaguaagcccuggcauauuuguucaaaauacagucuuacugaauagggguguguguguguguguguguuugugugugugugugugugguguguauauacacacauauauauguguguauguguguauagguguguacauacauacacauacauguguauacauguauauagacacguauacauguauauacacacauacacauauauacacauauauguauacauacauauauguuuauauauauacauaugugacaauaaaccaguagaaagguauauauauacacauauauacacauauauacauauguguauauauacacauauauacauauguguauauauacacauauauacauacauacacauguauguauguauacacauauauacacauauauacacacaaacccacagucaucccuuggauugguuucaagaccccugcauauacaaaaauuagcaguugcucaauucccugauaugaaugguauaguauuugcauauaaccuucccaccuccucccauuaacuuuaaaucaucucuagauuacuuauaauaccuaacacaauguaaugcuauauaguuauucuaacauauuguuuuuauuugcauuauuuuuauuguuguauuacuuuuuaugguuuuuuucccaaauauucuugauccacaguggaugaaauucacacacgcagagcccauggauacagagguccaacuccauuuuuaaccaauacucauauucgcacagauucauauaaucucacacuuucaaguaacguaagcacuauaugaucccauuauauuaucagcuugucaagaaaacugccuaugcucuguguccuuuauaaaacaauguuccuaccuaauaagggcagcuacagccuuuccccccaguucucccugcuauaagguggcacccacagauaugucuccuucucuuuugccuaagaaggcccuuuugauuucucuuucaauccuguccccaagccugaacucaucaguauccccuacugcugccagucuaggagagacuccaaucaucuuccccuacugcugagacagcagccuucuaccugguagccucugcccuccucaguccauucuccacacugcuugcuuuccuaucucuucucaaagccaaucacauaggucccuuccucacuuaaaaccccuuuaugacuccucauugcaucagaaauaaaaucugaacucccuuccacuguuucagaggcccacucucaagcucuccacaucuauaaagugccaacuagucuuugccaguugucaaacagacugagcuuagcuuucucucaacccagaaccuuuacauacccuggcuccuugauuuggagugcucucucuccaucugccuucuacagucggaccuucacaucuuucaggcugagacagaacccuccuccagagagcuuuccaugucccccuuauuuagucugacccaagcccauuauucucucuucacucuucauuuguuuccuucauaauaauucugauugaucauuguguuauccaucuccacgugugugugugaacuauauucucucacuaucacacaagccuccggaggauggaaagcagcuggccuugcugauagauacaucccaugcauuuaacucagagcuuggcucagguuagauggucacuaguuauguauuuguuaaacgaaugaacauaugaccucagaucuuuuugccuuaagagaaagaaaaguaaaccauuugaaaaggggggaaaaauuauaaggcuagcaaaaguuaaugguauuggcaaacauuacuacaggcccuugauagauguuaaaagaauggagaaagcccuuuaacauauuuaauauaucaucccuaguuggaagauacuuuuagaauugugccuaugcccaaaaguuaauaaaugggugaggauauucugugugacuaagaggggcuaaugaauugauaaguauuucugugagauuuacuggaugguugaaaaaucucuguacauuuuccccugauugucucuaccuuucugcuggcuuauugucaugcugauuuuuauggaucuacauucaacagcuaagguaaauaagguaaaaugccagagaauaauccaccauaauauaguagaaaacuuuuuuaaaaucaaaauuccuguugcuaaacccaccaucuaacaccuuuuaucacauuugagugaucuuuaaaagaacaucacacuuaaauucgcuuuugaguuagauuacugaagacaaaugacauacugaaauagcaucuaaaagcguuaauauacaaacaucuacccaauacagauuuaaauauagcagugacuguacaccuaccgaaacaugaaagacuaccaggagacagggauuuaauguggauugauacuaaaaagcuaauggaaauccgguggucuuuaugauugagauggaacaucuuucacggcucuuaaaaccuuaggcuggacagugaagacaugggcuggugcugaugaaggagggcuauaccccaagccugggaaucuggaaaucugauguguucggccagagaaacuccaaaguucuccguguuucugccuuucucuacccccacaaacuucaauucuucccuugcuaauaaaauacuggaaacugaguaauaaaaggcaaauuucauuucaauccuuugggcucaaagccagcucccugccaaaacuucuccugccuggagggguagagcagggaaugaguuggggcaagcacagauguccugcuucuacucuagagggagagaucugcaaaggguauggcucagcaucuugucuaccagcuaaugugauucauaaauaaaucacacagggagaagugugggaggccccugugguucaauucuuuaucucuuuuucucuuccccaguguggaagauuguccugagaguguggggaccagggggcagagucaccuacauggucugcuguacagcagcucuggcagcuuagcacaacccauucacauacugggcagagcccuuccaauguuaaccucugccagagcuccuccugacuuuuuuuuuuuuaauccuaaaagaggaagcauuucaaaugaccuaaaucuaaaaauagaguacuucaugcucaugacuauuuuaaauagcaucuaaaauaaagaauuaaaaaaaaaaacauguuuccauuuuugugacaguuuccccuucccuugaaaaaaagaaaauacuguagagcuugucauucaaucuaaaaucagacuucgugccagcuggaauccuagguuuauuuauuacugugcacaguucuuacauuaacuguuuguuaaagacugauuuuaccaccacugagacacaauguaagugaaggucuuuccauguuuuaccaaaaagagugauucaagcaugacccguccaggagaaaugauauuaaagaaaagggacagaaguacuacucagucacugauccaacuauauuucuggagaaaucaaguuuaaacauaaguaauugccuaauggaguugggccaagguggagauaggaaaauauccaugacacuuccaguauuugcaaaacagguucaaaaauaaaauugcaacauuuuauggucuguaacauacuuagucacuuagucgcagagacaucuggaaaaagauaauccaauggggcagguuuuuauucucuacuuuagaaaauuguucacauuuauucccuaucauaguuucaaguagaaugguuauaauucauccaauaagcuuuuuuaaaaagcagggaaucacaguuucugggcguggggcccacaggccuuuacaaaacuucauagguuuauaccuacauaggucauagauugugaaugacacacaacaugaugacuauguucaugaacacacaugcucauauacauauauacaugcagucaagcucaaccuagauucacaaaucuuacaagguuuuacuuccacaauaaugggcuccuguucagucucucuugccagccaauccuccaagagagacaccgacaaauguagacacguaaacaugcuccuccaaacauggaauagcuaucacuuauuucaagucaucaaacguaugagucagcuguaucuugauacaauuaguugagguucucuuucaauguacuccuuagacacucuguggugucaagcugugguacuauggcucuuucacuagcucauuaccaccuccagcagagucugccuugguauagccucagaggcacagagcaagcacucaauaaauauggaguagaggaaagagaaagguggacaggaaaaaaggggggagggaggaaaggagaugaaaaaggauagaagagaaagggaagccagugagggagugaauaucuagcugagaauggaggaggaaucucaaauaaaaagggcaaagucagaggacacucagaaaaacagaaguggauggacaacagugccacaggaacucaaaggugcaauguuuucaaaagauagauagauuccaaagauggcacccacugaugaagcuuuucuauuaccagggucacauacaaacaaaucaauucggcacccagggcugaggugguacagcgucacguccuuaaaaugccuucagggaccaggcaaauagcauaaauauaagauuauaggcgagaaaaugcuuaaguuucaagcacagcaucuguuucaagcagaaaaacugugcagaucaaacagcucagcccagacucuaucccuacacccuggagcuaacaaaucaauuugauucaaauauuuguggaauaccuacaaugggguuuuaaucacaaaacuuuacuugaacagcugcaaccucuagccucuccaggcuucuuuccucaucauggggagaaaaacacaaacauuucaacauuuguugagaggagaagagguucuacaugaaguaacccgacugacuuauuuguacugagaaaggaaaagcaacuaacccugaccuaccagaacuucucaccucgggcaguggcagugagcagaggucucagcagcaggagccugcacaaccccaaaggacauagcagagacuccaauaccaugucugaagcaacuucuuugaaaucaaaaugcugaucuucucacaugcugauuacagacacuuccauuaucaaacagaagaauuuggggcaaaauggauucuuaauggugucuguuuccuacauuuucuuaucaguagaguggcucaaaaucuaaauccaccuaaacuguccaucaucgcccccuccccaccaacaaugcucucauuuuauccuguauguguuuuuauaaaacgucucaccaucuguaacaauauauguauuugaguaauugcugguuuacuguccauugccuccacuaaacuguaaacuccaugaggucaaguacagagucuagacuugcucaugacuaaaucaccugcaucuggcacauagucagcaugggauauauauuuaucuguuggcccaacaaauaugacucuugcugcuaucugauuuuacacaagcacaccuccacuggcacaacacaaggagaggagaagagggaggcaucuggagagcucaaugucaagguuacuucccagcugccauuccuuguguuuccugaaugcaaguguaacuaguaacuguacuaacagagccaagggcuauauauucuucuucaucccauaaacagaaaaauaaacaguucuguggaacugugcaaacccaacuuaaauuucagauuccagacccauuaucuggcacccuuugcucagaaauacuuuacuaccacuagaagacaaucuaaccccuggucucacauaccacauaaugcugaaauucuuccccauucugucucaaaccugcccacaacuccguuucaugagggcugagccacuauccaauuucuauccuuauagggguucgguuuuagacuaugcucacaaaucccaaauucccagugaguucaggaaugaugcuuccuuaccuuaccuuacauaggaccuugaagauuucuauuacccgcagauguaacaugcaguuguuaagaccgcacauugcaucagcccacgaaaugaguugggggcuauccagccuggccccucucacgaggccauguaccuugugggggagcugugucuccacaaaaggaguaucuuuuucuauuuuauacaaacaugcccuauggauuaguaacagucugauacuagaaaaaaggaagcucaaaacuucacaggacauggcaaauaaaacccagugaccugauaagagguacaauaucuccuugguuuaauauuucaccucuucuaauuagaauaaaauauucacuaggaaaaauuuuuaugauaguguccuuuuggcauuagcaugaauaccuccaaggagccguauuauucaaacaauuuucuauuucaaaauacacagguaguaagaacuaacaaaucauuacauuuccaccaaaugcacggaaacaacaaacuuaacuaagaaaauacugaagcagcuuuucccaacgguaccucgccucccuagagcggaaugguuuucuuuuaaggaaucccuauugaugccagaaccaccuuggaagaauaauuaaugacauuuugaaaacugaacuuccuucucacugccuuucauaaugcaaagugaaggggaggcggggugagagucccccaggaacacacaaugcauuuuuacaagagcuucuaaagccccucagugagacagaaacacacuuucucauuuaagcaaaacuuuagaaaacuaacaauuaaaaugugaguuaaacugaggaaacaucuuacaucugugauucucccuccagaauaauaugacuagguagcuagcugccagacacucuuguuucagcaaucaugugacuaugugaugagggcuggcuucaugauucagguggaacugaucagggcacugacacugauggagacaaagcuugucaggcaugauguccuuguaggcaacaauaccugaaacucuguuaggaaaucugaggucuuuggauagaaggaaggaaauaagccaaaggcuagagucacacagucaguaucacuucagacaagucagcacuggaucaaccucuucaccuguaaaaugaggguaagaauauccacucaauaaguauaugauaaaaagaaagugacaacacaaaguguaaaugaauauuuaagcaacaucuacacauaagagacccuaaaugaauauccguugaaauaaaagcaaugguuacaugcuucucauauccuguggcccacugaccucauuagucauuaucuugaccagcuccacuugcacagcauuaugaauuacaugugugcagggcuauucaauugucuaguuugauguucuuaaccuugugaggcaguaaauauccauuuuaaagaugagaagacugaaguuuacuucacaaucuuaguggcuccaaucgaagaucguccacuguaaaauucaguuaucugccucaugauuucacggcuuauggcucuauggaaguucuauucuuaacaugacgcaaaggaagucagaaguugcaaaacucugaguuagauaauuaagccaugaaaagugauugaugcuaagcaucuguacacaacaugugaaccaagggaaugagugacuagaacccaaagagaguuuggaguuauuuggcugugacugagaaaugaugggcuaggaauccagguaacaacaacaacaaaaguaaauacacauugucucuccucuuugagaagaugaaagaaaacaucuuuuucaguucaaugaugcuuccuguagacagaaauuuucucauugaauggacaaaacuagcaagugcacaaguuaauaauaaccuuuuacccaagguuccauagcaaguuccacaugcuaugcuaucaucuaggcucccugccugccucuucucauugcauccucaugacaaccucauaaguugucaugcuaucuccaaguuuuggauagagacugagucucaguagagguaaguuuguuuuucaggcaggguugagcuuuucgaaguacagagagaacuggggaauggggugcuucaaagucacugaaagagcugaagcugugggcucuagaaagacauccaggaugaccacgaggaguaccacuacuucugccaccaucagaaaggcagagacucaggaagucaccaacagaaucauuauuagaaguagacugucugaauuaugaacauggaucagaaagcugcugucaccaacacagccuuugacuuuauaggaaagccacacuagcaacaaaauaaacgcucuauccacugcuucucaguggcccuucacugaguggccagguacugaaagaugagugcccaaaagcccgaugucuccuccaauguucuagccagcaaagaucacagagaauacagaaaguuggcuucagucucaauucugucuuccaaaacucaaacaagugcaucuaacuggcaaacaaggaaucagauccagggccuuagcuguaaagcaucuggaaauguaauguuugaccuucccgccuuucaguacaggaaggcacgugaugaggaggcuagcaagguuccugagagcucaaucacugugucuacuucaucagauuugccaucccauagcugauuccuaauuaaagggagugagaaccaaaaagggggcaaagccaaguauaugaguaaaugcacagaaacaugacagacuaauuuaaccagagaacuaaaaaggguuuagcacccacuaagugaagagugcauuuggaaacaagguggaggauauagcuggagaggcaagaaaaggccagaugaugaaaagucuaucaccccagcuuagaagcuuucucagccuaagcuaggauaucccuucugaacuucuuagaagccuugcacaauccucagcuacucauugaucacacagaauuguaaccauucauguucuugccugcuuuacuguucccccugacuaugagggugggaggucaagggaaaggaggggcuauuccacuuuguauuucuagaacauagcacagugccuggcccauaaacgaaagcuccagaaauacguguuguauggaauuacgucccgagguuccuuccacuaucaaucaucuacuuaaaaaggagaaaaugcucucuuuaccuuaaguaccuuucauuauuaaaaaaaaaaaaugguuaacuauggccacgcaauggcucucaccuguaaucuuagcacuuugggaggccaagguggguggaucaugaggucaggaguucacgaccagccuggccaagauggugaaacccugucucuacuaaaaauacaaaaauuagccgggcauggugacacaugccuauaaucccagcuacucaggaggcugaggcagagaauugcuuaaaccugagagacagaguuugcagugagcagagaucguaccacugcacaacagccugggcaacauagugagauuccaucucgaaaaaaaaaaaauugguuaauuguagauuacagauugauaauuguaagaauauauuccuauagacauauuuuuguacauuuauguacaguaguagacaaauguuguuucuguuaacugaaccaccauucucccauucugaugauagugccucaauuuuccuguaggaaaccacagcuacuccccucacaugaagaaauucacaugagggguaugaccucagcccugggguuucaguuuggcacaugacauggcuggaucaaugaaaguucuccgugggauucuugauaugagcaacuuggcagugagggggaaaaaguugcucucuuaugcugagauugcuacuaguggcaagauaguaacauuguauggccaaugaccaccacaugagacaagguguccaaagaaggcaacauggaggaaucagagcccauggagggaaagacacagacucuauuuuuuuuuuuuuuuuuuuugagacagaguuucgcuauuguuguccaggcuguagugcaauggcgugaucucagcucaccgcaaccuccaccucccagguucaagcaauucuccugccucagccucccaaauagcugggacuacagguaugcaccaccacgcccagcuaauuuuguauuuuuaguagauacaggguuucuccauguugaucaggcugguuucgaacucccaaccucagaugauccaccugccucggccuuccaaagugcugggauuacaggcgugagccaaugcgcccagccgggagagacacagacucuuaacaacacugaguacucggaucuagggugucaaagcugucaucggucaguaaauuucuuuuucuuuuucuuagaaggucuaggaugguuucagucugguaacaccaaaagaaauucaaaguuuuaaguuuaccauacauaaacuauuaguugaagaaauggcaaugacuaaauagcagaagaaugaaacucagcuuugggggacaucaaucugucagucaucuacugugcagccauuucgaggggggauaacuggaagagaugaggcuaucaccuggacauucuuaagagaauuaaaacauaauaagcccucucccugucuaaaugcacagauaauugauuaacagaaaaugaucauuacuaaaauggcuucagaguuuuucaggguugugggaauuacaauuguucugaaagaaaacugauuacuuacaguuuccuccuaagauuguaguugugcaguaaugauauugagacagcaugaugcccauuaaaaaaaaaaaaaaaacacugaagacuuuacaaauaacugagccaaaugagauauugaaaaaucaaagcgagaaagucccaucacuaaaaguauacaaauacaugagaaucagccaguaaaacaggaagucacucucaucuaaaauggccuuugcuugucaucaaacucauauagaauuccuaaaaucugucaguguaguagcuucuaagugauaugucaacaaauauauucacugagaauacuuauucugccuagagccaauguuuuuagaaaaacauccuaaagagucaacuguuaaaucacuaaaaugaauguuuugagcagguguuuggaauugugcugauuuauccauauuuuccaguuuaauuuccacguuuaccaacaaacuucagcaagaaaacauaaaauguaccuggaaggauuauguucaucauaaauacaaggacaguugcgcuaaacauaucuguacugguaacagugauucauaaaccauauucauuaaccuaaauccuuaaaguuuucuguuuaaacuguagugauuggaacgccaagugucagaguuuaaaaugguauuuuuaagcuauuagcaguugacauuuuaauuaggcauauuuaugacagacauggggggauaaaaaagaagguaagcaaggaauaaaaggugcaucaaggacacaagaaaagagaaaagaauuaccauccauuccuguuauccuuuucuuuuagcauaucaauaggaaagcaguauaacuaacuggucaagaauguaagaucuaaagccagccuuuaucagcucaaaucaugacucugauauuuaccagcugugagacccugaacaaguuacauaaacugcaucuguuuccacagggauaaugccagcacguagcucauaagguugcugugggaacugaauuggguacugcucaaaaaauauguugcacagggcccaagaggaaagaaguauucaauaaaugcuaacuacuacuauauuauuuguaaccuuacuuaccgggucaagggcuaauagugguaguaaauuguugcuuaaaauuuuauuuauauauuucuucuugaaccagaaaagaugccaggcuauuuauuuuuuaauuuuuuguuguuguuauuguuuuacaaaggguuucucagucuguuguccaggcugcagugcagcagcacgaucauggcucacuauagccucaaacuccuggguucacagagugauccuccugccucagccacccaaguagcugggacuauaggugcacaccacuaugcccggcuaacauuuuugcguuucuuuuuuuuuuucuuuuuuuuuuuaagagaugggauuucacuauguugcccaggcuggucucaaacuccuggccucaaaugauccuccuagaucagccacucaagucacuaggaucacaggcucagccacugugcccagcaugcaagacaauuuaagaggcauacaaaagacaaaaauauaacucaacuuaagaacagauuaagaauuaacaagauaagaauauuuaagaauagguuaaguaaacaaaugucauagacaaaacuagagucaggaacaagacaaaggauaagaaucacuuagauauggcugcucuaagcagcuacuaguuugucuucagcuuucuggcauccaacacaagaaagaaaacugggucugcggcacaauuuucaauauucgugagauuaaaauauacuaaaugcccagaaagagagaguacagugauuuuguuagaggccgagaacauaaggaacuaaggccaugcagcaaaucuucagaggggcacaucauagccacgguagauagcauugccaaacucaauuucuuagcccuccuuguauccacaccuguauauggccucuggggccacacguauuuccccaccucuucagucaaagcuugguccuaggacuuccuuaggcccugauauauggggagaagugacagugcaucuucacucaguucucacccucugccuuaaaaggucuuaagcauuucugcuugccuugcugcaucuccacuacagccauagaaguaagugacauaguuggugugguugcuagucuaagggagaugaaaaacacaaagcaguauggagcagagccauccacugagcccagccuagaucugcuaaaccccagaugauucacuaagacacaagcaaaaauaaaugauuauuguuuuaaacuucagaguuuugggauaauuuguuaugcagcaauggaaaacaaauucaguaacaaaaugaugacacuuuuuaaagcaguauuucuauugccaacuauaagucaaacaguaugccuucuaaauggcuuaccauaaccuaucuucauaacuuugauuucuaaacuuauuaaccuuguuacuguaauuucagagacccucaacaauuaauauaaauuaaauuugucacucacccuacuaaaugaaaguacucuggaauacagucaccaaaauuaaauaaagguugaggucauaggccuccaaauacaggccauacagcauaagcaaaauuaacugggaggugggguagggaggcaagcaguaggucauaccuuaaagagagaccaacggcuuccaaaguaacaacacuaggcaugaaaguagcccauguguggcccucaggagagcugccauguguaugaagacacacuggacugagaaaucagucucuucaaaugugugcuuuauucaaaagauaucagggcagaugucccacaggauuuguguugauuugaguugcuucucacaugagcaaagcuauccagcauccauacggcagaaguuguuauggggacuuauucauuuacacauggauaaugaaacucaugagcaaggcuggggagaccaacuaacaacucuaauaacaacaguaauagcugaaucccauugauauggauggugcuagucacuguguuaagcacuaagcaucaauuauuucauucaauucauugaacacucauaauaacccaaggagguaguuauuuuuauucauuucuccaaccaacuuugccuuuugcuuuuacaggcaaguauucuggagcuuggagagacugagggaccuggcuauaguuacaaaggcaccaccuuguuugacaggggcucucaggcaaaauuagaacagguaaacuugauuaguauuugcuuuagguaagucuugaacauuuucucaguuaacugaagauuuuuuuuaauguuuauguauuuuuuaaugaauacauuauaauuguacauaauauuuacgggguacaauuugauguuucaauacauauccguguuguguaaugauccaaucaggguaguuaguauauccaucaccucaugcacuuauuuggugaaaaccuucaauagccucuuuucuaguuauuuuguaauaaacaauauuuuacuguuaaucauagucacccuaccaugcaauaaaauaccagaauguauuucuccuaucuggcuguugauuguaguuuuaauucuuuucuuaaauaugaagcuucuguaacuucaacuggucugugaaaauauuaugccaaauagaaagcacuuuuuguaaauaaagggcgugugaugcacuaugaacaccucccaaaugauuuggaggaaaaaaacaucaauuccagugauauuguuucagauuaucccaauggucuagguuuauuccaaagacuuugaccuaaaucccucaguauuccccuucaacuaacucucaacccauuugaaaucuuauucauauguucucacuguuagauuguccaccuacaauuuuuuuuuguccuuugaauuacuuucuacugaaaauaauacacagaccucgguguuauuggaaauugcauugugaauacacaagguuuuuugucuaaauuuuagguaguuuucucuuucuguugcuaccucaaagagauaacagauucugcagucacauuauauguaaauuauguacaagcuucaccacuugggcuuguacauuauucuacugauuuucuacaguggcguggggggcacauaauagccagcaacaaauuauuagaaauuaaauucaaacccaguguaugcuggauaugagcauuuccaaugcauuuugccuccaauuuaguucagaugacuaaaaacagaccugugggacuguuuaaaggcacuaaaucuccacagaaucaugcagugcuaugacauaggcauucuguucucaaauauucaucauuuaucagcaacggaaacaaacauaggauucacaugugcaaaguaacaaaauagaugguccuagcugacauaccaguuugacucaacugacuauuacccuuacaaugagcagcuucuuaaaccacacuuauccugguccccuuuaucuauguuagagaaacaagaccaucucuacuauuaauucugucucaaaacuucagguuaccuaguuuuuucccucaaagauuauucaucuucgacagucaccacugcuucacaaaacagauuuuauuguuuucuuugccaauuaagggcuccccaagaacagugaauaaucugucagguuguuauaaaccaucaaaaguucuagaaaugucacauuaccuccuucaaauauuuuuuaacaugcaacagggacauacagcuuugucaucaaaagcuguauugguuuccucauauuuucuaaucuacaccauaaagggaagauguuuaucauaauggcaaaauaaauaauuuagccaguccaaaucucuuacaauugcauguggcaaaccaaagucaaacugaaggagaggaggguggaauagagguuaauuugcucacaugacaagaagccuugugacuuuauuuaggauaggucuaggcagugaggcugguaaacauuuaacaauauacucauuuaaaaaaaaaaagggcaggggguaggagggggcugacuugcagccaauuucaagcuaccaacacgcugucaaccagcucacagaauuccugaacauuuaacaauaggcuauuguaugcugggaugagccauccccagcaugauacuagauccagcuaucaaacaauaucauaaacaccccauccucucuucucuuuuuccugcuuuacuucaucugauuucauucucaaacagauuuacucaaagaugacugcagaggaauguucucagagggcucuaaauagguuggcuuuggaucugcccucuuaaaacuaaacauuaccacagaggaaugaaguauucugaucacccaguuugggagcuagagagaauggggguagcuacguucaaaccauuuggaugaggcaggacucgccugaaaugggguaaguguagcccuccuaagaaagaagcacugugcggaugaacaucaugaacaccauccaaguuucaacaugucugagauuaaaucugcagcaaaaguuuacuccauuucuggguguguaaagcagcuaaaacuuccuaccaugcguccgcuauccauggaaauccggaacaaaagcuuaagauccaagaaaauaaaauguguuuugaagaaaaauaugcucuugcaacauaaagaagcugucuucaguuacaaauagauauaaaaugugaagauauauaauugcugcauaaauuuauuaauagaagugcuaaugccauaaaucguacaucuccauuuugacacgcaauccuuuauuuuccuuucacugaggaagaaaaauaaaggagcggaacugguaauauugcuugcaacuaaauuggauuuuccaccagagaaagcuguuuagaaaaagcuauucuaaaaaagcaaaauaguacucacaaaaggguauuaaugaauccaaccaggaggaaaaagccuccaacaauacaaagcuuuccaaaaccucuuucaggacugaaagccaaaaggaugcuuugaacucucugucuuugcagaaaccaucucaccuacaaaccgaguaugagauagaguucaaauuuuagaauaagaacucuuaauucaaacuacaagucuuaacugacgauucaagaggagagacugcagcagcucuggguuucgaaggaaaccgauacauccugcccucaaacugugaggcacuauaggagcaagauguaaaggaugcagugccuuugcgcucccaccuccgccaccgugggugucauaauacagaggugaaaguucaacaugcgacagguagggaugcagcagacucuguggcuuuauacugcauaggucuuucacugcuuggucacagaauuucuuugaauccuauuuguuuauacacugauauuuauguaauaacaaaagaguaaguaaagagcaaggaaacagccaagaaacccugagcaaauuuuuuucccccuaagaauaaaggaguugaguuaggcuaucuucccggagcuucucuuuaucgcuagaugcagucagcuggaaacauaugccugcuaauugcugaaugugugccucauggagcaacggugcaguugucgaacgaccucggggaaacaagucuaggccuauuugugcauuucuuucuuucaccaugggacucaagugcuucgccaggccacuauuaggacaguggaaaaucaagguggaaggcucugaugaaaucaauuaucacuaaguuauuuucacuggugaagggguuuccucacagggguuuaauaguaaauuauucuuuccaugggaugugcuagauuaauggaggaaacaaagcaaacaaauguugccugguaagacuaagaggagggucccaaaauacuaauauuuacugcccaugaagagauagccacauucacaagaaaauaaauguaaaccuacaauuccagaggcgaaaaggaaaaagaaaugcuaaauggcaguuauuuccucaguguuauacauuacacauaucaauaaacccuagagucccauacuauacaugccauauggauagauaaauggcauaugugguaauagucuuucaaacuggaugauaguacuuugcacaagucagggaugcagcaauuguuugaaaauagggaaaauaaccauuuucuagcauuaccuagugaaauguaaguguggguacaguuugggagaaucuguauaguauuuauuuuuauccuagcaaacuauacuuuaccuuucugguagaauuuuaacuuuggauauuuuacaaauaucauauauagucuugguaacaucuuuuauuuaaaaucacaaauauuaguuggauagauguguuaagggagauuuaccagacugcauacacaaaggaggccaucagacaugggcaucugaauugauauagguuacaccacaccguaguuaaagaccaaauaucugccaguguucccaauaaggaaagauaacuaagauaaaagaaugucucuugcagaauuaagaccuugggauucuuuuaaagccuggguuuacauccuuugcucagaagagaaagacacauuauuucaauauauuuucauucauucuuaggcauuaacugucuuaauaaaggcagugcuucucacuuaaaaaauaaauuuagcuuuaacaaaguaaguguaaacgugacccuaauuuucacucugcuguccuuucuucccuguugugcuuauuagcugcugcucuuugaccuugaacaguaauccuuugagcaugccuccuuccaccaucaagaggagguucccuacggucugguaguauuucuaucauaguuguugacaugccagggaaaauaauuuccuuuggacacuauaacccuucucgaaaccagcuccuucaaacaacucaccuaauugaacgugaaagacaugaaaccacuggugucagaaauuaaauauagguguuucuuuguuuucuuuggcauuucuucuauuuacuuucugucaucuaugccauaggauuuagaaaggaaagcuauggaaauaggcaccaucaacuagaacucaaagagagaauuuuguaugaggaacacaguccaccagcagaaauagaauaguguuggauauacucuucaacaugcuuuuuuuuuuuucaggaucaauguugauggacuguauugaaaacaaaaggguaauucuucuauggaguugucuugcaaaauucuauucuaggguuuugucuuuguccuuuguaagcacaaagcaaaugagaaaacaaguauaugguauuuugaucaaaauauaucugccauuaaaccuaagguuccggagcuccaugguaucuggaagaugcuuuagaggguagguagccugaaggugcugcggugccaucaaagggcaaugaacaucuguugccccauagccccuuuccuccuccuccagcaacaacccugacaucauuugggaauucaaucaucuccuccucucagucuauaaggucgcaguagaauuccauccuuagacaugaagaaugugccucaggccaagcuaagaggcacaucuuacuccccuaugccccuaccccccuaccccccuacccauagagauuugcugugggauagacacaugaccuaauccauucuaaucagggugacucucaggaugucuacaggagcuauaaugaaagaguuguaaugucuacagcagaaauaaugucuucugcuggagcuucugcagccauccugccaccacugguuaggcuggauaaaaggcaaaccuuuaagccuuuuuuuuuuuuuuuuuuuuuuuuggugaccaaguuuugcuacuuguugcccaggcuggagugcaguggcgcaaucucagcucacugcaaccucugccucugggguucaagugauucuccugccucagccuuccugaguagcuaggauuacaggcaugcgccccccacgcccggcucauuuuguauuuuuaguagagaugggguuucuccauauuggucaggcuggucucgagcuccugaccucaggugguccacccaccuuggccucccaaagugcugggauuacaggcaugagccacugugcccggccugccuuuaagcauuuaaugggauguuaggaauacgguacuguaauuucuccuuggguauaaaauauauuggagucaaucacuguugccccuacccuaguggggauauggcaaugaucucaccccauaaggcaaacacuagaaauuuaugcuucagaauuccaucuggcuuugguuacuuuuugauacuuaugauuauuauuuuuauuugaaacagaggcucacuauguuuuccaggcuggacuugcauucuuuagucucaggugauucucccaccucagucucgaaagucgcugagacuauaggugugcaccuuaauuauuuuaagaaaagaauguaauggcugggugcagucgcucacaccugcaaucccagaacuuuaggaggcugaggcgggcagaccgccugagcucaggaguucgagaccagccuggccaacauggugaaaccccuucucuauuaaaaagauaaaaacuuagccaagcaugguggcgcaugccuguagucccagcuacuugggaggcugagguaggagaauugcuugaacccaggaggcagagguugcagugagccgagauugugccacugcacuacagccugggugacagagcuagacuccgccucaaaaaaaaaaaaaggauuuaauuuuuaaaaaucagcaugaacugaaauuuacuucacaauggaauuaaagacccccaacaagucauaauaugcuuauauggcaauaucacauuguuugugugaguuauaaaguuggauggauuugcacuggcaucuuuucacgguuuuagugagagaaucaugcaucauccaaggaacucugauguaaaagacuggacaugagaauuauuacagcuuugaaauucugucaauuuccuacccauuuagucagauuuaagaacaguaugaaccuaucuuacccaaaaaaauagguucuaaagucaguacauaaauuauauaaucaugugauaugacuuuaucauaucaguuuacauuccugaauauaauaugguccaauaucuucaaaacauaucaagacucugaucacuucuuaccauucacaccauuaucaucaaguugaaaccaccaucaccuguuuucugaguuacuuccaaagccuccuaaucaguccaaacuuagucccaugcaauguauucuucaaagaaccaguaaauucuuuuaaaaaauaaauaaacagaugagaucacagcacuacuuaacaccucuaacguccucccauugcaaaaucuguaccgugacuuacaaggucuucucgauuugauuugccccaucccuauccaucuaaucccaauuccuaccacucucccucucucucacaaagcuucagccccacugucuuucuugcuguuccuucaacauuccaagaucuuucucuccucgggggcuuuaaaccuuccuaccucugccugcaauuguuuuccucuuaauacuuccaaggucucccuuuugaauccauucaguuuacugcaccaaucucauaucuucaaaaaguuuuuccuagaccuccuaacaaaaauaaggccccuuuccuaauacucacuauccccuuauuuuccuccuagcaccugcaacuauauaauuucccuguugacaugcugauuauccaucuuauccacugaaauauaaucccuaugggcacaaguacuuuuguuuauuugcugcugaaucauagcaucaagcauagagccuggcaccuauaaauugcucuauaaauuucuggugaauaaaugaaucaaucaauaaaugaaucuuccaacaacaugaugcaacacagaccaacguucagauccuacaaggucuaauaauguggcuaaaggggcaccuguucuugguucccuuuggugaaaaccugauaaucaaugaauggcaagcauauuuacauauuuaaaaguuugccugcaagguaaucuuaccuugaggcuguguaauaggaguaaguaucuauuagcucguaggaagcacaugcacacauguauguacacacauaaacuacucugaucucucaugucuucaacaacuugacuacauuuuuaccugaaaaaauuauuguagcuauuacuaaugugaugcacuaaccagagagcagaaacaaauugaguuguuuguuucuccaggagggaaagcaggccgcagcuacuuccagaaggucaagagaucaggguaugaauaccuaagacauguguguguauauuucugccacagggaguuuucacacaauacacaaauggaggaucaacuaacaggcugccagucaaggggagauucaagaaguuucaaagaaaugcucugaaccccaaaauaacaaaggaaaacauguuuugaaaaguacacaaagacaguucucuuaaaaaucugccaggacuccuugccaaaauggcauguuacacauccccuucucuauaaccuauaccaucugggcuuuccguaccccaccagcaggguguaagaaugccuauucauuugcaccccugcccauauaaguuauuauaacuuuuuaaaaaucauucccaaaccuguagguuaaaacaugaugucucccugcuuuaauuuggaggucucuaaguugcuuacgguacaaccucaggauccauucaugcucauuuuguagcuacaaaagaaaaagcucuaaaggaaggccaagugaaauccuggacaugcagugugaugaagaaauaagggcugcugcuuaaccaagagucaacucaagcagucucugugaaguucuuucucacugccucuguuuauuuuccuccucagccaacacacgacuaacagcagcaucuugaauuugcguuacaauuuaccaagcaccuuuauuuuccucaaugaucuucauaaaaauucuguacuauggauaagaugacucuguuuuccagaugcagauccagaaaauggacuuucccucagugucuccaguuauuaaguaguaaaacccagacuagaaccuguguuuucucauggccucuucaaaguucuuucuacgauggcauaguuccuuaagauaaaccgagugaaagaaagguaacuuucacucacaauucaccagaaaaaaaaaaaaaaaaaaaaaagaggaggugggggagaaagaggugcuacacucagcugagcccaccuguuugguuucuguuagcuuugaccaaagugccagucauuacacuaaaauucuauuuugagguuuaucaugaauauugguuucuacaaaauucuucauuaauuaaugcuagaaaacacagcucucagucaauugccauggggcacaauacccaggcacugcuuuucuuuguucuucccagucuuagggacaccaauccagauagaauuacguccaaaaguagccuaaggccacguuuaugaaauaaaaacaccaaggacacaggcugauuuuagggcaaauuuuaggucuggcauuuuaucauucugcucuagaucuagggguuaaacucuacugaaauaacuaugguugcuuuugguggaaacccccuuccccaggcccuuccagcccuggccaggauucaaucauccauucaacagcuauucacuacacauucacauugugcuaggugcugggcauacaaugaagaacaagauagacacugcuuuuguucuuuagagaugacauacuaguaagagagacacacuaaaaacaaguaaacaaacaaaguuaugauugacuauaaguguaauacucuaaaggaaacaaacaggggcacuaauggagaauaacgaaggcaccuucuuuguuuaggguggccaagcaaggccucccuggaaaguaaguuaguaacagaacugccauuaacccacuuaggccuaguguuccauuacuggaaugccaagcaugugggaguuauccauauccuacugcucaaagucaucgccaaggucugauuuuucacucaugcaaaaauucaaaaaauuacaaccuccggcauauaugagucaauaagcauuccuuccuugaccuacacaugcuucaauccauauuauuuuccuuaguagguggcugaugaacaggucaaaaaccaaacaggccaugguagggauggcaucaggcauaccgaaaaauucugcuuuagaaaucagucaugaaaggucauuccaguuuaaauuacaaucaacauauagaagcuagaaacuccaaucagggcaaaaauggccucuuuauaucccaucaaggaaucauuuaucuaagaugacaagagguauauugccaacaaauccacaauucuguuuccaauuaaugcaaacuuauaauauuccaagcuguuauuagauuucaauuaauaaccugugaugccucauuaaugcaaauaugcucuucguggugcuaaaccuucauuagugaaauggguccaaugacaugacgguuucauaugauaauggaacuaugauuaaaaggcacaauuaaucauuuucuucuacuacauaaucucugugacaguuuacuuaugccuauaugaagcauuuguuucuugcaaacagucaauuuauauuuaaacuauucaauagcagaaagaaaagcagaaauaucauacuaaauuaucucuaauaguugcaaagaaucccagcaccaaguuagguuguucaagaauaaggaccaggcacgauggcucacauacaccuguaauccgagcaucuugggaggccaaggugagaggaucacuugagccuaagaguuugagaccacucugggcaacauagugagaucccaguuuuacaaaaaaaaauuagccaggcaugcaccuguacucucagcuacucgggagacugaggugggaggaccaccugagcccaggaggucgaggcugcauaagccaugaucaugccacugcacuacagccugggugacagagucaaaaaaaaaaaaaaaaaagucacagagcuggugccauucuccauuaagagcauaaagugugaaacagaaaaucucagucacacggcugucagugcuuuuucuuucucuugucuguguacuuuccauucuuugaacccugaauugcuccaccagcagguucaagccagcaacagauccugaaccaaacacagcaaaaacaggacacuauucccaccccucauuuucuccccaacuaccccacgcagcaaagucugacuugaagcgaagcugccuggaacaguccauuacuacuaccugcccaguguccuuccccaauucugacaauaacacuguuuugccuuugcagaacugcccaucucucauauccaugugggccugguuggguggucaauugcaacucuucccucaagcagccagagagagggucagaagcaaggcugggccaucaaauaccccaauacucagcacagugauugauccaggaaugggcuccugaauccagcagucuccuggguuuuuuuucugacauucauuuacugcuaauaaagaauaccacguugacuccaugcguuagcuuuguuugcuguuugugauuuguggagaaucgcagaagugaaaaguaacaaacacaugucaagggccauccaccccacuccaaccuccaccucaaccgucacccaaguaaaguccagcuccuuuagacucccucucucucaguccccaguguuacuuauugccaagagacauaaagcgugcaaaagccacacacuucuccuucuaaaguaaauauaguuuuaaaaaucuauugagauuucauuuuaauuguugcuuaguaaccauugcaagauuggaacuguuuccuagcuuaaaaaauaacacuauaaaaaagaucauuuagggccgggugugggggcucaugccuguaaucccagcacuuugggaggcccaggcuggaggaucaugacgucaggaguuggagaccagcccgaccaacauggugaaaccccuucucuacuaaaaauacaaaaauuagcagggcguggugaugcuccuguaaucccagcuacucaggaggcugaggcaggagaguugcuugaacccgggaggcagagguugcagugagccgagauugugccacugcacuccagccugggugacagagugagacucugucucaaaaaaaaaaaaaaauuagauauuuaaaauuaagcugucuaauuguuuuaaaacucagauguuauaguagcuuugcaucggagauacaauccuaaaaaauuuaaaacaaaacaaaaugacugggugcagcgguucacaccuggaaucccagcacuuugggaggccaaggcggaagaaucacuagagcccaggaguucaagaacaaccuaggcaacauagugagaucuugucucuauaaaaauuuuuuuuuaaauuagccggccauaauggugagcaccuguagucccaucuacucaggaggcugaggugagaggauuacuugagccuaagaaguugaggcugcagugagccaugauugcaccacugacuuucaccugggcaauggagugagacccugucucaaaaauaaauaaguauaaagcaaaauguuugaggauuuuauuucaauaaugccaaucuauuccucuucaacguuuugaucuaauguaugaauugugacucuguccucuuggcaacaaaaguaaugcugggucuuaaucaaugugcauuaguaugcuagcaaaaugauacuucuuccauauguaguuauauauuaaauauauauaaaauagaaguguuagauacgacucuuaugauuaagauauaucuuuauuuaaauaacuaucccuuacuggaaaauaaauauggauuuauacauuuuugauuaauaaaucaauacucauuuauaaucugauuuauaaauauuuuuuauuuauaaacauuuauugauuuauuaagugcacaugauguaauaaugguuucagugccucugccaacaaucacuggcugcuaagaguugcuagaguaauggauugaaaaaugcaaaagggccugaaagcaugguacgaaagaccacagugaaugaucgguuaugucggccaaggaugugggacucagaaaugguagcaggcacaucaagagcuuuuuuuaaaucuaccgcaacguggaaaaguccaguuguucuaccaguaggugcuucaccuuugugaagucacaauucucuggcuggcugucuacucaucuuuaaaaugagaguuuugauuagaugaccucuuaugucccuucuaguuugaauauucuaugauauucugaaaaaaaauaauaauaauagcucuuguauuagcaucccaagcagucuggugugggacuagcuaaauacaggcagcagugagcuucgaggugaaagcucugaggaaaaggcagaguagaagaagcaaacuuucacugagcuguuuagccuggagaaugauaccuaaaaagcaaauuacccuguaagaggacuugggaggaaagugcacagugaauaaguccaucaucuucucccauauauuuucaaaaauuauuccuggaauuauguugcaaaggagucucaggauguuugcagccacaggaacuggaaacuauuucacaaaauaggaaguguagagaucgggcagauucagugaccucacaauguuaugggugaccccagaucuucugagcuuuuugcuuuagugaccuugugaagacuuugucuucaggcuaguucccugaauggugaugagauggcugcauguagcaauuggugcucuuugcuuccuuguucgguuccugaaagagacuaguuguucuuccuuagaagcaugagcaaaguucuccuuaccacuaugugguccaaauugguuccuaccagcucaucuuugaaucuuuggcaagacagauggaaguauucugauaaggaacaaaagaagaaaaaagcaaacccuugacaucuggaaacuacucaacacauauagcugggccucacuguuagaaacuaaccuggcacucauagccaggccacauuauuauccugcugggcauaaacaaugucacagaacauaaacagcucaagaaaacccacucugagaccaugauaaaguaagacaaaacaagacuauuucauaauuucucucucuuuuuuuuuuuugagacagaaucucugcccagucuggagugcaauggcgcaaucucugugcacugcaaccuccgcuuccaggguucaaacaauucuccugccucagccuccugaguaacuaggauuacaggcaccugccaccaggccuagcuaauuuuuguauuuuuaguagagaugggguuucaccauguuggccaggcuggucucaaacuccugaccucagaugauccgcccgccucugccuugcaaagugcugggauuacaggcguaagccaccgcgcccggccucauacuuucucuaagcgcagacaaagaaaaggucacugcacaacuccugagauaccaaacauccccguccauuagcuacuaagagugacugcuacuucauuaugaaaaacagguuuagccucacuuuagacugucuucccuuuagagaugugagauauccaaucauaaaauuauccccacuuugugacagcacccuaugcagaaugaaucucccucccuuccuuagacucucccccaaaucacccaaaugaacuccaaauucguucuaacacccucuuacugagauaugcuaugguucucugugguauguguucucccucacugcaaugagcaaagaacccaacuucaccuccaaguguguuccuggaggucucuagcuagagggcauuaauucugauuuuauacuaauguuugcuaaccuuuuucauuauuaccccccaaggagccucuuuagacuuuuuuuucuaaucaucccccaccauuuaauuccacagauauacuguauauguuugaggggaggggguuugaaagagggucucacuuuguugcccaggcgggagugcaguaacccgaucauggcucucugcagccucaaccuccugggcucagaugauccuccugccucagcccuccaacuagcugagacuacaggugccugccaccacacccagcuaauuuuuguauuuuuagcagagacaggguuuugccauguuacccaggcuggucucaaacuccuaggcucaaaggauccacccaccuuggucucccaaagugcuggaauuauaggugugggccauaaugcccagccgauguguguuuuuuauauagaaaggguaagauucucucccccauacauauccucacaagccaauuuucguaugguuuaaauuaaauuauaaggggguagaaaggaaguugaagagucuaccacaauacguuaaaaagcacacaccuucuuagcaaucuaccuuuuuaguacaguaauaguaacacucaaugcuuuuuagcacuuuccacacaccaggcauugcuuuuauacaucuauuaauuuuacacagauuaaauaauuuuauccauccaaaaaaucuacaugguagaugcuagaauuauccccaguucaaagcugaggaaacugaaggacaaaugagccaagugucaugccccaagucacuagguuaauaaaugguggagacaccaaauaacugcccucuaacuccagggaacaugcucauaaccaugaggacacauugccucacacucaacagcggcuccagaaacacuccgcucaaugcgugcacaaaugagcaaacgagagucauaauuugcaugauacuacacugccuuguuccaaauacaaacaaggcaguaaaaauuacggacauaggauaagacuuaaaacuaagaugucugcuauacagagaaacauauugacggaaaucuuucggggcaaauuuuuaaagucugugcugcaugacucaaauguuucagaaaacuaaucccauucugugcuuaugugugugugugugugugucugugugucugugugucuguguguguauguuuacaagguggaaaaugccuugguuaagaaagggaggaagagagggaagaggaaaagguaguauguuuuccccuaaaaauuagagauuccgaagugaugaugacauccuccaaccgcuagauggaacgcaguucucccacaccauggccaugacugcucauuugaacuugcugcuucauggucauaaggccaggacuuccuggcuuccucaugagccaccacauuuuccauauuuuuagagcauucuuccuacagaagaaaccuauuuugcauuguuuuuacaacuaucuuuuuuguuguuguucuaauguugccaaggaaucaagaaccucaaaaccuaucuucuucugaggucaagccauccacucacaggacuucucaagcuggagcccuuaguugagcugauuuuacacaaucgaguagagaaagaaaauggcuuuuuguggugagcaucugcuguuuuguuaaaaaugugguuaaagacauuaacaaaagugacauuaccagcuguuguaaugucaagcagcuuagcuaaacuguuuuuuaucaaaugacaacauaugacacccaaaucaauuccaaaccaauaacacauuguuacuuguaaaacagagcugaaugagagugagaaugagagcaugugugugagugugacagagagagagagagagagagagguuaauuaaaauacaaauucaaauuucuccugaaguaggaacaacagacaauaugauccugauaauuuucauuaagaaauuuuuaacuuuaucccagacaaagcaaaaaaaaaagacgauuaugcaauccauauucuuacacaagaaacaguguauuucuuuuguaaaauucuuguaauagcaaaaagauaugacggaguuucuggccacuuaaaaucugacuuggcuucuguccuucagccauauaccuccuaacgaguaugacaauaacagaagaacugacuuguguggcuauguuuggucucucuauuuuuaucugcccaucauguuuaauuaucaggcuauuaaaagguggcaaaucgguagcauugccaacugcguugucccuauggcugaaaagccuguggcaguugaaacaaccaaacccuucccaugggcaucacgaagcuuguaaaagcaaaacggcacaacgucugccugccugccauagucauggccaauccugaauaaauguuuaauuuccacaacugugaugaggguagggccugauuugugccagugcuuaggaaucuccggguauuucaugugcacaauuauuaauaguguaauucacaaaugccaagucuacccuuaaggccugagcucaguccugcucugcuagaguuggugugacuuagucaucaagaaagaagacacuuucaagggcaugauuccuccuggaagaaaaacaaaggagugugcuuaggggauaggacgcuugccaggaacagaagguaugcugcacauggagaguguuucgagguagguaacucaggagggaccugcauuugggggaaaaaaaaacccagaaccaacagaagcagcagaaauaaacaagcaggugugugccucuaugucuacuacaugaaaggaaaacagggcugaaagucacaaucagcauauggagacacacaaagaggggcaccugggaaaaucaaugugcaucaggcucgauggugccugcuuccuccaggagcucacugcauuaucacagguggauaaagucaccccuucaaugggcacaaguagaucacucuucucugcugagauuggauuaaaggcgacacugaugcuaacagcaagaagaagguaaaccggacguuggaaagaauuuucaacagcaaagccacaguacaggacagaucaccaggagaaauguauggggaaauguuagaaaaguauggaaagcccuagaaauuucaaaaguccagcucugugaggagacagaggaaggggcagaaugaccugaaaggccauucuagugcuauuacuauacauaggaaagcuuccuugagggcauuacguuuuagguuuccaauaaaggagagaccauuuucaauauuuuuuaaaauuuuguugugucauuuuauaauaacuuccaauguagaucuuuuaauuuuacucuugcaauaaaccuguacauuuucuauagucaccugccuauuuaaguccuuuauuacagaagagguagaauauaggccaaaugccagaaguaagggucgguuacaaauucucaagugcuuguuuauuucuggauuacuuuauugacucauuuauguaaccaaugagaucgugcaguccagccucaguuucccuaaauauuuagaaaacagguugaccaugggaucauaguaguggggcaucugguuuucuucugauagugcuauuuguuaaauauucuguauuaucagaugcccuacugugugccuguauauagacuucaucuuauucuaaugcuaacuuuaugaaaugcauuucauuuuuaccuucuuuauagaugagaaacucgcuagcaaucacaauuaauaugaggagaaguuaaaauuggaacccaugacugauuucagagccaacauuuuuuagucacuacgcuauacuccuaccuauaaacuucuaaaaacacuguucacaaguacaucauuccccuauggcuucccuggauauugagagaccuggauuauaauuggaauuuuugacuaagguaaacauuucaaccacaagaccugauagaaucuuuccuaugagaauuggucucaggcuuacaacaaaacuagcaaguucuuccagaguacagagcaccccuguuugaggcaagacccagaacuuuaaaaaauucuaacaaagguccuaguuucucacacagagcucuugguuuuggauaagacgacuuuagccuaggcuggacugaagacaugaggggaaguucugcaaaagacauugugcacacauuaucucuuucacugcccuauggcccguaagauguuccuaaccuggaaacugagaacugcacaggucaaguaagguguccaaacucacccagguccuaagaaacagagcacagauucaagcccaguuguaucugccuccaaaaugagugcucuuuucuguuacaauacaugcuacuaugucaccuccaaagguagguagguacuaccuuuacccacacgcguguucuugaacuccccuuacaucucaccuaaugugaaaagccugcaugacccccugggacauauaaggcccuggguaguccacaaccaccaccccuccacguacacaucagcccccuuucuuccuguuaacugccacagaagccuccuucuguuccuccaaggcccccugugcuuuccuuuguacaugugguuccccugucaagaaaacuguucccuacccaucucugccaccuugcugacuccugcucacccuucagaccucccuggaggaagccucuccagcaucccuggccaggccagauuucuaugguuuacagcagaguuucucacccucaacacuguucacauuuggggccgggugauucuuuguuguggggucugcaccgagcaucauggaaaguuuagcagcauucacuagaugcugguagcaccuaccccucaguucugacaaccagaaaugccuccagacguugccagaagucccuagaggacaaaaucacuccuaguugggaaacacugaucuauugcucuuuagaaucacuuuccuuaucuucagagcacuggcuccagagcacaggaugugcuucugucauucuuugaccaucuccuccacgugaaaaugaguuucuuaaaggcagagacagugcuggcuucugcucacccucaaauguccaguguucaggggcaugccuggcucaaagcaggauuccaacaaaaacauuuuuuuuggaauuucucccuaaaaaagguuuggugggagaucauaaacuuaaguagguagcuaguggaagacugcugaagcuuuuuugaauaaaaaauaaugccagcagaguucaggucaggggaaaugaaucccuggcaggauggacauuaaccaaacaccuaacacaucagcagaacuuucugccaaagguguugagagguuaucagcagcccccacagcacaaacaggugucagaaugacaucccaccaaaauggcagcagggcccuaauuaaaagaagaggcuguucuuucaaguauugccaugcagccauggcacugcugggaugugucaaaucacacccaucuaaaaacacacaccacgaccugacaucuuugcccagcugcaccaucccacguuuccgugauggauauuagaaaauaauguaaccucaacugacaaguuuauuaagacacagaagacauuacagaggcccuuuugacauuccaaucucuaacgcagucagggggagaugcugacuugccaucauuauugaaaguaauuggucaaaaaaaaaaaauaaaagaggugagagagaaggagagcaauccuauaaagcugucagguuaauuauuuggccuacaggugugcucagugcucuugaucugccuaccacugggcuugccagugcuuugccaguguuuucuccacccucacuccuaguuugggauaguucaaucuaaagcuaagagaguacauuuaaagcagaauuuuaccuuggccaaguuauuuccuugccuaauuauaccuacguaccaguccaaaucuccauucuucccuauggcucuguccuguuggcauaccaaacuccaauuuuccaggacagauaacccaguuagaaacaaccgacuugugugaaaugccacagagagucacaacgcaaaaacaaguuuuauucagauugaauuuaauuuccuaggcaguuuagaucacagauccgaaacccagacauuuucacaagccaggcaaauaaccugaaugaguccagugagucagaugggagccaaaaggaagugaugaggaugaugacaaacaggaacagcaggcugugagcucaguguuagcagagaaaacccaccgugccagggaagcugcugaugcuacucccuggcucuagguccaccacacgcagaguagaugcucaauuaauauucagugaaugaaugaaugccugcccaagcauucacccuguuguuuccaugucuguuauuuccaccagaagaauguuuuguaggcuuaaaucuccagugccuucagcgcaacugucauuuggaaaguggugaacuuuaggaauuaaagaauggaaacaaagaguacaugggagucacuaaugcaugugggagauacuauucaugccacuuccaagaauggggaauccguacagcucauugucauaagugauguuauuuccaacuuguuaugggugagcauuauuuagaauagcuuggaagaccacaauauuuugcaauagacaugguagccugucagggauacaaaaugaagacuaagacuaagaaugucaaaugagauuauaaagauaccuaucuuugcucaaauaagcaaagggaaaaaguacacccucugccucuucuccucuccuuaaauuccuuuuccccuuacucucucaaggaguaaauauauaugcucauauauaccaacauaaaaaggacauugguagaagcaaacaauacagaagaguauaacgggaaaaauacaggucccacuacugagagguguccucggugaacaauuucagggcuguguguguauauuuacgugugaaacauaaauaggaucgugauaccuuacagcaacuucuguuuuuuucaccggacaucuauggcauuuuuuuauacuuacaaaaaugccuccuuugcucuuuuuaucuacuguuccauaaaaacucacuuuauaaacacaaaaggccaauuuuucucacauucaucaaggaaaggcuccuguaauauugugcucuuuuuucuaccuccaauauuauguuuaagcaaaucaugagaaucaauuaaaaaguggcuaacauuggcuuguuucuacuguaaggacuguuuuuccauaauuugggcuugaaaaaaaauaggguugucaaagcaugagguaaguagaagagaagcauuaaccagggguguuaggaacaggaaauguauuuuugaggaagguuuuggaagaggaguuaugcauccaaaggguucagaauuaugggccaacuauuccuauguacaaauugaagacauuauauaaacacuacaagaacugaaugcauacucaucuuuggcugcuauuucaaacuuccagggacaaauauuuguccuuauuauaaacauacauccaauauguguuaagugcucagaacaugucaagcagugugcuaagcaguacccauguacuaucucacuuaauucucagauucacccugaaaguaagguacuauuauuaucuccaguggaaagaugaaggaauucaggcuuaaggcuacacaaagauuagugagacagcaaagaugaaucccagcaaucuaucuccagaacuuggacccuaugaccuucacauuauacguuuaaaaaugucacagacagauggacacauaaaacuguguugcuuucauguccuggguuucucuucuaaaagcaaagcauauuuuuguuuucucuuucccuaacuagauuuccauuuucuuuggugagcuuaagggagugcccugccaccuuaauaccaaauauuauaucuagggugagaaggagagaauaggaagagcaagcagcaagggccuucagaaacuauuuguacuugccucccaagauagggcagcuugaccuuauccauguggcugacaguccaguugcucuagucaugcaccugugagacuacuuucugcucccuaaauaugccaaacacacaccaugcuuugcaugggaacucucccaccccucgacacuacccaguuauucacaugaaggagucuucacuuucaucagauuucugcucaaagacugucuuuccccccuuucuaagaguucugccucauuaaccucuuauccuauaaucuguuuuguguuauuuuugguacuuguggaaauaaagugccauacacagucaaguguuuugugaaugucaccaucacuuuaagccucauagauaucccacuucuggaacaauagaaguaugaugcuugauaacuauuuguugacuaaaauaauacauugcauacuacuugaaacacaccucuuauucuaguaggaauuaucuaaucaaaguuugugcauguauguaaauauauccauauauacacaugcauauguguacacacacacacauauuugcauuuugcaguuuagacucuuaauuaccaauagaggaaacucaguaaguagcaugauagaaaugcaacuaguauaaaccaacugaauuacaaacacaggacuuagaggauaacugggcauugcaauaauugugaaggaagaugcuuagugaaugauuagagggcaacuauguucugauaucugugaaugaacugcacagucuucauuaauuucacagaaaauucauuuuuguccuguugccuauccugccaugaaaguggagaauugcucagaaucuagcuuuagauaauaacauuuguaaaaaauuaaaauuuguggcagggcguaguggcucaugccuguaaucccagcacuuugggaggcuaaggcagaucaguugagcucaggaauuugaaaccagccugggcaucacagugagaccucaccucuacagacaaaaagcaaaauuagccagguguagugguaugcgccuguagucccagcuuuuuggagggggaagaugggcugagccugagagguugagaacucagugagccgugaucacaccagugcacuccagccuggguaagagagugagacccugucucaauaaguaaguaaauaauaaacaaauuuguuaucaacuuguccugaguugaucaaguugcuauaguuaacuaugaauuuauuucugauuuugauguucauaguugcagaaacuccaaaaacuccuagucaguacacagacggaggccuggcaauaaacacuugaaagaauugccuguuggaugaaugaaugaaacaagagaccgacagacuucaucccuccagagagauaucuucuacugcuucucuaugauuguuaggccgauguaauuaaucuaacacauggagcagauuuuacccuucauuuucaaguacauugucuauuaacagcguccaugagcccucugauuaugcaagguuccuguuaauggaucucugccaauaccaaccaucaagcuaaugaucugagcuugccagcuccaaggugaaggaccacucuugggcauaucucuccaggacucaaagaagaauccccucuccaaaugaucuuggagaagcagguguccacucugccugccagaggcucugccagcacagggugggggcaucaagggaggagaaaauaaaacccaguaauucauauggguugagauuauugacuucacuuucaaagaagauaaagugaaaaaggaagaaccguguuuuugaaagguaagacaggggacauuauccugcguuucaucaagucagcuuuuucaugucaggcgaugguauaucuccuguaacuugucaauggcaccacacagugaagcuaaaagguugaagauuauuuuuguaacgauugauacucuuucugccacagcagucaagcaucugaagauucuuccuuucucuccucugcucuggugaauccuuuuaaaguucuugggugaaagagcugcaaaccccagcagauaucaaaccugaaacacuaacuugacauaucgggaugugugcugcuauauucacugcuuggcuucaggccccuuccagagcacuugaaauacaguuggaggauucuuugaauaugggguaaaaguacguggaugaccuagauugucaaaggauucucuucaaccaaauaagaaaguaaguuugggucagcacaugcuaucagcuagaaagacugcucaaaauugugugugccaaaauaaugaaagaacgugccaauacgucaauccacguuuguuuccugcccccguuccugccacuucacagcucuaaauagaaacacacgaagagaaauuccaaugaaacaaaaggaauaucugaaggaucucacagcuuucagggguacuguaauacccugaaaacagugugguuauuccgggcuccacaaacuagguagaaauaaacauccaucauugcauagggcaggaagaacagcaaaagcauguuggcuaauuuauaaaugucacauacaguguucuuuguuucauugcauagggaggcaacguaaugaaaacauuaaaaaccaucuuuuggugauaauuguuguuuuaaacugacaaauuauauaagucaaagugaaauaaucuuugcaacuccauagagaaacagaaaacuauuaaggcccuuagaaacaucacaacccauguuccccuuucaaagguuagaauaauccugaguauauuuugggaaaguaauauccuaagucaguaaaaggucagugacagggaagauucuuccacaucuucaggagacaaaaaguccccuggagaagagaaaccagguucccuggugacauuccgcagaaaucuccagcuguuagaagaacuuggaucuccgaggccacccaaacuucaacuuaagaaugcaacaaaguggggaugaaacaguucccgggagggaggagguagaauaaaaauggaagcaaagcuacccuacagcacuaaucuguaaaccugcuucaauuggcaagaaaaagaggaaguacuacacaugccugaaaugacaauguagcacauggaauggaccucugcuguuuucgaugauccagcauuccuccugauuuuccuuugggagaaucauuuuucaccuacucacaguucacaugauuggagaaggcgccuucuggguacaggcauauaacuaaacugaauaauccauucccugacuucaucuuuccugugcgaguugguccaaggacuuuuguugaaaccacuggaagagaguggcuuucuugacagcagguuaauaagauggauggagguaaucagguuggcaaguggcugggcaacuguccuuaucaccauacaaaggaaaucuuccagagaacaaaggaaucacagaaggaaguggaugugaaagacagccagagauucccaacaauauaugauucuguaaauccaaccaugaaugaagcuugguauccccacuauuugagccaauaacuccuccuguuggcugaaguuacuuugacaugcauucuuaucacuugcaacugauaauccaucccacgugaguauaaaugugaagaaaucauucuaaguacauccaccuuaccaaauggaccauguuuugcucaccagugugaccccagcacuuaggacaagagaugaugugagaagacuucaaauuauuguucaauaauuuuuuuaaugauuauuuguuaacucaugaauuaucuuccauauucauaucuuuuaaaaaugaaagaaaaucaaagcagguuucuccuuucugucuaaauccuagcaagaucaaacacuggggaaaaaaauaacauucucccauaucuaucugaccccagaaaaauuauuacuuccaaauaguauuuaguuuuuggcaguuauuuaugaacagguaaucuauauaauuuaauagauaaaccuauuuaauuaucuauuuuuucucccacaaacaggaagaccagugucaaaauauugagcaacucuccuaagaacaaggcaugcaaucucaaauuccugguuuucagaaaagguuaauuggacaagcaaaaacaaggagccaacuuauuggggagaacuggaggccuaggaaaaagaaaaggcccaacuuucuauccccaacagacacuuugggaacugauaaaauuaaacauuuuucaaagacccuccauuuccuauuaccacaagaaagucaaaauauuucuaucuuuuaauuuaacuuuaucuugcuuuucuuuuugaaauuuuaauuuagggcaauauuucugagggaugcuauuuuuuuuuaaauaccuucuuuccuucagcuaauguaaaacaaauaguuacuccuggaaauuacuuuuuacuauugguuccaaagcuacaauuugcagcaaauaaaaggacucuucccuucuacagaaacauucagacaacuacauauugagaggaagguuuauguguacuuggagccuuugggugauguucucuuuggccauaugaugugguacucccaucagccugccauuuagugacuccuaucaaagcaaaccucucuaaaaacagacacuucaaagaagaugacuaauugugggugccaacuggaugcugaauugcugaauuucugaaugguuuccaucucauuuuccaaagaaaauguaaaauuucagaguaaaauugccacuuuucuuuuuucacgauguaguauuugguggcuuuuaaauucacagccuucuauucuuggaauuuuuuaaauuuuaaauuaacuuuccuuccuucauuccacauucaugcauucauuuagucauucauucauucguuuuuuuggagacaggauccuguccuguauacagcccaggcuggaaugcagaggcaucauuacaguucacuguagccucgaacuucugggcucaagcaauccucuugccucagccucccaaauaguuaggauuauaaccaugugccacccugcccagcuauuuuuuuuuuauaaaugggaucucacuauguugcccagauuuguaucauacuacuggccucagugaucccucuugaccccucagaucauuaaacauuuauuaaaugccuuucacguaucagguagugaaccaaugcugagaacauaaucaugaacaaaaauccaaacagccccaguuuuuacagaauauccagauuaguaggggagacagguauuauucaaacaagcacauaaguuucuuaauacaacaaaaggcgcauggcucuucaaauacaaguaacagaggaaugaaacugagcucaggaagucaggagagcuaguuaagggagugaaaauacgaguugagagccagguaguaaauaggccuagaagaaguauggguuuuuuguuuguuuguuuguuuguuugcuuugagauggacuuucauucuuguugcccaggcugcagugcaauggcacaaucucagcucacugcaaccuccaucucccagguuugagugauucuccugccucagcaccccgaguagcugggauuacaggcaugcaccaccacgccuggcuaauuuuguauuuuuuuuuuuuuuuuaguagacauggaguuucuccauguuagucaggcuggucucgaacucccaaccucaggugauccgccugccuuggccucccaaagugcugggauuaaaggcgugagccacugcaccaggacugaaguguguuuuguuagaauaagagaaagaaagacgugggauaggggcagaaaaaauguugggaaaacggaaagaacagcaggaacagagacccuguaguggaaaaaacuuaguauaugugaggaacuaaaaggcagccaggguggcuggauacugagacaagguuggugugagaugggcagaggcuccuccaagcaggacuguccaggcuguugcaggaaagaggucuucugucuacuaguaauagaaaugauccaauuuacuccauuaaagaaacaaaacuggauauauucaacacauuuucucuguaucuaacauuucaguagaagugauauaaagauugcuaccacauauucugcuugcuucaccuacaucuuacuguaugauauggguaacgaauaaaacacauucccccuaucuccauucuguauguauauaccauuauuuuauuucaucaugguaucugaaaagcaauuauaaaucaugauuacagcagcugaaauuugcugaagacuuacuaugagcacggcauuggaccaacuacuuucuguccauuuccacacuaaaaucagcuacaaccuuaaacagacugucccauccaaagcuagccucucagguugaaagaucaugauggauuaugcagcagggacccaccauucccagacugguaucuuaggguccagauuccauccaucaggcacaccugggaagaaggcaaccucacuuggccuucuauucaccagugaaucucaaguaucucuaaugauacuugugguagugcaguuuucugagucagccacccugguaugaauuagacuggguaaagugaauguucauccauggaugcagcuuuccauuuuuuaguggcuuauaaccaaggcauacugcucuuaggaguuuauuucagagaaaaaaaguaugaacagccaccauccuuaaauguacaaccuuuucucugcaacagcuuguccuuaaauccaggacacaggaugacaaauggguuucccugccagguccugagaggucugugggaaggugaggccuaggcaggaguggagaucaacgaagcaugaaaugguggauguuuccggggcugcagaauuuuggagaauuccucacgcugucugcucaacuggucucaguucucaguggacucuguggggucaggaggagcccuuucucuggguuuucccucuuucucccucagcagagaaaaucgagaaaaggacauuaaauucagugcagucacugugggugcuaaaauauuuucaggaucaaugguggugcuaaacuaucuccauguuucuaauauauauauauauauauauauauauauauauguuuuuuuuuuuuuuugagaucgagucucacucugucgcuaggcuggagugcaguggcgcgaucuugguucacugcaaccuccgccuccuggguucaagugauucuccugcuucagccucccgaguagcugggauugcaggcaucugccaccacgcccagcuaauuuuuguauuuuuaguagagacaguuucaccauguuggccaggauggucuccaucucuugaccuccugauccgcccgccucagccucccgaagugcugggauuacaggcgugagccaccgugccuggccuguuucuaauauuuuuaagacugaagugcuuuuuaaaaagaaaaaaaaaucuuauggcuacaccacaaaaaugcaguguccuuggguaagggacccacccaagccccuuggccuuuuacuuuccagguaucauuuuucccuuugauaguacucuugugucugcaaaaaaugcucugucuugauaugcuccuggacuguaagauuuugauuguuuuguuuuauauuuuguuuauguuuauaugcaucuuauauuucccugaaaacuaauuaacacuguuggccuuucuaacuggaaaaaaagucuauuauuuuuauacuaguguuacaaaacagaaguucagagagaaaauauaauuuggccaaaaucacauggcuaaugagaagucaaguuggaaccugauuauaaaucuauuugcuuucaagguccaugcuuuuuuuuuucaagcucagauaaauuucacauaauauaaaauuaaccauuuaaaauaaaccacucaguggcauuuauuaauaucaauucauaauauugcacaauuaugucuaucuaguuccaaagcauuuucaucauccuaaaauaaaacgccaugcccacucagcaguuauuucuuauuuucuuuuuccccagccccuagaaaugaccaacgugcuuucugucucuauggauuuacuuauucuggauaucucauauaaaugcaaucauacauuugagucacuacagcaguuaacacagugccuggcacguagugaauuuuaaaaaauauagguugacugugugaacgaaaggauagggguggauaaugauuaaaccaccauaaaauccugagauauuguucuaauauccacugcaugcucuccacaaaugcuccuucgaauuuuaucuucugugacgaugacacuaugucaaccuauccacagagcccagcaguguuaaugccgcauguuaauaaaacaccccucuuuccccacagagcuggauuuuuauaaaaugaagcuuuagaaucuagauaaccaggacacaguacacugaaugucuacuccuaauauguuugcacaaagcuaaacuacacauauugcuaccuaaaauauaaaacuaaugugagugccuacagaggaaaauguggaaugcugaauagggugaacccccugcuauuagccuggaaaugaugacucuguugugaaucuguccuacaggguaucucagggucugagauaauagcauaauuauauaugcuaacucuuccuaguuauaauaucuuggaagacaaaagauauaggguaggagggaagaaaaguuaagccaaacaaaaagaaaagacuaaauuauuuuuacucaacauaaugacucuuugggaagucuaaauggcaauacgagcaaaguuacaaugcauacuucagaaaggagagguaagauagaagauaaaagcugugcacauuuauacacauauucuacaauggacaauaaaaugagaaaugcacaguuuuucagaagggcaacaagaacaccucuaccuccucuaaaaauuaggauaucaccaacaaaucguucaccaaguuagaagcugaagcauuuuaaaacucaaugcuauuaacagcauacuugauauaagcagaagacaguggguuucauuacuguuaacuacccuaguacaacccauagaaaccaugacucagucugaaguagcacacucuaauagaacuuccugugauaauagaacuguuccagaucuguucuguccaauaugguggccacuaaccacauauauuuacugagcauuugaaacggggcuaauguagcugaaagacgaguuuuaaauaucauugaguuaauuaaacucaaaguuaaauuuaaauagccacauguggccaggugugguggcucacgccuguaaugucagcacuuugggaggccaaggaagguggaucaccugagucaggaguuagagaccagccuggccaacauggcgaaaccccgucucuacuaaaaauacaaaaauuagccgggcauguugguaugugccuguaaucccagcuacucaggaggcugaggcaggagaauugcuugaacccaggaggcaaagguugcagagagcugagcucguaccacugcacuccagccugggugacagagugagacuccaucucaaaacaacaacaacaacaacaaaagccacauacuaguagcuacuauauuagagcaacucuaucagauauuaauuaguaaagaauauagaaauacucucuagcauaguuuaccugcauuucauaagggcaaucaaaauagcuuuaagcauguguaguacaggcauacuucucaaacuuuaaggcugugugauauauaaacaaacaccuggcaacugccauauggaaacggacaaacaccuagguaggugggguagagauggaacaaaguggaaaaacacaagucagguaaguaaaaaagcucaucgagggcugaaaugucccaaagacuuggagagucaggccuuccuaggagcuuuccaucuuacaaagcugaguauuggcaaauguuaccagagagauuuagcacgaggaggaagcugguuuaaugaaaagagcugcgucaaucaugagccgauggaaguccugcucuagccuuuggcuaucgagccauaaaauccguugcuuggaaauaugaaacccuuuuggcuacuuaauguuuucuccaauuccucuaacucagggaaaaggaucauggaaagaaaccaaggagggcaaagcaaggagaaaggccagaaauccaaagaggaagaccagaaacaggaagaaaaaauacaacauaaaauugugggagaaaaaaaaaugcucauagggagacuggaugcucccagggugaaaaugaugaaaaaucugugcgaaagagcaugcccaagcaguuagcaaagaccuuugugaauuuauguacaaaaccacaaauuacacacaugcuucccaggaacaacaaaugcugcccauaaaaauaaauaccugccauuaaaauaaauaauaaggaggggaaggagagagagggucagggaaauaauacaauaagccaagguuaaaaaaaaaaaaaagcuagaagaaguugaacuugaccuagaauuugauagucaguuacuuaauccagaaaaaaugaaacugccaggcaaaaguacuagcacaacuggcuaugaaaaaaacuaaaggcauucacaaagguauugguaacucgucuuaugaucaguuucucccuaacacuaaaguuuccaauuaaaaauaaaaaacaagugagguaaaaggaaugauucuaacuauagucccuucgcauagaaguaggucaaaacagaagaggcuuacugggauggggaaacagacaaauuccauuuuguaauacaccauggagaaagguguuuauugaaaguggcagcuuuagcaccauuguuuugcacucugagauuagugauuuuugaaucaccuccuaugguauuacuuuuacugugcauuuagcaaugucagcugagauauaauuaugccaaaccuagugauaugaucaucuaccuuucagguucagcuaaagaguucucacuccaucaagacuucuuuuucucugaaaaggauucccacuaaaauacugucauuuccuuugcuuugucacaaucacauuuugguauaggcuggacugggucagugcugugaaucugagaggagauaauguacuucaagucccaaaguauuuugaguugcugguaugccacauaggauuacaaucacaaaagaaaguuaauagugugacucaaugcugagaguccuagcuacgggaaagugagacaagauugguuucauaccuggcagcacuagaauuuaacguuaauaugaaguguccugauuagcuauuauauaaaacacugaaagaagaaauuucuguucaggagguauucagaagaacugaggaggauagcuggcuauuuagugccagagagccaagucaacuuccaauccccaugggcuucuucagugcacaugaccuauggccaagccccaucuuuuuauuucacaaauguuaacuucccaaauggguuagcaagggaaaacuaucauuauuauaaagaagcgcagauaaggcagacacaauggcucacaccuguaaucccagcacuuugggaggcugaggcgggcggaucaccucaggucgggaguucgagaccagccuggccaacauggugaacccuuucuguaauaaaaauacaaaaauuaccuggguguuguggcgcacaccuguagucccagcuacucaggagacugaggcagcagaaucacuugaacccuggaggcagagguugcagugagccaagaucauaccacugcacuccagccuggacgacacagcaagacucuguugguggcgguggggggagggagaaagaaaaagcacagauaugucaagucagauucacuucaucaacucuaagauuuaaauaauacuaacacuuuacucacuauuuaaacuacguuguuuuucguccauuagcucuuccucagcaaucugaucccaugugauauauauugaagaaagacuuucacagaucaaauaagguagggaaauucugaaaacuaaacuguauuccuagaaauauaccaugguaugagcauauuaaagacccugagaaguucugcaguaaagaaaucugauauugcccucuguauucuccuaaagcguuuuagcuuggggacgauuuucccuuuguucuuuauauaaaauacguauuaccaucucauauucagagcccuauaaaauauacuucaagaaauacugaggggccccuuaauuacacuauaagacucuuaacauacaguagguuuguaaaaagauaguaaaaaggauuaaagauuccucagaauuagcuuuucaugggcagcaaaagaagugagaaaagaaugguauuuauugcuaccuaccacguggccgcauuccauuaggcgcauuucagucucaguaaaucaccgcaacaauucucuaguagguaucauuauucucuuuuaugcagaagagaaaaccaaaguucauagaugccacacagcccacucacggucccagaguuaagagacggcagggcagggauuugaaaggccugugcccuuuccccuauaucacagugguguaaucuuuucacacuaugcauacuucuauaaagcaaaaccauuuugaaauaucuguccugugugacaucacaauauuguuaaugguuuccuucuguuuccaguugucugcuuaguauaaugaaauuaaaccauuaaaauggaaauggaacuuguuccgugaccuucccuuugugagaauaugccaaauuaaaucaacaugggauuuuuggaggaugugccauuuuuuuuuaagaacagggucuuucugccaagacaggaaaacuuauaagaaauucaacuaccuagcuacaggaccucaaauauuagguuauaauacauguuucuguagguuguaaguguguaaaaaaaaaaauagguuccuucagguuuaagaaauccaaggucaugaaaacaggcaucuggccccagcuagaacccuggucuagaacacuaaggaaaagcuaggccaucuuucauuucuuccugacaucuuggucucucuaaacggguucucuucguucugcaugcuacaugaaaggaaacagcuaccauuaauuccccaguauugcucucuccucauaugugaggucaaauagauucaagauggaaucugaaugacaauucuaaauucucugaggaauuagagcccaaccuuggaggcaauccuccacggggacuauauguaauauauuuauguaauguaaauauggccaauggaaauuacacagcuguaaccacacaaacugggacaagcagccucuggagagcauggagagcagugguguuuaggccaccaaaacagcuuauacaaagacuugacaaaaagcacacaagcucgucaauggaaaauuuaugagauaaugcugaagugauuuuuaacuaggaagaucacgggcagcaaagugagucaaguuuuaaaugaaaaguagaaaaaauauaccgugcuguugcaacaaaaauaacccaacuugugcuuaugcugaaguuauaaaaaggagaaagagaaaaacuucacaccugcaacagcaucauuaaaacauaacaggaugguuuggguuugucagaauuaagggccaccugcuguuccacacuucacccucaucccaaucccagucccugaaagaaaugaaaagaaagcugaaggaauuuucauggagacaaaaucgagcagagacuggaucugccaaagacuauuuuucuagucuucaagaaauauccugaaguacuguuucuaacagcuucauuuuaaaaaauauuuuagcucuuuguuugucuuaggcauucagaauauaaaauguacauuuuauauuuuaauucucuguuagaaaaacagggcauauguuguaaaaacguauggaggucuuccuuuauaauuugacguugaugcuuuuucacagauaagcauuuaucuuucagaaucuaaauaaaaugccauauuuaaauuuuggaauuuuaaucuguaucuggaagaaccaaacagaauuuucaccaucucuaaauuacuggauugcaagauuaaagaaucaaguacuuugaucuuauuuaacuuguacaguacucacaaaauuuaaaacacugcacauauuuuaaacaaacuaaguaagcauuuacuuauauuugauaaucuggauauuuuuaaauuuucuauuuuaaaaugaaggugaguaggaaaaauuacagucucuuuaaaguaccaugaguuaaacugccacauugaugguaccauuuaccaaccagcuaugagaaguaacaaaauaaaguugcaccaggaauauuacuauuacucucuacaaucauuacacagauuacaaauuuuuuuaauuuuuuuuuuuuuuuuuuugagacugagucucacucugucaccaggcuggagugcagugguacaaucuuggcucacuacaaccucugccuccuggguucaagcgauucucccaccucagccucccaaguagcugggauuacaggugcccaccaccacaucuggcuaguuuuuauguuuuuaguagauacgguguuccaccauguuggccaggcuggucucgaacuccugaccucaagugaucugcccaccucggccucccaaagugcugggauuacaggugugagccacagugccugaccccagauuacagauuauccucauuuuacagaugggaacaucuagguucaaaaagguaaaggaauuucccaaggauauauagcuauaggcuaggauucauggccuggucuaaugucagaagcacccccuauuaccacuggcaucaacagaagaccagaguagaguuuagguuguuaguaaagacauguuuaauaagcacaaagccucuugguaauaauuaaaauugaaaaucuucauacagauuugugaucuggucucacaaagugaaaagcucaaugcauuucuuuugcauuuauugacuuuaauuuucauuuccauagcucuuuauagccuucaagauauugucacauuaucucauucugacaguuauauccuucauauuuuagcauuuauuaaguuguuacaugucugacuccaaaagaaauggagguacacccuccuauauauaucucuaccugugauacaucauagcaaucaccuuaugcaugaugcucugaaaaacaaauccgaaauaugcaacagccuagauaaaugggaucacaaaaucccugguggggacuuuuaauuauaugcuaaguaagaggcagguuaugcagaacuuucugaaaaaggggcagaggguuuucagaacgauaugagauaacuucuaggcuguugccauggcacuuguaaacuguccuggcgccaaugggagugucuuuaugcuaaugagcaaugaaggcaacuagagguugcuuuccuccccaccugguaguuuuggcuggcuucuucacugcaucugaaaacgggauugacuaaauccugcuucuauuagugggaccaugaccugaaaacaaauccuacaggccuccuaccucaacaaggcagcaucaacuguucucacaauaaaccaaauaucaaugauuccaugauuuggugagagcacugccuauuagcaucuuuaaguagcacaaaacauggcagcagacgcucuccuucauauuagguugcaucuagucacuaggcaaaaucuugguuaguuuccuuucauuuuaaauuuugcucagaggcccagugggcacaguggcugacaccuguaauccuagcacuuugggaggcugaggcaggcagacagcuugagccccagaguuuugagaccagccugggcaacauggcaaguuccugucucuacaaaaaaauauaacaacaaaaaagucaggcacagcagcacaaaccuguagucccagcuacuugggaggcugagguaggaggaucacuugagccugggagcuugacacugcagugagcuaugauggcaccacugcacugcagccugggugacagagugagacccugucuugaucaaucaaucaaucaaucaauacuuguccaaaugaguuguuaguuccuccuuuuauucucuauaaaugcugccagucgggggcaguguguaaaaagcagaaaaacaaagucaaaaaauaauggaggguuaaaaaaaaaaaaagaaaaaaaagaaaaaacaauggaggguuccacuccuuuaaaagauauucuguccaugacaacucccccucugcccauuuccugaaagaauaaaaaggauauguaguucuuucucucugacaucuucugaauaaaguaucaccuucaauucaaacagguaaaauaucuugaaaaaguggucagaggagcuggccaggcacgguggcucacaccugcaaucccagcacuuugggaggccgaggcgugcacaucacuugaggucaggaguuugagaacauccuagccgacauggugaaaauccaucucuacuaaaaauacaaaaauuagcuaggugugguggugcaugccuguaaucccagcuacuugggaggcuuaggcaggagaaucacuugaacccaggaggcagagguugcagugagcugaaaucacaccagugcacucaaaucugggcaacagagugagacucugucucaaacaaagaaacaaauaaacaaacaaacaaaaaaauaaaagugguaugauggaggauuguuuugaaaguguuuuguucaauuugaagucaacaccgugacuaacaaguuugacugacagugucccucaaucagacacacuuagaagcuccacagacuugaccagagguuccacagacauucuggguacuucaaaaaaucacaccacaggcucaagugugccaugucacacucuuuucaaaacuugacaaugccaagucaaucaaggaaacugauuaagugaugccgacacccucuugccuccccagaaucccuuuaaaaccaagaccaacuguguccaaucucuauuagggccaguaacuuuuacuaagaaaaaauauuuccuacuguggcccagauccugaugacagucaacagcguuaacguuuuuacuuuuuaauuuuagacuaguuuuaaaucuacagaaaaauuauaaagaguucagaguucccauauaugccacaccuaguuuccacuauuauuagcaacuuccauauaugauagaguuguuacaaucacugaacuagcauucauaaauuauuauuuauauuaauuuauuuuucguuuuuuuuuuugagucagggucuuugccacucaagcuggaguacagugacgugaucagagcucacugcagccucaaacuccugggcucaagugauucuccugccucagccuccugaguaacucggauuaccgggcauuaucacaccuaauuuguuuuuuauuuuuugguagagaccaacucuuacuaugcuucccagacuggucucagacucuuggugugagcuaccaugccuggccucugagacauuacuauuaacaaaagccucuauuuuauugggauuuccuuaguuuucaaucuaauaugcuuuuucuacuccaggaccccauccaagauaccauauuaacauaacuuauguugcuuaagacuuuucuuaguugugacaguuuaugagaccuuuacuguuucuuaugaccuuaauaguacugaggcaaguauguugcugaagucccucaguuaagguuugucugaugucuuucucaugauugcacuaugucuaugguuuuuugggaggaacaccacaaagauaaagugccauacucaucacaucauagcaacguccauauuaucaacaugacuuaucaccgaugauguuaaccuugaucacugguugaaguauuguuuauucaauuuuugcauucugaaguuacucuuuuuuccuccuuuuuaagcuguacacuuuggacaagaaaccacguguggccgacauuuaagaugugagagcuaggcuccagcuccuugcaguauuuaugagaacuauccggaauucugcuaaacagauuuuucaauucuaccucauuuauuuguuuauucaaucauuuauuuccaucccuauuuauucaaaucuuuuuuuauauuuuggguuauaauucaauaguguuuauucugcuguucgaagcgacccaucuuuggcgcuugggaacuccuugaguuggcuccuaugucccuuuaacacacucccauuauugugauuuauuuuguuguguuuucugagcacugucuuacuucuuggcacuauaacgugcuccaggcucaucauguauauuucuugcugaagucccagaauuugccauuucuccaaagaaccuugguuucuuuuauugggaaauggaauuagaaacaaagaucuggguguuagguguauuuguugcucccacgguuuauucgugaagcagaaauguacccugguuuuaguaaaugcagaaugucagguauccaccauuuacagcgucaaauugaauaguuucaugguguggggaaaaaaaaaaaucgcauguuucaccuauuaaaccucaccccagaaccuucaguaacaaugauuuguuuaccaucuccaugguuuugucuuuaccagaaaguuaauaaaguugcaucaugcaguagauagccuuuucagacuagcuucuuuccuuagcaauauacauuuacuauucauccauguuucuauguauaguucauuccuuuuuauugcugaguaauguuccauucuacagauguaacagagcuuguuuauucauucacuuauugaaggacauuuugguuguuuccaguuuggggaauuaugaauaaagcugagacaaacauuccagugcaggguuuucuaauuucauaaguuuucauaucaguuggguaaauaccuagguauaugacugcuggauuguaugguaaaacuauguuuaacuuuguaggaaacugcaaaacugucuuucaaagcgccugugcuauuuuacauucucauaagcaauguaugagaguccuuguugcucuacauccucccuauuaaugguauugucaguuuuugguauuugguauuugcucuacauccucccuauuaaugguauugucacacaccaguggcugugugauaguaucaucuuguacuaauuugcaacucucuaccaacaugugacguugaacaucuuuucauauguacguuuuccaucugcacaucuuuagugagcuauguauucagaucuuuugaucauuuuuaaaauuagcuuguuuuguuuucuuacuguugaguuguaaggguucuuucuauauuauggauacaaguccuuuaucagauuuguauuuuguguucucccagacucuggcuuggcuuuuuucuucauagugucuuuugcauagcuuaaguuuucauuuuaauuaaguguaacuuacgauuuuuuucaugcauuauguuuuuggugguguauauaccuacuaacacauuaccaaauacaagaucccagauuuuuuucuagauuuuauacuuuugcauuucacauuuaggucuauuauucauuugaguuuuuuugugacauaugcaaggucuuugcuuaaguucauauuuuuacaguggauguucaacuguucuaccaccauuuguugaaaaguuauccuuucuccauguagucacuuuugugcccuugucaaagguugacugaauuugugugaguuagucaacuguuuuucaaaaaggcucagcauuuucgaaaauccaagaaaacaggaagguuuaacuugaagccaagagcaacuugacaguggcagggcaaugucaucacuacuguguauguaggucaaaccaagaauguuacacagucauaacggaggugggcugcguacagaacacccugcaucuccuaaaugguuuauaaucacugauuaauccucugugaguauagacgggccucauuagcucuaguaacaaggaaagacaguguuagauugauaaagcuaagguugggaaagagaaauuagagcagaagagcuguaaaaaggauggaaagugccaugcccgcaaacuuuguagauggauguuuuuauuguauuuguuuuuuuuuuuaacaaauaccaccaucuuuucauuuucuuccuauguucuacacucccucaaauuaggaggcauaagauauuuaaauucaaaugggagcuuucuacucuagcucccacugauguguauuucuuauuaaagcuuugugauuauuuuguauuuuaccaguucaugcccguagaguguugaggccuauuuuaucaaaacugaaauagcucgugauuagagcuuacuuaaaauaugcaaaccaagacaaggucaaagcaaccuuucuuucagaggguccugugggggaucaaaugguauacauugugauucauuuucauucuucuucuguguguuuacccaugauggccagggaacacaaaauacaagccucucacuggagucagcgugcaaaaugugaaacccccuaaugucaaacugcaaucaacacaucacaagccugucauuaaauuggcuucacaaaauaaaagugagaaaaaagacaaaugaaguuaccacacguaauacagaauugaaguggaugaggcugaaguuuagaagagaaguuguccucugaggaccgaaguauaaaugcaguuuuuaaauuaggccauggagggaaacucuuggauuguuccauugcuggugcccucggaagccuucacggguuuccugugaaacacgcaauguaaagcagugaaugcagaauauuugauccuaucuuuguguuaaugagucuucaaucuagagagugggugaucacuuacaaaaauggccuucugcugacucaccagcccugccuauuacauucacccugcuccugcacaaagccagaaaaacugaacaacaagcagcaaauaaauuucaauaaacagauuuauuguccuauuucaauacaaaucacagucuauuaagaauaaugcacucuaguccagguucugacagucaaagaugcugauuuaagaagagaauugugcuccuaauuuaauucauucauuugcaucucucucuucuaaguaugauauaauucagccuuacugaucauagcugguaaucacuccucuguuuuaugguuaaaauugugcuuuuaaaaaauuacaauucuaccuauuuauguggggauuuuuauauauuaugguucuaggaugaaugguuauuagaugacaauaaugaaaaaggcaagguuuaucaaagugaccucugaaauuaccccauacauuuucaaaaugaugcaccuguauuacacagagcaucauagauuccaagcacauuuuccauaacuaaugauaugacuuggaccaucuacaccuuuugucagcacuguuuucugauuucaacauaguacaauccauugaaugucagacucuaacaggugucuaugaacucagggaucuugacaguuucuuucuuuuuuuuuuuuuuuuuuuuaccauuauuacauuaaaggcaaacagaauucaguuccuucaaaauuagacauuuucaacuuaugucccagcuuucuguuauuccaccucacuuuuguacuugguaaaauaaauagaucacaccguagaugcugacaugcuucuaucacauauuaugauauuuuggcuuuauuuuuuaguugaaaaagugacuguauuuuguaaaauuauacacaaccaagaguuuaaauuggauucaauguguguaugcuuuccgcugaaugauuccuuuuucucugggucuugccucaaacaagaaaccauuaaugaguagugaaagcuuuggacacagauuuugugaaguuucauaugaguuaaggagugccuucauuucauccuucaaauuuugacaguaacuauuuuuauaaagaaauuaauucagcuuuuccaaacuucuuuacauugcaucauaauauauaucacaccaugaugacaaacauugaaucuauuucuauuaaagacaaacaugcacaauuuccaucucaagugaaaucuugagcaaggauggaaacuucucaaagaaagaaaaaauaguaagccaccuuguauucuuaagaaugcagaauuucaaaaugagacauuucugagcugccucucacaaagcaauuuuuuuuuuagccgcagggcaccccaguagaaguuaaaaauagauuacacuucuauucaucuaaaagaaggacacuaauaugagcacuguagcuuucugcacuucaguaaaaaucagaaaugaucugcagcccggugaauaaaguugauucacuuagagaacaccagcauuucucuccucaccuagcuuuugaaagcaagcaugagacagccccugccuacaaaauugcagaggaauuacucucaauuacaggcuucugucuguuaaaaaguagagcuggugaucagucugaccuuuuuucucugacaagucaaauaaaugaaagggaaaaaaaaaucugacagguguucaauuuagaagcugggggugggggggaaagaggagaaagaaaagaaaagcuuguauucucuaacuagaucuccggauuuuuuuguauuauucauccuauuuuaaaaguuccuuuucagugaauaaauugcauguggcaauguaauuuucuuaaagucacucaccuaauguuuuaauuugaguaucauuuacugaaaucuucccacaaucaaucauucaggcuuuuaguuucauacuuuagauacuuuagggcaauucugcugaaugcuacaacuccgcccuacccccauucuuccuuccuucuuauaaguagauuacaaaugaccacagaagaaugacuuuucugguucccugcauuugcuauauuuauugcaagacauggcuuguaaacaccagccuccacauuuuaccugauaaugcgaucauuacagaauucacuagaauuuggucggcauugguauuauuugaaugugaauguuuuaguaaugacaugaaucguuuuucagcucucugacauuuacccacguuuuuucauuucaaaagaguuaacuacuuugcuaaggacugaaaaaguuguucugaugaaaguuaaauucuaaaacauucuguauucuucggaguugguugguuagguucuugauaauccagcacuuguucagcaaaacuacuaauuagagguggaagccauguaugcauugaacaguuaccucuucaaguuucaaagagagaagaaggaccaaaggaugcucuuucccuuaggaacccaucugaccugcauuuaggccaguuaaugaugacuuccauucagcuuugaaacauguuucuuuuaagucagcuacuuuucaguagggaaaaacuauuuugagaauuaaucauucucaaacaucauacagaagccaaccaguuaaaauaccacaaucuuaaacagaccugcaaacaacauuuggaaaguugaauugugauugacugaugacaucacagaaccaaaauaacgucccacauucacuucuugcucuguuauuuuuguuugcuucauaacagucagaacugcuuuucugagauggcugagacaguuuucucagaaaugacgcagugaaauggcuaauggccagagagugggagugagaugagaccagaaaaaaaaaaaagaaaaacuaaaagaaaaaagguggaaaagaacaaaggugauguacacauaccccuaaaagcuggccaaaagauaguuauaguaaaaauucuaagggagggcugggcacgguggcucacaccuguaaucccagcacuuuaggaguccaaagcaggcagaucaccugaggucaggaguuugagaccagccuggccaacauggugaaaccgugucucuacuaaaaauacaacaucacuggggacuguuguggggugggggagcagggagggauagcauuaggagauauaccuaaugcuaaaugacgaguuaaugggugcagcacaccagcauggcacauguauacauauguaacuaaccugcacauugugcacauguacccuaaaacuuaaaguauaauaauaauaaaauuuaaaaaaaauacaaaaauuagcugggcaugguagugcacacguguagucccagcuacuuggggaacugaggcaugagaaucccuugaauccgggagguggagguugcagugagccgagauugcacccuugcacuccagccugagcaacagagugagacuccaucucaaaaaaaaacuaagggagauuuugaaguugugucuuuuuccugugacugggaggcccugggaagcuaagaaaauuuuauugaacaucugcuuugcuuccaggagauaaagucuuccugauacuuccuucuaauuuaagugaggcaguaucccacaauuaaaaaaauaaaauaaaauaaaaaaacaaugguuccuuucuccaaagagucagccagcaaugaucaagaaaacagcacagugguguauacuauacagcuuugguaccaaugccaacaacccaaagugauaaaaaauuaagaacagaauuuauacaaaaauaaugcuuaaacacauguuuuauuaaaagcuauagaaaaagggauacauuugaaauaaaaauagcaguauuuucugcuuuaauaaccaacuguugacuagucucguacuuagaaaacggcagguugucaccuagugaacuacucaaaaaucucucuaacuagcaagauaaaaagcaguauuucaaguccacugaacugaaaugaacauaccauacgaacauaauggcaguguacauugcucacauacaaaaccacaucauaaagccguagugauuagaagggcauagugaccaaagcaugauccucuccuccagaaacagacucaaacacacagaaaaguaguauuuuuuuauaugacauugcaaauucaugaggccagaugaauuaaucaacaaauguuauuuugggaaagugaggacauugaaaagaaugugaacccuaccucacaccuuaucccaaauaaauuggagacagauuaaagauuaaaaauuuuaaaaauaaaaauguuucauuuaaaacauaaagcauugaaaacagcaaaaugauuuaaaauacuuuuaaaaagucauuuuuaaacauuuuuacagugggagaaacccaaaagaaaagacuaacaaagccaauuacagaaaaugaaaaguucagauaauacaaaccaaacagaaaacaaaccaaaacaccuacaaucaaaaaaauaaagguaaaaggcugggugugguggcucacaccuguaaucccagcacugaggauuggagacugaggcggguggauuacuugagaccaggaguucgagaccagccuagcaaacauggcgaaacccugucucuaccaaaaauauaaaaauuaccaaagcaugguggugggugccuguaaucccagcuacucaggaggcggaggcaagagaaucgcucgagcccgggaggcggagguugcagugagcugaguucacgucacugcacuccagccugggcaacagagcaacacuaugucucaaaaaaaaaaaaaaaaaaguuaaaggauagacaggcaaaaguucaauggccuuugaaaaagguaaacugagggcugcugaaagcccuaaagcaaggagacaaaugcagauguagguuuaggacucagcaugaaugcuguggcuggagacaugggguauggcagaugccuuucaugaaagccaacagagacucaucucccuaccucccaaauggcuguggaggaguuuccguucugugacucuaccucuccuguauggguggacacguaaccagagguaagcaucugaucuaugaacaaucaacacagagauugaguugagccaugcucucuacagggcauucagaaguaaaugggauuuccaaguucaauuagcagaguugccugcaucucauauuugacaccuuuacccuacaugcugcuuaccugcccaggaucugaacuucuggauauguaucuuuauuucaccccacacucugaguccuaacuuucuacccucuaaaaugauuccaccaccauccgugaaagcagaacugauaacuacaggcugcgugacucauguuugguuuugacuuuucguaaccacgauccacauuaagagcuuuuucaaauaauuguuuauagguuauaugaacuucauaauuuugaaugacacaaguuucuacugaagugauuggucugccacuuccacugccagugaaagaauauucucucuguguucuuaaaaucauucauucuaaaugacacugggguaagaugaccgaaaacuaaagggaugacauuuugcuuaaaagguagaauuguaaacaccagacugcacucagaaaaauggagauuucucaaaauuuaaaauccucaaccaugagaaggauaauuaacaaaauacacuucagaaauaugaacacuuagaaugcacuuagucacuuuacgagaacuacuguaaucgugcccaagccuaaaugcggaugugaguauaaucacugaccaguugcagcaacacugcugcugagaauggaccugcaucagaagacaugccgagggacagagcuggucucagcacccuuagguuucaaugcauguaagagccaguguucaggcugcaaaggucugggcauuugucuuuccaggcuaacagaggaggagacaaugagacucuacaucaauuucccaguauauucugcaaagugauaaugaauuucuaaaagaaaacuaaauaaaaauaucauuuaguuggcuaaagagcuuccagaagaaaggccucagaccauuucaaaaagaaaauggacaacucucaaacacagggacauagaugaggcagaaaagaagaaauaugcauaccuauaaccauggccuugacaagucauuuuauagaaagguaagauccaagucuugaggcacuugcucaagcauucaaauauuucuggggccaaucaagugcuggcuguggagaugccacauccugacccugcaaacaguuuagugggggacacaggcuuucacauauaugacuguagcacagugugauauguccaaugucaggggccaguaaugagaacaugggggcaggaaaggaaggagagaguccucacaccucagccaaagugguucaggaaaacaucccaggaaaagagguguuugauauggguguuaaaaaaugggcucgcuuuccaaucuaaagaacuugaaaguaucauagacgacacaaaugugaagacauccaaugaucauggauuggaagaauaucaugaaaaugaucauaaucugauuauccaaagcaaucuacagagucaaugcaauuccuaucaaaaaaccauuuuuuucacagaaauagaaaacucaauccuaaaguucgcauauggaaccaaaaagagcccaaauagccaaagaaauccuaaacggaacaaaucuagaggcaacacauugccugacuucaaauuauacuacaaagcaauaguaaccaagacagcaugguacuaguauaaaaguagauuuauaggccaauggaacagaauagggaaccuagaaauaaagcuaaauacuuaggaccaagugaucugaaacaaagcauuaaaaaacauaaacuggggaaaggacacucuauuuaauaaaugguacugggaaaccuggauagccccauguagaagaauuaaacgggauccuuaucucucaucauauacaaaaaucaacucaagagggauuaaagaccuaaaucuaagacaugaaaccauaaaaaucuuagaagaaaaccuaggaaaaacucuucuggauauuggccuaggcaaacaaucuaugacuaagacuccaaagcaaaugaaacaaaaacaaaaaugaauaaaugauaccuaauuaaacuaaaaagcuucugcacagcaaaagaaacaaucaucacaguaaaaagcccacagaaugggugaaaauauuugcaaacuaugcaucugacaaaggacuaauauccagaaucugcuaggaacucaaacaaaucagcaaggauaaaaaacaaauaaucccauuaaaaaaugggcaaaggacaugaacagacauuucucaaaagaagauauacaaguggccaccaaacaugaaaaaaaugcucaacaucacucaucaucagggaaaugcaaauuaaaaccacagugagggcugggugcgguggcucacaccuguaaucccagcaccuuaggaggccgaggaggguggaucaccugaagucaggaguucuagaccagccuggccaacauggagaaacgcuguaacaacuaaaaauacaaacauuagccaggcauagcggcagggagcuguaaucccagcuacucagggggcugaggcaggagaaucacuugaacccagaaggcggacguugcaguuagccaagaucgcgccauuccacuccagccugggggacaagaaugagacuuugucucaaaaaaacaaaaacaaacaaccaaaaaaaaccacaguaagacaccauuuuacccccuccagaauggucauuauuaaaaaguccagaaacaauagauguugacauggaugugguaaaaaagggaacauuuauacacuucugguggaaaugaaauuaguacaaccuuuauggaaaauaauaucgugauuucucaaagaucuaaaaguugaccuaccauucuaucuugcgaucccaauacuggguuucuaccgaaaggaaaguaagucaugagaucaaaaaagacaccugcacacauauauuuauugcaacacaguucacaauugaaaagacguggaaccaaccuaagugaccauaaaccaauaagcggauaaggaaaaugugauauauauauauauuuauauuuauauaauuauauuuauauuuauauauaauuauauauauguauauauaauuauauauauuaauauacauauaaacaugauauauauacacacauauauauauguauaccauggaauacuacucaaccauaaacaagaaaaaaauaaugucuuuugcagcaacuuucauggaacuggaggccauuauucuaagugacguaacucaggaaagaaaaaccaaauaccacguguucucacauacacagaggagcuaagcuauggauaugcaaaggcauacagaauguuauaauggacacuggagacucagaagggagggugggaggggcgugggggauuuuaaaaaacuacauauuggguaccaugugcacaacucaggugaugcaugcccuaaaauuucaggcuugacugcuauacaauucaucacauaaccaaaaccuacuuguaccccuaaagcuauugaaauuuguuuaaacgaaaaaaacuugaaagugauacaguuuuaaucaaccaguuacugaggauggacauauuaguuuauuauugccgcugucacaaauuaccacauacuuagggcuugaaacaacacauauuuauccuaucguuuuggaagucagaagucugaaauggcugucacugggguaaaaccaaaaaguaagcagggcuguguuccuucugggggcucuaguucagaauccauucccuuacuuuguccagcuucuagaggaagcccacauuccucaccucauggugccuucccacaucuucaaagccagcaacaucaggucaaguccugcucacaccacaacacucagaccucugcaucccucaucacaccuucucucacucugacucgcuugccucccucuuucauuuauaaggacccuugugaauacauuggaccuaccugaauaauaccagauaaucccccuaucccaaaauuuuuaaccuaaucacaucugcaaagcccauuuggucauguaagguaacauucacagguguuggggauuagaauuaauaccucuuugggggaucauuauuccaccuaccaaaguggguuagggaccacacacccgcccuaagugcagacggaagcagcaauggccuaggauguguaacauacauacauacauauaaacauauauacagacauacauauauaacauauauuacacauauauacaugcacacacauauccauuacauagaugauaucauacauauauacaauauauacauacuaugauaguaaauguuuuauuuguaaaaaaaaaaaucaagcaggauuauauuagucucauuucuuauacuuugcuaugcuuuugugugggcaaaaagccguauggaucauguacuggggaccacagguaaguacauacagccaugcagacaccccaugcauauaaacuccauccaacauguagauuacugcaccccaaauagauagauacauauauacguagacagauaaaagaacugcuuuucaagucgguguuccccauagugugguacauauuccauuuacuaauucaaacuuuaaaauucgaaaagcagcauacuuaacaugcauuuaaaaauauauaaccaucaugucagucaugauuucauaaaugccacagcuuggaacuauucugcccauaguagucccuagccacauguggcucuugucaauguaaacugugacuaguccaaacugagaugugcuauaaguguaaaauacacacaagauuucauagcauuaaaaaaaaagaaaucucauuuaaaauuucuuauugauuugcauguugaaauaauaggauacaguggguuaaauaaaauguaaaauuaauuucuccugcuucuguaauauggcaacucaaaaaucucaugugccuugcauuauauuuauuuuaacaguacuggauuaaaacaaugccaaagcaguugugaagugaaaacaaaaugaguugagcuaaaguaaauauuaguaaaguuagcauaaagguauuacaaauaucuugaaauuucaaagcuaauaaccuauguuugguaacacuauacaacaucccuggaaaauggaauccagcuuuugaauauuuucuggaaaggguaucuuaguacuuccgagguuguucaauguagugguagagggggucaaaugaaaaacauuucuucuuuguauugacuggaaaucugaaaaaccuuuguacauuucucuccaaugcccuuaguucuggcuuauaaagcacagcacaaaccuacccacuacuauccauaacuagcugguucuggccuuuugaaccuuuaguuucaaggcucccaugaaaccaacacagcagcuuuguaacuucacaaacuugaaagaccacauuguuggaggaagauucuuacugcaggcccuggcauuccccauugaugagcugaaaucaguuauuaugagguucuguauacaccuucugaugauggauaaaacaaaugcauaugccucacaggcacagcaggaauuaaaaauacauuaguucaucgcaacuucagaucugggauugaggaacguuuggaugacuuuuuuuucuuuucaaauaaaguuuagaugaggcaggaauuucacuacagaguagaguucugagacucuccagguccaguucagcacuuggagagaaaucaaauacaucuuaucuuagguauggcacuaacuuucaucaaaaaauuaucauaugcucagucacaaaugguuauuguaaaaucuuuacuaaccuaagugcauauaaaaauugugaauuccuaauacaaagcaguauuugacuuuuaaauuucauuuuaagcuuggcccguucacuuggaaugugauuacagaguaaauuaaaaaguaaucacaugugaauuacauuuccucaugaauguaaugacuucaggaggcugauuaauguuaagcagugccuguccuacugcaugcauaccuucccaggugagauaugcaagauagcugucgugaguuguuuaauuuucuuuuacugguauuccagggagacugccugaacacauaauaggcucagcacauucauuaggacugaggauguucuucccuuugguaugcucaagucccacgugcaaaauaccaucaccgucaacuuaugguuaugagaaaagcccaagggaggcggugcagcucugguaccauuuucuaccuagccaaguuucaauuucucaaucucucuuucuaucuuuuuggcaaauucuucauauuugaauggaauaauuccagagaaucacugaaaaaugcauuugcaccaguguaaagguaacgaauugucucacaaggaaugaaggcuuauuaauaaucuacaacaguauuacugcagagaacaaaauuuaaacuaaguggagcacaggaucauuaacauauuuccucucagguaauggggaauguagcagucuaaaauauuuacuccuuucuguagucagguuaaggcauuguuuucuaaaggaguugucagaggaaucacgcuauuguuagaaguggaaaaggcuuggugcuucauuauuucugugcaaaagaagagcaaauacaguggauuuaguagccagccaaggaaagccagguacuaaaaauuaccuugggacaaaaguuggucuuuuauuccugugauuccccauuccacugggaggaacaaugaacuaguagagcagccugagaacauguuacaucauaaucuagaacauauagacagcugaugucaugaaacugucauacuauaugugaugcucucugacaucaucuauuauauaaaauuuuguuuuucuuuuuuaaguuuggugagacaggcuaaauugaauucaaaauccaucagugacucaugaccaucaguuagaaacauucuggauugggagccuuuggaaucacaggaguugagagacugccagcucacuucauugucauuuaacuguggguccucaaaggggaauguuccaaaugucaugucuucccagcuuuguguggguggugggaaaaugaagagggguaauagcgagagaauuaaugucaggagaauaagacagaaaaggccuacaauucuguaguuucuccuaagacuggcuucaggauuccuuugaguuuaauauuucuguuauguuuuuauccugagauauuuaaauuuccagaacauucaaggucaaugauaagacuauuagaaagauuuuuauuuaaacauaaacucaaaagcacucaaggauaaagaagaaaccuaugagaacucugaguagguaaccuacaauucuucuguguuaaggagagaguagagagaauuacucuuguguuucaaacugggggugucaaacauaggggacuaaaaaugugaaauauaccaguauacaauauaacuccauugccuuaacugagaugacagacacuaauauucuuuuguuguacuaggguuuuuauucugcauuuguuguaccuuauaacauuuuuaaggccuuuacuaacccacugugugauucagaagagggugaucaagaaagugagugaccuagagaacacaccacgggauaaccaaucaacauagacaagguaagacuuggacacuagggaugggauuaggaacagggugucuccauccagaggacaguacuggguccaggcuauaaaggcagagacacuggauugugggugcucccugacgugcuaaugagaguucuguuaccaacaggacugggauaaucaauuucccuucucugcauccccuuuccacauuuuagggccugauguuugacagccaucuaaugagcuaaaugaauucuacgaauucugcucuaccauguuggauuugcucuuguggauaauacucagcagaccacuacaauuucuagugggucacaaucuacuuuugaccucccccuucucuaggacauaucccuggcauuuuccuauacaugaccaaaauuacuuuuagagaauguaauuuuguauaaaaugggaaaaauuaauuaaaucauuaaaauaugaaaaggauccucuucuaacaaggucuuuccucuacagggcauccaugcuuugaacucuagggacagcauuaaacugaagcaccagugucuuucuucuggaaucagaaucccuuuguugcuuuugggggaaaaaaaaaaaaggcugucauugaacuuuuaauuagguuccaaaaaugugaccugaggcaauaauagaaugauuuauuuuaaugcuacacugcucuugaugauauucgguuaaaaaugggccagccuuugaaacacccugacaccacacacuggcaucuacaauguugaggcuacugauucaguuuuauuucccaagaugucuuucuuuacuccuuuguucaaccacccauccuucuguccauucauccauucaacaaacaucaacauuuauugccaggcauuaaggacagacaagcaacaaaaauaaaauggucccugucuccaacagaacuuacuaaaguucagcugggaagacaaccacuuacccaacuuaaaauagaacaacguggguggaaaguacucaguccaauuuaaagagaccauaauaucuaaguuuuggucuuuacugcucccucuagccuggguuuuauguuugguuuagccauuuaaccaccacuauguauaacaacacguauguuccacugcugauuuuaccaacagaggccagucucacggugggaaacguggcucccaaugguaucuuauauaccaaaugaucgucuaugguagauuucaaucaucauucuaaauucuacauuguggguuuguauuucugagugccaauacaaaccacaauacuaucuauuuuuuaagagauggggucucacuauacugcccaggcuggccuugaacuccuaggcucaagugauccucccacuucagccucccaaguagaauaucuuaaaguccagggccauucagaggaagagagaugcuacacuggguagauaaucagaagaaaagaaucauuuaacaaccacccuaccccccaaaaaacccuuucucucugcaaaauggaagggccaucuagaaagaaacagaaucauucauacauauuuauuuuaaaaccaauaauuaaccaccuauugcaguacugaaguucauggccuacaugggauuuauuauacugauuaguccacuucuguguauauuuaaccuaucucauaacuuuuuuuaaacagucaauacuaauaaauagcugaguucaucuaaaauauauuggaucuaagacuacccaaauuuuccucaaacauccuaacuagaccccaguuaaacuucuuuuggagucucagggagaaaaaaaaaaaaauagaaugcuuuagaaauucuugauugaauuuuguuacauuagcucagcauaagcauuacagccaccaaaaccacucuuaccaguaaguucuccauagcaagagauggcugccugucccaggauugcccacauaugucuucuuaggauacuccaggaacaaagaggagaaaaauaaucuuggaaauucuguagacuguuuugacuuuuuaacccauucauucaauccauaaaaaugaacaaagugcuauaauguuacaguggaaagagcaucuuuucagaggaagauagcuggaauuuuagucaagacuucgucacuaauuaucauugugccuuuaaagcauaucacuucacuuuucuggaccacauuuacuuacaagaaaaaugaggaaguuggaccaaugaccuaguagcacucguuucugauucucagucugaagucaauggaugcuauuaacauggaaguauuuugaagcugcauuuccugcaggggcaaagcaaugcuuccuccacauuuuccugacuccuuucaaguucuccuagagagcuccuaagacaauucauaaagagaaaggggguacugcugcccaagcacacauccuuugucacgguguguggucaggcacuaguuggcauuaauuuacuuguucacaguuguacaugagacauuauugguagaguaguuaugguugccugauuguggauguguaacuaauucuggaaaaggaugcuauaaaguuacaauccaaacaaucucagcaggugucacuguagucaggagaacauaucuucacaaauacucauuauuuauuuauccuuaaguaagagaaggucccuaccagccagccuaaaaguacugagcucuguuucccaucauaaggccaagaaucaucaacuuuguaagaucaaaaggggguuuuauguaugcucugucuucgugcaggucuaaguggagccaugacaaccugaggcacauuuguagauauuuuuucaagguuauaggcagaauggcacuccauagcaucagucagaaagcuacucccaugcccuacuuugucuaugaccucagcuuuaucuacuuuuauuuaugaguguggagcuuaggauuucagugacagaauaauuuguuugacacauuacaguuaaaaaaaaaaccccaauagaaguacauagacauacacacacacgugucuguaaaauugguaaaaucugacuaaacucuguggauuguaccaauguuaauuuucuaguucuuacaugagacuauaguuacuacaguuaagcaagaugcuaacuauagagaguuugcaugaagugugugugagucuuugcauuuuugcaacuccugugaauguugaauuauuucaaaacacaaaguuaaaaaaaaaugacaaccaccaaauaauuaagaaaccuauaccuucaaaagcaagauuuaaaaaguaauuguaaaaguucaggaauaguguaaugacacgguucaucaucagugaacaccucuccuucaaaaaauauuuguaugauaauaaauaucccucaacaaaggcauguaagucaccaguauucauucccaggaaauaaggacugucucuuucaaaaauauuuagaggaccugagaugacccuuuuccccuaggucacaccaagaguuuuuaucacugaaagcuccuuuuugcaauucauaguuuugacaaaaaagauuuuagugaugugucugugucuccagaugcacugcucugugcaacuauauaauaacuauuaccuggucaaccuaugucagcccauuggaacugaucuuuaagaacacaaaaacauauauguacacacugguaugaacagcaaaucauucuuaaaauauuugauuuagaaaaaaaugcaagagagaugauaguuaauauccacaaaaggcaacacaauuucacaaauagacaagaaggggacaaagaaaaacuaaaagaaaaaaaugggggcaaagacaggaacaggaagacaaacuucgcauguucucacuuauuagugggagcuaaaaaucagaacaauugaacuugugaagacagaguagaaggaugguuaacagaggcugggaagggucauggggaggggggugaauaguuagugaguauaaaaaauagaaagaaugaagaauaagagcuaguguuugauagcacaacaaggugauuauaguaaauaauuuaauuguacauuuuaaaauaaaagaguauaauuggauugcuucuaacacaaaggaaaaaugcuuagggagauggauacugcauuuacauuggugggauuauuacucauugcaugccuguaucaaaauagcucauguacuccauuaauauauauaccuacuauguacccgugaaaaugagaaauuaaaaaaugggcaaauauauggagagguauuuuauuuauuuuauuauuuuauuugagacaaggucucagucugucacccaggcuggaguacaguagcgugaunucagcucaccucagccuccacccccugggcucaagcgauccucccaccucagccuucugaguagcugggauuacaagcacgcaucaccaugcccagcuaauauucugguuuuuuuuuuuuuguuuuguuuuuuuaguagagauggaguuucaccauguugcccggacuggucuugaacucccgggcucaagcaaucuuccugccucggccucccaaagugcugggauuacaggggugagccacccuucccagccugaaaagguauuuuuaaggugggacaauauaaaaagccaauaaaaaugaaaagaugcucaaauuuaauagaagucagaaaauguuagagaaaacaaugagaugucauuuagaccuaaugcacuaauacaaaugaaaauaaggggaaauaccugcucuggauuuagauaaauggauauucugauacaugguagauuaaaauaucacuuuuaaggcuuuaugaaauguaauguaacaauaccuaucaauauuuaaaaaguacauuuucuuaaaucuaguacuuucauggcugacaaucuaucccauuaaaaguagguuauuagugagaccccauuucuaccaaaaaaaacaaaaaaaucuggccaggcaugguggcaugcaccaguagugucagcuacucaggaggcugaggugggaagauagcuugagccugggaggcagagguuacagcgagccaauaucgcgccacugcucuccagcuugggugacaaugagacccugccucaaaaaaaaaaaaaaaauuauaugagcuuuuuguacagugauaagacaaaacaaaaccacacaaaggcuggaucccaccagcagaaaauguuuuaaaauuauguuaccgccacuggacauaaugaauuagauuuauacaguagccuugaagggauuuccucaaagaauuauugaaagauaaaagaaugaguaauauuccauuuuuguaaaacaaugacugaaaaaucucuccagauauguauauauaaauacacguauguauuaacauauuagcagguugacaaauacacaaguauaaucauaggucagaacgucccaaauucugcaucuuggcacaaguauaagauaauaacuuuuaucuaacacugggguggaaagauaaagguuguucaucaccagaaaugaugagccaaaggauagagccaccuaaaaagcaguauuugagcaaaggaguuggggaguucaaaaggaaguuguugccugaggaggauucugggagcacuccaggaagagggaggauagagcaugguggaugaggugggucauguguacgggaaugggauaguaccgagugaaaacaugggaacaaaaugacgcaaaguucagaaauacacauacauacauuuacauauaugaauacguauguguauucuugaauuucauggucauauuuaugcauuuucggugaaauuguguuuuuaaaacuuacuuuaugucuuaaaaauaacacuuaaggcugggcgcgguggcucacgccuguaaucccagcauuuugggaggccgaggggggcagaucaugaggucaggugauugagaccauccuggcuaacacggugaaaccccgucucuacuaaaaauacaaaaauaaaaaaaaauaaaaaaauaaaaaaauuagccgggcgugguugcaggcaccuauagucccagcuacugggaaggcugaggcaggagaauggcgugaacccgggaggcggagcuugcagugagccgagauugagccacugcacuccagccugggcgacacagcgagacuccgucucaaaaaaaaaaaaaaauaaauaauaauaauaauaauaauaauuauaacacuuaaaaaugagcccagguagaugaucuuccaguaauuucucccuugauuuucuuguucuugcugcuauuaaaaucaagagggcaccauauuucucccuuugcucuucuaagauccaguacuuaugauaagaaaaccauaguccaacacacccuauguaaguuauucuguguaucugagcuucagauguaaaggagcucuuucagacuucaggguuaugagaguuucugaauagccaccuggcaaaucuggguagauguugacuuucccagcaggccacgauuuauugccaaaagcacaauuuuuuucuuuuguuuugacuuaacaugccagaaaaaaaacacaagacuauaagaauuaaaccuaaugcaucacagcuaagcucucuaaggcaugaaagaggcaagggcugcaccaaaacgaauuuaucaaucacggaaugcaggaccccuuguaugauuagcuuaauuauuuaaagaaugcaaaagagguggacgguucuaccauuaaauuauccuguuuaaagaaaaugccaacucgguaagcauuucuaaguggacaggcuauuucaauagaguacauugcugaauguguguguguguaauaauaaaagaggcugcccuuuaaaaauccccacaccacguacuuuuauuaauuuaauuugguguccacuguacuuuuuaguucgcuccaguugcaauuacuauucuaguuuaauuucacauauauuugcauuguuucauggaaacccuuaccucgguaaagaguaaaaauagauaccucccacuagacccaccucaaaaggauauaugugugugaaaacauacauacacaacuaagugggaugaaagugaucuuuagagauaugggauaaaggaaaaaccauuugaaaaaagucucagaacacuccuaggaagaccauauguacuuccucauccagcaaagugcuauuucaaauguguuaaauaaguagggagugugucagugugcgugugugugugugugucucuguaccaauaaacauccagaaaaaaagaggggaaaaagucaauauaaaaauuuagaaauuagaauauuuacuuuuaguuaagaaaauuucuagaaaguuuuauuuugauauacaaaauauaagacagccaucucaacaaucguguccagucauucagcaaucagccaccacugacaaccuacaccuuuccuuccuuucaauaauggccuuccaacagaccucgaaaggcuucuauaugggucacuuuucuuacuauaucuguauuuuuuuuccaaaccuaauccuguuuguucugaauuauacugaguuucugauaaacuuuaaaauguuuuucuuagauccagcugcacuaagaguauaaagcgaauuuagaaucaccaccccacaguccccccgccgacaaaucauacuauuuaauauggcggugaugagaacaacguaugugacuaccgugacacucaauaaaaaugcuaugauuugcuuuuuaaaaagucagaaaccuauagaauucguaugugaguuccacucauuguuucuauaaaaaggucauucugauauguuuuagggcauugucaugagaaugugugaaaaaucuauaggcuuacaaaacaugaaaacucaagauacugguugguaaggacaugguagggguaauguauucuuagaagagaggcugcaucauuucugcagauaaauuugaaauuuucuucaugcaauuuggaauguaaucucuuacuagauuaaauuuuacagcucaggaaggugaggagcugguaagagcaaacugcaugagacaagaguauagauauccaacaaacaaugaggcaaccaaccugauucacuuaguacuugacagcaaugcuuuuauuagaaacacuuuacuuaugaccuauuaccagugguuccucuacuauugggauacauuuaaaucugucauuuuaaauguguuuacacuuuuucuguguacaagaacugcugacaaaggcaagcgugauaugucauacugaugacguguuaagcugaggaaauuuccacugccacaggcaacacuuuaaccuuaugaaacauuuuaaucacauuuuuauugaagaagcuuauuaaaagaugcaggcuuucagaacucgacaaauuuucuugauccuuugccaaaucagagguaggcaaaguguacucugaaaucaccuccccccaaauuguaaauucauuuucugaaauuagauauugacauuuaagcaucauauaaaagucaaacuuuucuaggauggcugagaaguugaaaauccuaaaugcccacauuaugagaaaagaaguuaaggcaaaggccaauauggugaguaauuuuaaauuuacacuuagcauuuagccccuuuucugcauuagucccauguuaggaaccaacucauucuuucauauccaacauauguauuuucaguauuugcuaagaaauaauccucauuucaaagcauugguuauuauuuucuacaaaagcuugguuucucaauaguauaauucuguguuugcagacuauaaaaguauagcucugagaauaugaaagaaaauaaucaccaggacaggcaaucgauuucugugugggcaaaaauuuuagaccuuuuuuguaggugaaugacaucagagagccauuuagcucuaaguuuccaugacuaccuguaaaauggagauaucauucauucacucauucauuugauaaauaucaagagaacauccacaauauuucagguacagaacuagguggcauuggggugacagagaacacacugguuuugccuuuaaggacauuuauagucuacuugcuuucuguccacuucgacucagacauaaagaauauuuaucaaauauaccggaagucccagaauaaggguacucuaaauacaucauucaaauuucaaaauagaaccuaaaaaacaaaugccaaaacauuuacccaauguauucaggccuuaugaaccuagugauuaacauauuuuuaauauguuauuucagcuauacuguaacuauauggugaaacacaacaaaccaaacuacuugguuuauuuaguuuaguauaaagccacauuuaguaguauuccaacucagugcucuucggcaaguaugugcacagcuauauuacgucuaggcacuguaacaguggcuagggagaugaugacaugaugacaugaugaucuguuagaacccugugaccuuaagaagcuuaugguccagaaagacauacaaaugugucauucacuaugugauacuccucucaaucucuuccucucaccaucucaccaucuuucuuacauuccuacuccugauuugguccagacaauccacccaucuuccagagccaagaacucuguugagccaauaguaaaaaucucauucccucugcaaaggauuuguuuguuuaggaaaguugugugacccaguuucagccaacaaggaaagugagugaaaaaccauucaauagggcuuuugaaaaagacauggaaccaaucuaaaugcccaucaaugaugaacuggaucaagaaaaugugguacauauacaccauggaauaguacacagccauaaaaaggaaugagaucaugucauuugcagggacauggaugaagcuggaagccaucauccucagcaaacuaacacaggaacagaacaccaaauaccgcauguucucacucauaagggggaguugaacaaugagaacacaaggacacagggaggggaacaacacacaacagggccuguuggggguggaggguguguggggagggaaccuagaggaugggucaauaggugcagcaaaccaccauggcacacguauaccuauguaacaaaccugcacguucugcgcauguaucccagaacuuaaaauaaaaaauuaaguaucaauccaaaaaacacaaaaacaaaaaccaaaaaaaaguuucuucacucuuuccaaaaagagguaaaagauaaacccaagugaauggagaauuugguauaugauaaauaugcuauccuuaaaucacuggggagaagauggaguuuugauaugaacuguugggauaaguggauagucacaugaagaaagguaaaaucagauccauuccuuagacuuuaaaccaggauaaauuccaaauggaucaacuauuuaacuaugaaaacuaaaauuaaggacuagaaaaaaacaugguaauaugucaucucaauaaccuaggaauggggaaaacuuuucuaacaauuauuuaaaaucccaaaguaauaaggaaaaacauggauaccagugauuacauaaaagauuccagaaacaaauugggagaacacauugguaagcuucacuagagauaaaaauccccaauauacaccagggcugcaaaaucaggaaaaaaacagcccaaaaucacacugaaaaaugagugagaaauaugaacugauuagcucauaaauaaaugcaaaugggccuuaaacauaagaaaauacacuggacugugcuguuaauaugacaaaugcaaucgaaaacaauacuaauauaacauuccucaccuaucugacaggaaagucuuaaaguucaacaauauaguauguuggccagacuuagggaacuaggaauucuuauauaguugugguauaaauacaaagagacauaugcaaacccuauggauaaguguucaucaauaccuagcaaaauuacauauguauuuauccuuugacacagaauugcacuucugggagucuauccaaaagacacacuagcaaagauaaaauauauguuugcacaaagcaauucacugcagcauuauuuaaaauaacaagagauugaaaauaaaaauguuuauaaauaggggauggagugagaaaaaaacaugguacaucccccaugauggaguacuauaaaaccguaaaaaaaaaaaaaaaaaaagaagaggaggaagaggaaaaagaagaaaagaaaucauucuagaaagugcaacuaaaugcucuccaggcuauuuuucuaaagaacgaaagaaaguugaagaaaaauguauagaguauauauaacuuuucaaagaaaggauggaacacaaauauaaauguauuuauauacauacauguauguauauccacauacaaacacauauaugcaaccuuauguauauauuguauuuguauuuaauaaacagaguaaguauuaaaaauuugggggaggaagaaacagaguauaagggagauauagaaguuauacuacuuugaacauacugguuuuauagauugauucugaaaucauaaauauucuacauaauuauaaugcaaaauuaaaucuaaaaaagcaaucucuauaaauugaaaguaaaauaaaccuaauuucauauccaguugcuaucauaagcacucacagaggugcuauuucuagcgauuuuauuuaagauacauaacaauuuaaaggaaaacucuaaacugcucaugguaauuaaauuauuuguaguaggacugguaucgauauucugagacucuugugcauguacugugaauaaaucaaagaauuaugaugguaucauuaagugcugagguuuuguuggggaaggagaguaugguugaaaugaaauaaggaugugagaucaaugggguaaggcauucugacuggggaaaaccacucucccaaagaugagccuacaaguugccuuagcugguucuccaggcuucuguuucuaaaguuauugucaugacaucuuuuuaauguucgcuuuucauaugaugaggccaauauauacauauuaaaguacauuuacaugcauauacacacguaaacuuauuuggauagcauguucucaugcaucgaucacauuucugauuugagauaauaguacacuagguuaaauucuuccuaauugacuguggccaagucugcucacgcccagcaucggaccucacauucuuuccuaccuacuuguuuuaagcugcuggcuccuugcagucacuuggcagaaaacacuucuccucaaacuugcauuguauuucuagcuuucacucaucaauaugaauuuuaaggcucccagugaaaaccaauuuaagguauggagccuguuuaaaacaaggacuggcuccagucacacccuuauuuucagaaaauaagccucugaggcacucccaacauagggacaugcagccaggacgccaagugguaugcuuugguagaaagaauuaaaaacaacuuaguauaaaaacguuaggguauuuguuggauuuaaaaaguuuagcuaauguacaugacagcagaccucaaagcaccagaagacucccuugucuguaauagagcuucagauagaacacaccucuugaaauaauacuaauaucuauuuugggauaauauaagguauuuucuccaaaacacauaucucuuucacauaacgggagacauauaaguaaacagaaauaucucugaagacaacuaaguguuguuuaagcacuaaaauaacaaucuaaugaauuaguaagauaagaaaaaaucuauggggagaggaauauuauuuaguuugggaaaauaaauaugguuugcaaggcauaugaaauaucacugggacagaggacaggaaauaauacugggccugggacaggauaugagaaaaacaagaugaaauggaagaugugagaauucagaauagacaaagaaaaaggacauggcggagcaauccugggcgcuaaugauuuucuaagaaaccagcaaauccggguuuguuccugaggauguuccaaguggagcagcugucuaucucagggauuuugcuaacuccagaagccaucagccuagugcccagugaauguuuaauacugagaugcuuucaugccaccugaaagaaaagcaagagagggaucugugucccucucaaaguaccuaguacuuuaugguagcuucauugguuuauugcguugauuauucaagauuccuuggcugacgaugacaagaacacaaaucaaacuagccucaacuagaaagagaauuaauuggcuuauauaacuagguauuccaaugauagagagaacaugagacaaaucuggaucaaggcacauacccuuucuugcucucucuccccccaucugcuucuuuccgucucccaauucuguuugucucugaucagcuuuuggccucauauucuucuuccaugagcagacucugaaaucccaaacccacagcuuuuuugugucaagucgucucucuacauagaucagauuucaccgaagcaaucuuacugacagcuacaugggagaugcuucagcuuccuggaacaaucgcuggggcauauuccugugauucagacauuggacagacccaagucaagcucccacaggccacuacacuggccauuuccaccacaaccauacaggauggggaaggagcaguuuuccaaugaaucccaacaacagauuuuucccacuauccuuccaauaagacuauuuuuccuccaagggcauggccucucaaauauuuuuggccuucuccacacuuuaccauaacaucuccuaaauauaugccccauaauuaaacagauggaaaccagaauuuuuauuguagacaucaucagugaauuauuuucacagauugcaaauacauuccuucaauauuccauuaccugauugugaucaccuaauuagcagaugaaaacuauucagaguaucaggagcauaagaggaacaaggacaugucaauuugaaaaugauauccuuagaaagcaugccuaucuacaucuccuaucucuaagucauaaauggaaagcauuuaacauacuuacugaagauuuuuauaugugaaaaaugggaugguucagguagccuacagauccugcaaccgugguguguggaacauaggugucaugcagaauaaucucauguaauaagagguucagaggguggucgugacuagcgcaaugggaagcuaaguagauacgauuccaggcccuacccucacuacaaacagaagguccaagauuucauccucuuucuuauuugagaguuucauauuuuucauuuuuuugaaaaagcaauuguacugccaaacuaaaaaacuuacaaacaagcaacaaauuguauuagucuaaucaccucauuauacuaaagaugaaauaguuucuaaauacagauccuaaacuugcugucauuuaaauuucaacacagcuauccuuuuacuucaccaggcugccuuucuuaauuugauuuuacaaaggaaagcuuuuuaaaaaaaacuaaaacuaaaaaagcauaguauucuaugcuugaguucuuagacuacacauaaauauuuaggccgugcuuaucagaauuuuagaauucugaagagccucccugaacugucaaaaccucuaaaagccacaccaugcuggugaggcgacagaguaaagggaacacuuacauacugcugguaggaauguaaauuaguucacucacuguggaaagcaguguggaaauuucucaaagaucuuaauaacagaauuaccauuuaaaccagcaaucccacuacuggguauauaaccaaaggaaaauaaaucuuucugccaaaaagacauguacacuccuauguucauugcaguacuauucacaauagcaaagacacggaaucaaccaagaugcccaucaacagugaacuggauaaagaaaaugugguacauauauaccacagaauacuaugcagcuguaaaaaaaagaaugaaauuauguccuuugcagcaacguggaugcagcuggaggccauuauccuaagcaaacuaacacaggaacaggaaaccaaauacaacacccucucacuuauaagugggagcuaaacauugaauacauauagacacaaagaugggaacaagagacacugaggacugcuugaggagggagaugaggaggggcacauggauucaaagccugccaaucauguacgauacucacuaccugggugacaggaucauucauccaccaagcuucagcgacacucaguuuacccguguaacaagccuggaugcacaccccuggaaucuaaaauaaaauaagauaaaaguaauucauucaauuaaaaaaaauaggcugggccugguggcucacagcuguaaucccagcacguugggaggccaaggcaaguggaucaugaggucaggacuucgagaccagccuggccaauauggugaaacuaaaaauacaaaaacuagcuaggcaugguggugcacaccuguaaucccagcuacuagggaggcugaggcaggagaaucacuugaaccugagaggcagaggucacagugagcagagaucacgccuguaaucccagcuacuagggaggcuaaggcaggagaaucacuugaaccugggaggcggaguuugcagugagccaagaucgcgccacugcaguccagccugggugacagagugguacuccaucucaaaaaauaaaauaaaauaaaauaaaauggcacagaagcaucaaauguggauagaagaaauaucuaccuaugccucuguugaaauaucaaugagucugucuaauaaaugccugcaauaggcuacuuaauuaaaaugaauagcuuuagcaaucaccuugguugacaacauucagaaugaagagcaaauaauaguuaacacuuauucuacauaauuacucuucccuuccguacacaaaacauguacagagccugggcuugguaacacgaaauuuccaauaaucuaugagagaacacuuaaagacuuuacacuuaagaagaauaauuuuuggauuaauuuugaaucuauuuuccaaaaguaaaugacuuuuuaaaggccuagucaguuaccaugauaaauaaagacauacacuccaaguauuuggcacauguaauuacaguaaaaugaacacaccccauaucaagcacaucuuuguaggucaagauggcaauaagaaaguauuuuucacucugguccacagugaucaaagggggaucaacacugaaacuguauuucagaaugccagccaaaagcuuugaccaugaaagagaagcagugcuggccaguugcccacaagacugcauacuacauuagguuuuaauacauuucaaaaacagagaauuuauauagaaacugugacaauuugaagaaguuugcugggauaaucuuagaagacugaucuaaagacagucuaggacagcugcaugcaauucuaagagucagaucuguuuguuuguuuccgagauaagcgucaaauacuaauacagauaagagcuaaaacuaaaauaccaauucagugaaaaagcuaaaacccagaagacguuuuauuucauuaccugucugaaguuauuuuuaacagugacaggucauguucuauuucuucacugggguaagagagaauauuugaaugucccaaauauauuaaaguuauaggcaaaaaugcucacaaaccauuuagaaaaugauucauuuuacugucuaccuaauacugagcugaaauacucuacucuaagcugacugcuuagaguauguuuacuaucugcuaauccuauagcucgcacuuaaacaaggcugguuggauagauaauccagacaaaugcaggguuccauaacagagcauuuuuaaaugucuuaggcuaucaccuaagccacaaacaaaauugauuuuuccagacauguuccagugucugcuuacccuuuccugcuaccaacugucaucucacuccccugauaaaacucuugacauguuuugcaguauccucuacucccuucccauuccaaacagcugucuucccuuccuggcagaaacucccugacaucuggauacucaggauggcuacuguuaugauggacagauuccauuuuauccaacuacccagcuccgagaauauaaaaaugagcaaaaggaggagaagugugauaguuucaccagcuacacaaauacuaguucaaguaauggcuauauuaaagcauuagcauguugaauaauuuucuuuuaaaaguccaauuuugugacaucuguaaaaugauacagaauguuaaaaugcgaugauucugaaagaauacacaauuacaagcuuccuaaauuucuacucagguaaugacaacaaauccaagcccauagcucaaacauaggauuucugcuucauggccuaauuugauguuuuuuuacuagauuuaagaacaaaaacauguguguuagaugaagacagaugagucgaagaaaagacaaaacaugagucacuuuccuugagcucaucgcccauaucccaucaaucaccaguuccacuuugugcugcuuccuaaauauguaucaucucuugcauauucugcuacacugguuucuuaaacuguuuuccuauauccauucucccacuacuucagucuauucuccauaagcagccagugauauuuuauugaagugcaaauugggucauaucacccuaacacccccuuucuaaauccaaucaguggucccccuuccuuguagaauaaaaccuacgcuaguccacauggacccuaaagcuuugcauaacucuggucccagcuucucucuggcuucaucaggagccugucuuccccucacucaacauauucaaaccacacuggccuucccuccauuauccaaaugcaucaaauuucucccauuccuaaggucugcuuuagcacuuuucucuuugccuggcucccuccugcccaugguucagaucucaauuuauaugucacuuccucaaggaauuacucugcaaucaacugcaauauguuauguauccuuuuauaucucucaugggaucauggaauuuuucuuagcagcacuuuuaacaacuguauuuaauuaacauauuaagucagacauuaaagagauuugcaaaacuauaaagcaaugccauucucaauuuuugguuuugaaaaauuguuaauucuuguuuaaaaauguuaucuuaaugugcaaaauguuuauuauuguuuuaaaguauuauuuuaaaaaaauuuuaauuucuaauauggcaaauaucaauagauuuaacaacauaaacaaaacuucuuucggucgucaaucuuuuuuaggaguauaaagggauucugagaucgaaaaguuuaagaaccacugaauaagaaauuaaacuauggcuugugaaagaaugagauacuacauuuuaaauccuuuaggaauacuuaaaauuguaguuaaauauauuuuauguaggaaacaaagcuuucaaguaauguugcuaccuuagaaagaaaaugcuuaauucuuauauacugcuaagagaauuauaacaggauuguacagcuaggucauaagcaaugugucaauuauaaaacaguugauaagaaaguucaacuugccaugacaaacauaguuuacagcuuuaaaugaacaauuuuuucuuugaaagcauucuaacaaauguuaucuuuaauaacaaacacauauggccuuuaaacuuucaaggcaaagauucuugaaaaucauaauuaaaacaaaccuuucgaucuuacagaaaaguucuuaacagaagacuaacaauuuugcaaugacaagauggugaauaugugcucaauacuaauuacagucaugaugacugugauaucaacaaacccauauaugguacuuuucuaagagcuuagaaaucagccuuaguuacuauuauuauuagcccaaggauauguaacuuacccugcaucugacagcuaaguaagugacauaaaugagguuugaauccagggucugagcucuuaacucuauacugccuacauacauacauacauacauacauauauacauacauauauaaauuaaccuuucuuauccugcuucuaaacaaagguaagggccacccagucaaugcuuuguauucuuccaauauucuuuccuagaacuucuucaaaggcucucaugaagcacuggugaaacuggaaaucacugaauuuuacuaccauuuuaaccaaggcugaaucaaauaauuuagaaguuaauauuguuuauuuacccagggucuaucuacccacauuacucucauuuuguucacaaauuaucuaauuuccuacugcaucuggcuuugcuuauuuuggguuuucauugcuccugaagauuuuucuggcaaauucuggguuucugccccucguaauccuucuguggacauucaacaugaaauacuaacguuccuaggccacuggacucuuggaaagcuaaugcugugaaaucuuugcuuuguaauagcccuauacuuuguucaauaucuauuucaucuguguaacaaguauuauaaauaauaaaaguugggagucuccaguaacugagaaaauucuacccaaagucaacauauuuauguuaaacaaaagguaguuuguauucucaaaaugaauugaguuauugggucugacauccuccugauuaaaauguaaacuuauuauugaguaacgaacuuugaacauagucagaauuuuagagaaacaucaauuuaaaauauauaauuaaacagacagagggcuguaaguucaucugacagaauauguuuacuuuuguugaaauguuaaugaugucagugauacuucccugucccccuucauuaaucuugggaaaauaaacuaucuguuucuccucaaagcuuuguucuccucacuccauuucuucuuguccucacccagaagcuaaugaaguaaaagcuuuagggcuucuuaggcuaacaccccuucuaagaucuuguaucuaaaugugugguuauaauuguguaggcuuuauccuaaagaggauaaaaauugcauaagauucagacgcuacucaaccuggaucugccuuacgugaguuguaaauauuucagucaacuugcaauuacugcucauauuuuuguuucucuguacuugcagccgaggaaaauccuuuggaguggcucauggacaucagucccccugauacaaaagcuuauuuuggcaagaaaguggcaaagaauuacaagucaggauagaggcuaaacaugaauuuuagaucuaaauuucuaucaauagguaauuagaugaaaaacaauaauaagguagauccauaucagagacaaaguggaggccucuaguccuaaaugggccugaauaauuuagaaauguaacuuaaaaauguuugguuuugggaacauuuuauguaaaaauucaggugucaaaaaucagaccugauaaaacuggguauaaaugcucuggccugaauauauuuccuaucuaccucccuucacucauuuucaaggccugccuguccccaccuaaguuaaauuuaggcaagcccaaaggguuauuauuaaaguuauauuccucaaauuauggaaauaaugcccaagagauauuaauuauuaaaaaaaauaaaucaacugacauaauagcauucauaauagcauucauacuauguuucaacuuuuauuuuaaaugauuuauauaauuucuaagaugaauucaaauuauuuauuaugguauacaguauuuuuuaauauucagcagaaaaaauuaagcacaaauuuuauuuuaaauaacauuuccuaccaccuuuaaauauaacuucaguagcagacacuguguugaugguuuggcuaaaggaggacaagaaaauaggaccugcucaaauucaugcaugguggcaacaaaaauucagggaucauggcaccaaaaaucuuguuuuccaggauggaucacagacugaggaagcacagauuauacauuuagagccgacauucauuucuucacagcaguauuagaaaagaaaagccacagucgaugccauuuccaucuagcugcauccaagccuuucugcauacagagaaauaucuaauuacccaauacacuagagcaacguguggggauuguuuuaauauauauucacagcaugugucauuauggcuccuggcggcuauuaaaagggugggcuagcaacaugaauuaacaauaacacauuugguauaugauggcuuuauaaugccuaaagcauuuagcuagucucauuauucuuaaugugcccuacagcucacaagaaucauguaacuguguauucagcuggucccaaaugcuaaauggaaagcaaaauaucuccuaaaaguaguucugaguaacugcuaugucuaguuuucuuccuuuuucaucaacuaacauggcauauguuauaaucaacagauaguucuguuuucagaacguuuuuuuccuuuuguuuuagacaagcagaacaacucauaauaguagacaacuucaccaggagaacagcaguucaguacaacaggaaggccagugucuccccaguaccaccugcuuaagcuacuacaaggguucccuuaacagagaugccugccucuauccauccuccuacagcccauucuccagucagcaacuauagacaucugugaaaauaucagaucguaucacauuacucuucagcuaaaaguacuccaguggcuucaauauguacuaagaauaaaaugcaaacuucuggucauuucccacaaggcuccuucaugcgguggcugccuacuuaucucugcaacuucuguuuguaccauucucauuacuaaaccugaaacacggcgcacaccuguaaucccagcucauagucauuccagucauuccacacuuuuagcauuucauggacccucagccuggaauacccuucccauagaucuuuuaaugacuggcuccuucuccuucuucagaauucugccuaaaauugaucuccucagagacuauccuaucuguagcaaccauuuuuucccaauucucuaucgcuguccuauuuaauuuuuuuuuuaauuaggccuaguagagugaaauuaguuguuuuuucagcaugauuucuuaucaacuaucccuauauaaauguggguaugcacacacacagaaauucgcauuccauuaggagcacggccuuaucuaucuuuccuauuaucaccuccccaguacguggaacagauacugguaggcaguaagugcucaaaaauuauugggcauggacaaacgaaccugcuaguuaagcauuuccauccaggagacaaucaagggagcucaacuugggaauguauucaaaucaacucuuugaaauuccaucuaacaacacaggaaaucauucucucuuauuuauuuauucaugcauucauucauucauucauucauucauucugagccaggauucaaguccuagucccucuuacuagggcagaaaaaguauaagcucucgagaagaaauuauauucuucuacccuccccucccuguucuucaacuucagucauucaccugcucucugguaugguuucugccacuucuguguauuacagguaccaacuuucacucaaugcucuuuucaccuuuuuacaauagccucacacuaagcauuagguuggugcaaaauuaauugugguucuugccauuaaaaguaauggcaaaggccaggcaggguggcucacgccuguaaucccagcacuuucggagguugaggcggguggaucacgaggucaggaguucgagaccagccuggccaacaugaugaaaccccgucucuacuaaaaauacaaaaauuagcuggguuaaaauauuauuuuaaauaacauuuccuaccaccuuuaaauauaacuucaguagcagacacuaugcugaugguuugacuaaaggaggacaagaaaauaggaccugcuauggugugguggcacacgccuguaaucccagcuacucaggaggcugaggcaggagaacugcuugaacucgggaggcagagguugcagugagacaagaucguaccacugcacuccagccugggugaaagagcgagacuccaucucaaaaacaaaaaguaauggcaaaaaccucaauuacuuuugcaccagccuaacaguaauaacuuuaggauaaagaguuugcuaggacuaguuuuuccugaauuacauuacaauuacuccuugacuauuaaaacacauacccauacguaugcauuuacacguauuuuuccaucuacaauagucuccuccaacauuugggaaaacuggaucagagaugaaggaagacuuucuuccagggauagaggcuccccucaggcagaaugacauugcagagucccuggagggcuccuaacuuuuacuaggcacucaguggugucaugcucugugcuuuauuuauuacaauaccccuuugaggagguauucauauaauguauuuugcaggggaggacccagguacagggagcuuaagucaauaggacaaggucacauagcuagcaaaaggcagaagucguguucaaauucagguccaucugggcaccagauccauucuuggaaccgcugaaucauacaucaucuuugcaacacguaagcgauccaugcuuuguuuuacaauauacuucuuuccuaaggugguaauccgagagcuuuuauuuacuuauuuuauuuacuaaucuaaaaacugcacacacccaccuucccuucaauauucccaaguaacaagcuuguugagaaacccuacugaaaacaagcugagccuucuuuucauuacucagugauuuuuaaguguugcuaguuuuuauaccauuagacuuuuauuuucauaauuauaggcugccaugggcuucuuccaaagcccccugccaagucuucauuccuacauacaggugcuaauugcuuucuuagcaccacugguuauucucugaaccuuuggauuucaccaccuacaauaggacccuggguuuuucuccccuucaguaacccuuagcacaauggucacagucacuccauggcugacuugguucuggcccacaagucucaucuccucauucucaaagcggagucaaguuaauucugugcccgugcugcguccuguucucucucaauucuuggucguggugcuugauccucagguuaaagcaacugaacucuaguagcuuugaaacaaacuuguauguuuccuccuccccuccauauagugugaacuauauauaacuuaaacauuaacaauaauagcaaacuuuuauugaguuccuaucagucuccacaccaaagccucucaacaaauuuauuucguaaaaaacaaacaaaaacgagcaaaccucccuguggaggaguaccgauuuuaucccccuuccgcuaucuuccagaagacagcacugagguucacagaggagaauccauucuuccugguuccagaguccguacucuaaagacccacuacccacuaucccucuugugaaaacugucccaaccugauccugaugcaaaaugauggcaaauaaaaggcaguagauagauuuuuacaguaaaagagaaacagaagauaauuaacuugaguugugaaaagaauucaagaagggagaugcuuccuuucaagacauauaaucugcuccuguaugucuuucacuuguucuucaaggaaucuucgaaauguuccccucacaaaguuucuccuuaugcucauaucccuccuaagccauccaugaggguacccaugaaggcccaguucaccggagcugccugacguacugauuaucccucucuaaagcauccucuuuuggacaacaaauuauauguccacccaaaccauaaucuccaugagggcagggaugugccuuauucuccuuuuuaucucucaccaggauuuuuauuuuauuuuauuuuauuuuauuuuauuuuauuuuauuugacagggucuugcucugucacccaagcuggagugcaguguguggucuuggcugaaaacuccggcucccagguucaagcaauucucuugccucagccucuugaauagcugggauuacaggcaugcaccaccaugccuggcuaauuuuuguauuuuuaguagagacgggguuucaccauuuuggccagacuggucucgaacuccugaccucaagggaucuguuugccuaggccucccaaagugcugggauuacaggaaugagccaccacgcccagccaggauuuuccgauuuuaaaucaguacuggaguaaugcuugcuaagaagucuuccccccaagcuagguagaauuucgucauuacuaaguccuucauagcauuuuguguucgucucucuuacagaaauuaucacaugccaacuuuaauaguucacagaccauauaugccaugccucuguggcaggccugagucuccacucaucuuuguaucccuagauaccugauuagauacuuuauccagugacgugguuaacuacaugcugaccaacugaacucaauauucuuuugauauccucauuuugcaggcaaacucuuacuguccugccaauggaacagaaaauuugagaguugugagaucaaugauacaccaagugcuggaggaaagaagacagaguaucuguaccuggagaacaggagaaaguuuagaaacagggcuaaaggacuaggagguauuaucuagguauaaaugucuggguauuagggaugggagagaguugagagaaccucccaggaagagggaaaagacagggcagauacaagacagucugcacgcagaauggugugaguagguuguguggcuccugauggcugaaguuuaaaaucagaagggagauuugaguagacgcuuacuucucaacaggcuguucuguuaaauaccagagcaacaguaaauaagcauuuaaugcaaaacuugcccucuuaaaacagcgacuuugggaucaucaaaacugcauuguaacugaagauaacagacggacaggggagcaaauagaugaccucaggacagcuuauuuggggcugagacagaauacagcauucucucuccacuuuugcacuucccucagcagaucuacagaacugcagaggaccaaguccugaccaggaaugugaccauaccaaagggaaaacagucauuucaacauuucugugggugccugugcugaagggacccagugaggcugggcgcucuguuuauaaaacauaauacgaaucaugggacuaagcuauuuagcagagcagcaaugggacagccccacagggagagaaagggugaggagauguuaacaaauggucucaggggaauccauuuggggaagaaggucccaguggugaagaaggaccagaggacuuguacaacagagcugucuucuguucaauuaaaaagcacuguuggcugggcgcaguggcucacaccuauaaucccagcacuuugggaggcugaggcaggcagcccaccugagguagagaguucaagaccagccugaccagcagggagaaacccugucucuacuaaaaauacaaaauuagccaggcauaguggcgcaugccuguaaucccagcuauucgggaggcugaggcaggagaaccgcuugaacccgggaggcggagguugcggugagcugagaucgcaccauugcacuccagccugggcaacaagagugaaacuccgucucaaaaaaaaaaaaaaaaaaaaaacacugccugccugcacuauacuaacauguucuguaaucccucuccuuuacccuaagccuuuacuguugcugcacacaaugauugcaggauuaaagcacuuuggaaaaaugaaaaacugggaacguguccaggcugaaaggaagcauggagggaaaacaacaguugguugucucucgagacuagauauagaggaaggagggagaaucaggaaggggacuuauggggucacauggaugugucuagggauaagaaugagaagcaaauaaucauacagcccuauggccuugagaagugcugguuuuggagcacgcaucuaucuguggacacugauaucccaucuugucucuauugucacgccacuucucuaugugaaugugagccauuaucuucuccucuggcuagaacaucuaucuaccuaacguaguaaaugaaucaaauuuaauuuaaaggaaaaucaaaagucauuuccaugcacugacauaagaaagcacuuaaucucaauaaacuagcaguuaggaugaugggaaaaucuacaagggcucagagguaugcagcaaaucaaaauucuccccauuuguauaauggaacaaagccaaaguaagcuuucuuccuggccuaaaccacauaaccuaacaccuguuagaaaaaugggcuggggcaaugagcugugaccaccggugauucaaaggaaucacuaaacucuccccaccaguuucacagaacugcauuggaaaaugacuuuuaccaagauucuuaauaaaaucaacaucuuugccuguuucauacauuauuagauuuuauggcaugcauuucagaacucuaauaccuuaacucugucuacaagugaggugggauucccgaaggaccaccaucccaccucugaaaauauuuucauuacccaagucagaggaagugaagaaaugaaagcuuccugaaucuggccagcuaaauagcuugauucaaguguguuauguuuucauuauuuacauuucccuuggaauuugagggcugucuucaaauuuugugacaccuguauuuuuuucaccuacuucuguucagugauuuccuggaagaaggaagaacacggcugaaaugaacaaucaacgaacacugauuuaaucuauaccacauuuaccuccaauuagguaaaucauggaucacuguuuaaaaauauuuuuacaaggccauuggauaaaaacaaguauuagguaucagucagugcucugauuugggaagagccauuuacggucucuaagcuuaugucaucucaucuguagaaugaaagugacugauuccccacauggcuuccaacuccaagaacuucuggaaugcuguacugacacucauacagagcugauuugggguuaauuauuguuuuucauuucugcuuccuuuucuugauggauuuuaucaaaaagugaaccauuuuaaaaagcaauuacuggacauuuuuuaagaacugcaggggagcuggagauaguugcaagagggagaccuauuagguuuccuuuuucuuuuacuaccacuuaacuuuuuccuccaagccucuugccucacaauaaacauaaaaacagaugacccuaucacuccagacuguccuucauaauggcaacaacaacaauaauacaagcuuuuaauuuuugaacucccacuguacggcagaccuuuaucucauuauuggaaggaguauaaaguaaggcaugaaaccacuggcucugacauacuguaugaucccauuuauguaaaauguccagaauagacaaauccacagacacagagcaaagaaaauuagugguugccagggacauuaagcauaggagaaugagggugacuucuuaaccagcacagggcuuucuuuugggaagacgaaaauguucuggaacuauuaauagacaggaguaguuaugauuguaugaccuugggaauacacuaaaaaagccacugaauugcauacuguuaaaaggugaauuuuuuugguaugugaauuauaucuacuaaaaagauaaaauuuaaaaaaauaaaacacacauccauggcucuggauggagauuguccagguucaaaucccagcccuaccgcuucucagcuuuucuaagccuaaguuucuacauguauaaaaugggagaaaugacaaauaccucacaaggaaauuagaggacuaaauaaugcuacgacuuuuagguacaaaggccaauuuauagcguguuuuaaaaauauucuuacgagacccuugaauaaaacaauauuagauaccaaccaguucuuugauuugagaagagccacuccuggucucuaagcuuaagucauuuugucugcagaaugaaggggacugguucccuacaugagcaucccauaaauuuuccuauucuuauguaauccccacaauaguucuauaaaauacguagaacauuacugauuuuagagaugaagaaacaucaguaaagggcaaggaaguugcugagccacuaaguggcagaggugagauucgagaaaugucagaauggaaccucacacucuugagugacacaccacugccuccugacccacauauuaauaacccagcauauguacgaacugcuuacugacuucuuacuauguugcagaaacucagggacagugcccucaagaaagucauuaccuggccacuugcaguggcucaugccuguaaucgcaguacuuugggaggcuaaggugggcagauuacuugaggcaaggaguuugagaccagccugggcaacauggugaaacccugccucuaccaaaaguacaaaaauuagccaggugugguggugagcaucugcaaucccagcuacuugggaggcugaggcaggagaaucacuugaaccagggaggcggagguugcagugagcugagcuccugccacuguacuccagccugagcaacaaagugagugagacaucaucaaaaagaaaaaaaaaaaaagaaaaagaaaagaaaagaaagaaagaaaagaaagcaagccauuacccaagaugggagaagaacaacagugcccagggauuaaggaaauuaaggaacagguguacacaguaaaaguauaaaaguagauauuuuuaccauauaauucagaaccuucugucuuuagaaggggacuuuccuaucagggaaaauccagaguaacugggcugagaaaaaacauuauguagaugaacuuuugagaguuucuaagaaaauaauuaagagacugagugcuguggcucacacuuacguauaaucccagcacuuugguaggccaaggugagaggaucauggccaggcauugaagacuggccugggaaauaaagcaaguccauaucucuaaaaggacuuuuuuaaaguuagccaggcauggugaugcacgccuauaaucccagcuucucaagaggcuguggcaggaggacagcuugagcccaagacuuugaggcugcagugagcuaugauugugccacugcacuccagccuggccaacagcacaagacccuaucucuaaaaaagauaacaagaauuaaguguaaucggccacucaccucuaugccaaauaccauauuuuacuuaagauuucaaaucucguuguucaauaccguggccacuagccacauguagcuaaauuuaaauauauuaaaauugaauaacguuaaaauuuugguuccucaguucacaccaccacauuucuaguucacaagagccacacgcggccacuggcugccauaaugaacagaccagauaaaagagcaugucuuucaaugcagaaaguuuuaagggacagcacuaaucuaaauauaaaaucacaucauucacagucaaauaauaagagaaaaugcaacauuuuauuucauauccuaaaaagagauuugguauccaagugaauaccuggaacuacuauaaaugcucaccuaaguuguaagaugacauuauaauuucuuaucuacacuuuaaaaauaacauuaucugaucauauugcucugguguaaagauuuuccagaaaaaaaaucacuuuccgagacuccuuauuuuuaaaaaucgcagauagcauaggcaaacagauaaugaacauguaagcucacugcaucucaguuuugaaauggauucaauucacuggucuugaaaagaaaaguucaggacauuggggaaaacucaguugcucuggucucugaguuaauagccuuaugaguagaaugccuuuuuguccaaagaauucucaaaauaguauuauuuuuguuuauuuguguuuuugagauugaaucucacucugucugcucaggauggauugcaguggcaugaucuuggcugacuaugaccuccccauccuggguucaagcaauucuccugccugagccuccuaaguagcugggauuacagccauaaaccaccacgucuggcuaauuuuuguauuuuuaguagauacgaaguuucgccauguuggccaggcuggucuugaacuuuuggccucaagugaucugcccuccuugaccucccaaagugauuacaggcgugagccaccacuccuggccuuaaaauauuucaauaaccauucuaaugugagcagacaugguaguggcaacaacucggaaauaaaauaaucuuaugagguuuggucaaauacgccaauaaagcuccucugccaucuugccucugagccaugcucauauuugugaaaugggaggaaaaauuuuucuccuucuuugcagauauauuauucuccuucuuugcagauauauauguguguauauauguguguauauguacacauacacauacacagaagcgcacacauauccaauagaaguugguaucuaucauccaguacuucaguuuuuaaguauaacugacacacauauacauauaaauucaauuaauuauuuuacagucugaacacuuucauguaaccaacgcccagauccagaaauacaguauuaccaacaccucagagucuaccugccgcagccuuccagguacccucaaggguaaccaacaaccugacuucuagcaccacuggugaacuuugacaguuuccacaucuuacauauguggcacucuuuugugucuagcuuuuaucacugaacaagacaccaucuaguuuugacagaucuucgccacaaggcagccauuuaaugcuuuccugccuuauagaauaacuaauccuuauugagcacauauuaugugucaagugcuuuacgugccuugacuccuuuaauucccccaaacaagcuuaucaguaaaguauuauuauuaucccuauuaaauagaugagcacauugauguguaaaauuggcuaggcuauaguucccacuuauucaguuacauacuaaucuagguauuccugugaaaggauuuuacagauguaauucaagucucuaaucauuugacuuuaaguuagggagauuauccuggguggaccugauuuaaucaacugaaggccuuaaccauagggcugaggcuuccaggagacagggagcauaaaauaaggagggaagggggcauuuuucuggagcagauaaccaugagcaacaaucauccauuaacuuauacaugccaauaacagaugucacaccaacucaaagacaaggcucuucaguucauucuugaauaggaacuuguaguagaaaugguaugugccacauuauuuuucaagccagcccugaugucauuuguucaugcacacugucccuguaagaacacucucauuuuucaaguccugcaucauauuucaaguugggaaaaauaaggucacucuacacaugguagggugauggagguguuuuuggacagccagacuuuucagauuuacucaucuuuaaaagcaaucucagugaaaggcuucucuugaguggaucuaaauagaucucaaguaaaccuaggagauuuuuuaagaacaggagcaauuucuuccauuaucuuaucccccuuaacauauaucauugagcaggacugaagggaagucuugguaaguacagaugcauguuaucauuugucuccucuuuuucuauugaaggcugauuuuaaggauuuuccauuuucagaggugaaauuaaauggaauccuuaguuuucccuuccaacccucaagacuuccuccucaagucuucuccaucucaauuauuagcgucccacauucgcuggguuuccugggccagacucaguagugaucagcaagucaguucugccuccaggcauaucccaaagcuaaaaucuuaucuccaucuccaucuccaguauaagcacccuuguucugaccauucuguuugcuaaacacagacaaggagaccugagugaucuccuggcuuccacuccugccccucuaaagccaugucauauacaacagagagcucauuuuaaagcugcaaauguaguaauaucacucuccugcguacaacuccaaaugagacuggauaugugaugacacuaaggaaauacugucaacuuuuagaagugauaaugauacuauggcuauaguuuuuaaaagaguucugauguucuagagaucuauggugacaaaugacagcaugccuccuucaaauaacacugugcagugguggugacugggaaggggugcagcuggagagaagggauagguaaaauaagauagaccaugagcugauaauuauugaaacucggcaauggguacauugggagucacuauacuuuucuauuuucauaucuuauaacauuuuuauaauaaaaaacuauuaaauccccaaugacuccugacugcacuuagagaguaaaaucuuaagaacuuguauggcucaaaagguauuuaaugaucugacugaugccuggcaauccaugauuuuauccaguacccagcuuuguccauuaacugccaaacagcuguaacagccaucccgugccuuccagcccuuugccaccauaggaccuucagacaggcucuuuucagccuuagagggcuccuccccaagaugugccagaugugcccaguguugggcuccuucuccuucagguguccacuccaacaaacuccucagagagggccuccuccaccaugcuaccuaaagcaccuucccuccccgcucuccuccugcccaccccucugcacccuuaccacucuaccuauuuucuuucauuauuucuucauaauccuuaucacuuuuugaaaucaucuuuucucuuaaguccuuuugaaaaauaagcugauauaguuuggcuguguccccacucaaaacucaucuugaauuguagcucccauaauucccaugugucaugggagggacccgguggcagguaauugaaucaugggggcaggucuuucccaugcuguucuugugauagugaguaagucccacaggaucugaugguuuuaugaaggggagucccccuguacaugcccccuguacuuacaucuugccugccgccauguaagaugugccuuugcuccuuuaucuucugccaugagugugaggccuccccaaccacguggaacugugaauccauuaaaccuccuuccuuuacaaauuacgucucagguacaucuuuauuagcagcaugagaacagauuaacagacaagucacuuauuaucaauauacuccccauacuagaauacaugcucugagaucauugggaccuugucuguccaguucacuugcaugcuuccagugccuaugauagugccuagcauaaaaguaggauuccaaugaugacacauuacacaaauccuuuaaaucagaccagacaauuaaagcuguguacauagcacagggacaacaaaaaauaauaauaauuaaugccuuggaaagugaaauuauccuuacauguauauaucuguaguauuaaugaauaguuaacacuaacggauuucauuugaauuaaacauaugucaacauaaugaauaacuacuuacacauauuaacacaauuaaugaauaauuaauaccugugaguuuucucugaauugcauucaauauauccauacacaauacaugcacauacacauauagucuuuauuucauuauucugauaccgaauauauaacaccauuguuggcuuauauguaaggaauaugacaguuuaugauugcuauaucucgagcaggagauuuugcuaaauguauuguugccagagcuuagauuuuaaaauucauuucuaagucuuagcugguguuaaaccaugucagcauaauaagcaaguuuugauuuccuuucagauguuccuggcugcugaaagaauugauuuugaagauuuucccauugaccuauagggcugugaagaagagauagcucuucuuaaucucaaagauccaaacugaguuuacauuccccagccuuuguuuggaugucaccuucagagcuugcuucauuaugugucucaggagaaacacagaaguauuagugauaggacacugacugguagacuuuaauccuucuuugagauguuguuuaauaaugaugguuuaguaucacauucgaggauaacuguaguuaguuaauauuuuuacuuuuaauauaccuacuuucccaaguacaaauuuauccuggggcuacguaggugacccaagugcaucaggagcaguuucgaacaagguguaacuucucaacguuacauggaauaagagagagauucaaaaaucacauccaaacucaaacaucauuucaaagguccuuucccaucuuccucuccccaaaaacaacuaaaacauggcauauugcaucuuucaaccauggucaaaauccuucucuguuaaguagauucuauguauuuuuaaauaucuaugcuuuuguuuguuguuuuuuuuuuuuuugagacagagucucacucucucacccaggcucgagugcaauggcguggucucggcucacugcaaccuccgccuccuggguucaaaugauucuucugccucaaccuccugaguagcugggauuacaggcacccauaaccaagcccagcuaauuucuguauuuuuuaguagaggcaggguuucaccgugauggccaggcuggucucgaacuccugaccucgugaucugcuggccucagcccccaaagugcuaggauuacaggcgugagccaccgugcccggccauaucuaugcuuuuaaguauuguuuuccuucucagacguuugagaaacucaagaaggaaacauuguauacagacucagacuuaaccucaaugugaacauacacagcaacaucauugacagucuacaguuacaugaucucaauggcaagugugguccacugugaugucaauuuuauaaagggaagcuugaaaaacaucacaacagaaagaaagcugucaugcuugcuuugauuaaagaggauguaguauguuucauaaacagguuaguucucacaggaagguucaauaaauggaagcaaaaagcaaaaacucacaauggagauccucccaguguuugaauuuuaaaaaauaaaggucaguuuaucacuagagcguucaauuggcuccaggguucauaggguauuguuagacuagagcuccuuuugcuaaaaaacccagaggacuucuuguauuuugcuucuagcuaucugggucugcuuuuaauuccucagacauacucuucugcugcacguaguucucacaccucaagacccaugaguuugcugucugcccaaaugcaucuucucuaucuuucaacauccaaguugaaugcaacuucuuucagaaagccuuccauuuccaugacuaguaccucauuuucaaaucaauuccauuguucuaagugguuugaccuugcuggguucaugcuuuaauuccucugauuguaacaauaaaaaguaauuuacuuucuauguguuugccacacauacuagaugaggcccuugaggacaaagauagcaucucauuugggucuguguccccagagacuuccuccucagaaaauguugaaugaaagaaucaaauaaauaaaggaaugaugaaugaagcaagccaacagcacccuucaacucucaguuugcuucaaauccccacuacuacccuuccauucuauccccaguagaauuuuucuauucucuuuucagucuuaaacacuguuaaaauuucaagguaagcaucacugaaaacugaagugcuguggcacaauggguuuuucuaaugaauuauuuaucuguaagcaguaguucauauucacauauuuuuuagagaccaguugccuuucuuugugaauggauauguucauguauccaucuauuagaugcuauugucuuguuuugcaaggcaauugaguguuuuauuuccuuuuuuuuacuuauacaguaauauuugaaaauauucucacuguaaaaaauucaaaccauauagaaaaauauaaaaacucccuuaucacuccuuuuaauccacuuuccuccccaaaagcaaucuuuauuaucaguuucagaucuuuuucuaugcauuuagcuacauaugcacauauacaagcuuuguguuuggguaggagucucaugcauauguagaaucauaagguuuuauaaacuucucccuucaauuaaccauguaucucagagauagauagucccagauaaggaacauaccucauccacuuuaaguacuagcauuccacacuuuggauauaccaacauuuauucaucauucccauggugacuaaaauauauugauacuccauuuucacucuuacaaauccuagaucauauuucuuuaugaaaaagcaccaagaguuuucaaaaauagaauuacuagguugaaggguaugcacagacuggcuucccagaguauggaacuguuuauuucuccauauccuuaaaaauugugaauauuaacagguuuuguuuuuccauuuuuuuuuuuuuuuuuuugguuaaucugaugauagcaccuauuuccuacaugaccuaaaccaguugagaaaugcccauauuuacaccuaccaugguguguugcgacuggaacagguucaagugaaauauaccaagugacugcuaacagccuccuaccuaacuccuuucagcuuacaucccaguaacauaaacagggauccacacugaauucacguuuaauuaucagaagacagggaccuugaugagugucuucacauaaacuaucuuguuuaauccucuuagaauccugugaaauagaaacuuuuauuccuguuuuauguuugaccacagugaggcaggccacccaagaucacaagauuguacuugauuccacaaagcgcuccacugaccccaaauuaagaaacugccccauacuugcauucgguuugcaguuuuccacuguuauugcuucuuggugccuaauguaacuacccacauaaaaacugaagaugucucuaccuauuauuuuaggaaaagcucuggcuuugaaaauacugaauuuuucugggagaagcagcugguuagaggcagguagaaauuaagaauuugugggccgggcaugguggcuuaugccuauaaucccaguacuuugggaggccgaggcggguggaucaccugaggucaggaguaugagaguagccuggccaacauggugaaacuccaucucuacuaaaaauaauaauaauaaaaaaaaucagccaggaauggugguacaugccuguaaccucagauacuugggaggcugaggcaggaaaaucgcuugagccuuggaggcggagguggcagugagccgagauuguaccacugcacuccagccuggcaccaagcgagacuccgucucaaaaaaaaaaaaaaaaaagaauuuguguaucagcaacaaauacaaacuuuauuggacacucccucccuuucuuaaugaguuccucagguuuuuuccagaacuaaaccaagucaugaaaugucagauaauaaagcccuuaaguauuaauguacaguauaggugaauggcuacuguacuuacucuaucuuagcgauauuuaauaauauuaaauguuuuaaaacuauccuaucuaagaaugaaauaaaagaaagccaugguuuuauuaucuuaagaaauuuauaccacucaacuagcuguacuaagcaaaaaaaaaaaaaaaaagucacagcaccauggaaaaugaacacaaaagaugcuuucuaaaaugcugaaaagcauaaaauaaaagauuaaaacauuucacuaugcauauguuaugcuggaaccuugaagcuaucgccuacaugagaaugguacuuuaaagauuacugaauauguuuucugaaaguauagaaugaucgauucauuuuucaaacccuuaguguaguugcacucuuccuuucccugacagaugacaaggcucagggaaagcaaagaucagagcugaggaacaacaaaaaaaguuggcaccugauucacuuccccuucaugccaacccuguuuuucucccuuaucauacaacaaagcaaaaagaaaaguauugaauaugaaaaccaaaaagauuccccaugacugagcuuuggcaaguacaaaugcauuaggaauggagcugauuccugugaccuuuucaauuaugauaauccugcaaagaaaauuaaaaucauuuucuaaaacaugguccaaggaguuccauagauaauugaagaaaauauuuaggaacaucccuggcauuuuucuaagaauguauauacuuagcccaggucuguugcacacugcagccauuucagccaugaguauuugugagcaaaaggucaaauuaacuugagagauauuuuugcaaagccuacuuccagaguuuuugcccuucauuuuuucuuuuguauauauuuacauuuugaaaugggaagacugaaaaagagggaagcuauauacuuguuucugcuuuggucugaaaauuugguaguugaauguacuucuuuuugaaagcaucuuuuuggcugggaggagaggcucaugucuguagucccacuaacuugauuuggaaggcuaaggugggaggauugggugagcccaggaauuugagagcacccugggcaacauagggggaccccagucuuuuaaaaaauaaaaaacuuggcugggcaugguggcacauaccuguagucccagcuacucagggggcuaaggcaggaguguggcuuaugcccaggagcucaaggcugcagugaaccauggucauagcacugcauuacagccuaggcaacagaccacaacucaaaaagcaaacaaaaaacagaaucuuuuuguuuugggcaugaaaaauaagugaagaggcuuuagaguuccuaggaucuccacuggauuucuaacaagcaaaaguuucccuaaagcauggaaaaacacacagauuuaacuauauuuaaaguaaaaugauccacaaagcucauccuugcccaauucucauuuaaugaauaagaagacuaaauacuucagaaaaucaaagacuaccuuacuaauagacuuagauaaauggauuucaguuuagacccaagaagggaagucaaaucuauagauacagcaucuaagaaguugagaccuugguucucuauucuacucucccuauuauuggccuuaugaccacaaguuggucaguucgccucccuaagccucaguuucucacagggaaaauaggaauauuagcaaaugacagagcaaauucacaggacugcuaucauaggauuaaauaaaacaacacaaaaaacuguaaaaauuauauaauacaauguaaacaagcaaauggcauaauaauuauuuguccuuguucaccaaguuagguuuucaauaucaauaugcaucucccuaccacagcaggacagagacagcuacaguuacuggaaacuauaaaauggguuccagucaacaaaagccauuggacugcuuucugauucuucuaauagaaaaucagagcauuaguaggagagaauggggaaaaaaaggcuuugcuucaaauuuauauuucuguuccugauaccuauuaagagccaguuauguagcuauuaagcuacagcuugcaauuuaaaauaaauaaacugauaacaaaacccuuaaauuuccaucaucagagcagaucaaacuacaacauaugcuaccgaggaugcaaagcagcuaaugaagacuucaauaucaggauuaugacccuuaauuucaauaggaauguguucuguuguuugagcucacacauaacgagaaaaaacaucacggaagcacaaauaaacugucucauuaaaaagcacuuugccuugguccaaauauaauuucguuuuuauacaauucaaaugcuauagaacaaagaaagagaaggaagagggaugauaaaugcagaggacuugggagggaagccuguucugcaauaauugagauggaaaggaggguucaaccugcacuccuuuguuuguggagacaaaguccucaacagcuggcagauagcaggaaguagaaugcugauggcuuugcaguuagcuucaaaaccuauuagcaacccucagauccaagagcuguaccugcuuugaaauaaaccaggaaauagggaauaaaucauuucuucuggagggaaaaaaauuguuuaaagugauuaaaacaugccacagguuucucacacaggaggaauuaaggaaacuauuucagaacuuaaugggaccuguuaaaaaaaacagauuuguaagaauuuaaaaguaaauauuucuuuaugcaaacuuaucauagugaguaucuuuuaaauacuaaagcuagggaugcacuugcaacaguuuuuaggaaacggggguggaauggggaaucacuucacugaagaaguuuaaagacauauuuauuccucuguggauuccauuucuuaaaagacugcccugaaacuucuuccuaaauucugucauaauucccuaagacaguaccaagggaauuaucauucuuuauuagaugccaaagaaacauaacaaggaucacaaaugaaacaccagaaaauuuaucaaauaagauuggauguacagacccauucuaaagagcauuccuucucccccauguuuuaagucaaauuuauauuaaaaaucuugaauuuucuaggaauuuuaaguacuguccccuaauuuuccauuaauaagcacgcucaugaguaugaaaaaaauauuuauuuacaugcauuuauuauaaugggccaagaaaauauuucuauguaaagguacuaucuuccuauuaaucuguaguuuuuuugcuuuuuuuguaaggguugaaagaaagagaaaagcaacagauugcagguggggauagaggcaaagagagauaaacgguagagaaaccaguucugaaaugucagggaauugccuggagagaguuaaauauacuguuucugcggacccauucccagauagguaccgccuauuccuacauaugaagagagaagagaugaguuauauucaugacuaguaggaguuaguuuaucuugcuucuguuuuuuaauuuuacucuaagacaaagggacugcuauaaaagaggaagaaguggagcuuacucuaauuacucuuuauuauucucuugaucaucaucaccucuaguaauuuuguaauucauuacaguaauuuaucuaaguuuccaaggauuuuaauauguucuuuagcuccuagguagagaaaaauugugguaacaaucaaaugacuaaucacaauuauugguuaggaaaaugaaaaucacaaugcaaucauuauaaaaacaggguguguauguaauuacacuaaaacuucauugauuuaggccauuauuaauauuugguaacaacuaaaaauauguauuaucuuucacguuuuauuucuucccagcuucuccaguaugaauaagaauguauacaagaggauguuaaugaaaacaaucuuacagcaucacaugguauuaaauagauuuuuaucuguagcuguauauuucaaauaaaauugauauuuugcuuauuuucagaggaaauuuguuuaaaauccuauaauauuucauguuggcuucaaacucuauauauuucaccccaaaccguuucucaguacauacuuacauccuuuuuucauuaacauguucacaaaacccauuuggguccuuauuuuucugcaaaguacauauuauuuccaggcauguucuauauucguguguauguauguuugcuucuccccaauccacauaaucuucaugagauaaauuauauugccuucuucacuacuaucuguagcuucaacacuuagaacaaugccuugcagagagcagguacuugaggcaaaguugacugcuuagauaacuccaauaccucuucaccucuucccaucaguaacuauauuauuuauuuuuagcugagcacagggauccccgaaauaaagaccacaucuucuaauuucaaguugacugcuuuugccccuucuucucucuuucauucuuucuauugguuagaagauggucauaauggcugaaaacucuauuagacagcacugcuuucaguccuucuuccucauacaaacacauauguucauauauauauauuuauauaaacacauacacauaugugaacaucuccccaagcuucuccaucuccuugcuuuuugucagcauauuaacacaccaggagaaguagauguuagucuaaucuccaagccacuaggucuuuacuugaauugauaggcacauuuucaagugaaccacaauggccuugaaucagcguucucauuuuaucagugugaugucaauauucaguccaaaacuaaaaaaaaaaaaaaaauuagauuugggccacucauauuuaacacugaauaugaagcaaauggauuguucgccuuugggaggguggucuaugauuaaacagaaauacaggguuaccucuaagcagcuucauuuugcucacuuggauaacuaucugguuaagugguauucacagaugggaaaagaguuaacacucaaugaaugcuauguugucauuaauucaacaacugaacaaaagggacaagauccccacacucauaaagcuaacauucuaguggggcaaacaaagaaacaaauaacaucaacaaaccacacucaauugguuucuucagagaauguaacacuacugacaaauuaguauugucaagaacuacuggccauggagaggcgauggggagagcuugaccugugccugcauacacucuagggacugagcuuaaaaucuugacuuuaagcucaacaaauggcuacaucuuuugaccaaauuccaucaugcuuuaagcuccacgguuuaagccccugaaguccuuuagaagauagaggcaacggcucuuauuuaaucuauagacaccaguucaacagcagaaacuauuaucuugaacaggguaacaccuacaaccgugaggaaugauaaccaccuucuuaaacguugaagauauaaucuguacgacaguggcaggugaugcuuuacauuguuuuauaauauuaucccaccacccaguucuaaaauaaacuuuaacuuuuuuguuuuuuaaagccaggaaaggagauaaagaaucaaugaaaggucaacacagaacagacagaaaguaccagaugugcucucuaaauuauguucuguaagagucagcagggagaacagaaauaauuuauuucaggaauccugacguuaccaucauguacacucgguuaaaugguuuguauagcugaaaaacucagacaggucuuacaccauucuccuuuacuucuaccacuuagagaaauucaaucaaaggcugagguuaaagauaccaguucccaucaagccaguauauauauuaaaaguggcuuuucugaucacagcaauucucaggcaguuuagguguagugauaaaccuaaaaauauaaucugacaaauuuucaacuguucauucuaauguucaauacuucaguuauuauacuucauauuuucccuauaaaugucaaggaaagggaauugucuauaggauacacacauaccuauauacacauaaauguauggggggagggauggaauuuccauuaaauaaagagagaaggauaaaaggucacacaauugucacuuucuaaaaauaauuucccaggaucuauaauuucucagagcuguaguaaauuagucacuuaaacuuauuaaaaccaaaaauuuaaggaauaccucugaauauaacucagaauaauguaacaagauaaucaugagccuuuacaagauuucauguugauuaacaguaaauagcuuuuuuacugacugauuucugcuuccaaaugacaccgccuaaacaaacuuuguugccacagaagccacaaaauuguaaggcaaugaauuucugaauuggggccucaaugagaaguuugauuuuuaggaucuugaguguucugaauugugcucaacaguauuuaccacacguguugcuuguuuaugagacagagacuacaaacaucuugaaugggacuuuuauuuaaaauucuagauguuucacauuuauauuuuaaagcaaaagaucuuacauuugaucagcguggcuuuuaauuuuaguuaugauuauuuaaaaauaugcuaagauauuccugacaucucaaaagaacaaauuauuacugucugucaaugcauuuuuagaaaaacuguaucauaaaaaauguauagcuucauauaauuaaaacauucagguagugugcauugacuaaaguaauauggacuauuaaguaauucaaaauuguguuuagcggcagcagcuguuuaauuaaaagguaaaaacugcaacuaauccacuaugguugacagaaauacagccuauaucagcagucagauccccuaggauagagaauauggauaugaauucaagaagucaugagcuucauuuaaugaauauaaugaaaauaaccacaauaaaucaguacugaaacauacuuuauaucuaaaauuaucuguauguuggcccacuuuuaauuuccuuguagcuaauaauuuugcauuucgauguagcaaaaaauccuuuaacauacauauugucaaccaucaaugcacacagcuuuuaucagagggcccauagcauaagcucaacuuauaaggaggcuagaaauguucuuagaaucagaugaucccuucaaaguucuaaacuucaggguucaauauucaaaguacucacucauaauuaccuucuaucauggagaaauacaaaauggccaauaagcucauaaaguuaaucaaccuuaccaacaagugacuaacugaacauuacaauuucauuacaaaauuauuuucaccuacgauauuaggggaaaaaccuuuuuguuaauugaaaaaagaaacuagugauguugaggaugauauagucauuuguaaagauaaucaagcaauauauaugauauucccagcccuugauccagaacuuccaauucuaguggaauuacacaagugggcaaaacuuuauguacaaaaauauuuauugcagaaauguuuuuaauaucaggaaaauguuuaaaaauauaaaucaauauuggcaacugauccagaaacuaugguaagcauacagugaacaauuaucugggcauuaacaagaacuggaaaaaaacuaucuguauguacauuuuaugugacaaaaccaaaacaagccauuggacaauaaaugcagaauaaauucauuuuuauacaaugaauaauuguaaaaucaaaagauauaaaaaaaauuuucuuaaauuugccuaugcuuauguuaaaguaaacuguuuaauucccuucauaauuuucugcuuaaaaaaugcuuauuuuuauauuguuuacccuggcugugcuuuaggaaauagaucagaaguauggaaugaggcagaccaguaaagaggcauugcaguaauacaggcaaaugagguagaaauggaaauguagagaaaaacaaaauuauaaauggcaaauaaaugaauucuuuuuagaacaguuauacuaaaauaaaaagucuaccuccagcaaauauauauagagaguuaucuuugaaggaggaaaaccaaaucauuucaacaguguucuuuuauuuccaggaggggaaaaauguccuauuaaaauggcagaagagaaaaggggaaggaaggggaagggucucucuuuuacuuuacaaacuagaaacaaacaguucacagguuucuuaacauucguaucaaaugucccguggauuuuauuugcaaauuaugaggccagcaaagcagaaaaugggagucuuuaauuaggaagaacagguggcugagaggcacaaggugaguauuagccacaucucugccuggugccaaaaaacacagauccgaccugcagaacaaauuuuaagggugagagcguaacugucuccaguuggaguggagcuugaguggagcucaagcucuguauucagcuuuucugaauuauauuuacuccuauuuaaagugaaaugguuugcucuucagcuuugguuggaauuuaccaauuacaaauuauugaccuucuucauauugacauucuccacacagucuacaauccucucugcugcaguugaagcaaauucuugaccugccaaauguuccuguuucucuuacuggguuuucaaaaugauucuccuaaacagcugauuacguauuuuaaguuagaaugacaauauagggcuuauaaaaguggaacacagaggauuuucagugcauugaaacuauucuguaugauacucuaaugguagauuacaugcaaguaacuauuuguccaaacucaucgaacauacaucacuaagagugaacccuaauagaaacuauggacuuugggugucaaugaugugucagcucaucaacuguaacaaaugugacacucugauagggaauauugauaaguauauguggaaggggagggaguauucgggaugacucuguaccuucugcuaaauuuugcuauaaaccuaaaacuguucuaccaaguaaggcuauuaagaagugcucagagcuggguaugguggugugcaccuguaauccuagcuacuugggaaucugaggcaggaggaucacuugugcccugaaguuuaaggccagccugggcaaauaucacaagaccuugcaucagaaagaagaagaaagaagaaagaagauagaagacagaagaagaaagaaagaagaaggaagaagaugaugaagaugaagaugaagaugaagaagaagaagaaaagaaacuuaaaaaccacuuauacauagauacauauuuuuuaaagcuuuucugucauuaaauguuuuggguuuacaaaauuaaacauuuggcauucuugcucaaaaacagcaguaaucuuaucuuaaaguucauaauaaucauauacgcccagccucuggcucucaacuuaugagucucacauuuaggcaaauuuuuaugaauugaaccaauggcauuucauaguaacguaaguucauguccaagugccacagcuugccacuugcuugauuuuaggcaauuuucauaacaucuuaugccucaguuuccucaucucuaaaaugagagaaauucacauaucuacuucacugaguugugacaauuaaaugaaagaaugcaguuaggagcucagugaagggcuuagcacacaguaaagacuuaagaaauguuaacucuuuuuguuaugacuaacuacaacuuaauguaaaagggaacuacaaguaauuuuuuaaaucgauaagcacauggagccuucgaggagaaaacaugacaccuucaaaaaugaauaugcaagguuuggaauucguuacuucagaguagaauuuuaccagguuagaggaaugacuuauaaccauaucuaaaaauugucauucuucagugcauugcucuucaucugcauuugaagcugccucguuauaaaaaagcuguaaaacguccucaaaguaacuuuaguucuucccccuaagaguucaaaauccacucccuagguuuauucuuugguacaaaaaccuucaaaagcugauuugcugaugauaacaaauuuguuuucagaaauaauauuccugaucugaggugauaaacaauucagaacuuucauaucauuggggaauuacauuuaagagaucaacuggggaucugugaaauaagaagcauuuaccuugcuagaggaaugcuagccugcauuuaauuguauaauauuuccccuucaggguguaugagacagcguguuggaaaauggaaugauucuuggcuuuauucagaaagagaacaaaggagagaaggcagguaaaggacacagcaccauggaaaugacauuucguuuccauuugaauucuaaaguacugaacuuuuaaaaucuucauuugaagaaacucugagaaauuugucaggagggaguaagaaaaaugauauagccuaccacuuaagauagggugccaaaaaacauuaacaauuguucaaccuaaaugguuaguauucagguugaaggguggcagaauaugccaccccuacauaugccacuuuagcauaaggauuauuuugagcuaaaggcacuuaaaaaacagcaggugcuagaagggcgcugugacucaccccuuuuucuucccgaaugcagggauaaaaccccaauacagaagauguccucuuuauaccagaaggaaagucacauuuuuaucaucaaggaugaaaaggugagaccuggagaaugcugcacaaagauaccaugugaaaauaauucuuaucuuccuuuagccugccuacagaguucacuuacuuuuccacaauugcaucuuuucagucaaucgaauauaaaagcaucuagguuuugccauuucuuuaugucuucauuuccuaaugagggcuccauaaaacuucuauuaaguauauuugcaugcuuuucuucuguuaaacuguuuuacaucaguuuaauucucaggcccagccaaaaaacucuaacaaggcagggguagaauuuuugccuuccucacaagguguucguuuuucuauucuugaaacuuuccguauguuucacaauuuuuauaaacaaaaguugggggaaugaacuauuacuaaaaaaucuggaagacaaaauucuguucucauuugacacaccgaguaucuauuuacacuuuucucggaaacagcgucuucuccuccuccacaaaacccaugugcucugagggaggcugacuccaucacuugggcuauaaggauaagccacagcucuggugaggacaacuggcaaaaucccaucacccuguucauuugauuggcucaggggaugagugagagaugaaaguuggaccaauaaggaugaaggauuuuuuuuucaacaguuaucagaagagccuuuccauuuuccuacaagacaugaauggacaaauuagaaaggcccagugccaggagugacauuagaaccaugaucugagagucuccuggagacugggcacaauaucaaggaaauacagccaagacacacacacacacacacacacacacacacacgggagaagggggaaggaaaaagagggagaguguauuaaucuguucucacacugcuaauaaagacauaccuaagacugggcaauuuauaaaggaaagagauuuaguggacucacaguuccacauggcugaggaggccucacacgcaugccaggugaaucaagagcaaagucacaccuuacauggcagcaggaaggagagccuguacagagaaacuccuguuuauaaaaccaucagaucuugugagacuuauucacuaccacaagaacaguauggggaaacugcccccacgauuuaauuaucuccaccugucccugcucuugacacauggagauuauugcuauucaaggugagaucuggguagggacauaaccaaaccauaucagagaaaaacguagagagaaaaaaggggaaagagaaaaaaaagagaaggaaagguagaggaagagaggccauacaugcacuagauaaagucgcaccuacagcugagcaagauaguuuccaauuauccuagccaauaaauucuauugucugcuuaagcuagaaugggucacauuuuuaguugcuuacuagugaaauuauccuaacaugcuaacaggcaagauaaaaauagucugagcaaugacuaaaggagcacauuuuuuaccucauauacugacaauucaagagcauuauugcaucauuugcugccaaauggagaggaaaguugguuccuaaggacccccucggccagaaaaguacaaaacaucuguugaagucaugggugacuuguuagcaaaguucagcagcaguaaagcuuccuaagaaacaggucuuuucucaccagcggguauugauauaauuagggucaauuacaauuuagaauuuccagggcauggggcugaauuacaguggcauuuaagagcucugcuaaauuuucccauucaucuugaagauuucuggaggaaccuguuguaauuaaguaaucuucuucuuuucauuuuuaugacaauuuucuucuucaggcuuugcaauuacccacuacuccaaaguaccuuccuuuagaagaagaauuaaaaaaaagaccaccugauuuucaaucgacaaugagacuugguuuugcugccugcuaagugauggauugugauguguacagcaaucucuaaauaagcugcuucaacaagauuuuuuaaacucccacugcccucaccaaacacagauaaucccaaaaacucauugucugagugggugaucaaaaacgaaagaggugacauuaugauugcugggcauccuuuacccacgugguuuguaaguagcccugggagaugugcaaacaaacucuauuacuuccuuguggguuuucacauaugcuucccccauacagauuuuaugaagacauaccuuuugagcuuuaugcaaucgaggggaaagagcuuucacuggauuaagcuauuccaauugcauuuaccuugggcaacaaaguaaaccauauccauaaaaaacagccagaggcuuuuaaguauuaggucaauagcacuugaguaucauauagucccaaaagaagcuguaacagaucauguugauuuuauggaaugccuuggcucucucuggggagggaguaguacauagggagugaggaacauuaugacaccuauuacuaucaaccacuguucagugauggcuuucuaugcaagcacccaaccacccugagaaaaaaguacuaacaucuucaauugcacaaaagaagagggaaaaauaauuacaguuaguugucuggucugugaucauccagcucaagugaaaaaacuaaaauuugaaaaccucaucuuuccaauuccaaaguuuauauuuaaaaauuguacuuccaguguugaaaaguaucuuugggaauaguuaugccaguuucugacucacaauaagauacacuccaugcauguuguguguguguaucuaaaaccauccuugacccaguacaggcacuucuaguuaaucuuucaacugaucuuauccuuguccagcgugugggccacugcucaugccauuucuucuacacagcauaccuuucuuuucccucccauuuccaccuauggaaaucuugcuuguaagucaaagcccugcugugaacuaacuaugugcaagacaugacaaacacagcagucagacagauguagccucuuuguuaucuauuccauaauaacacgaggcauguaauaguguuucacaguuuaugaagaccuuccaaugcacuuccagaauggccaaaauuccagcuaacucuggaaaacgcauuccaaagagaaccaacuagaauaaauggggaaaaauuuuaugucaugaguaccgaaugugugccaaguauuuccauauaugccuaacuuaaucauuggcuguaugacaaaauaugauugcaagcauauuaauguauuaauucaaaaauauuuuugcaacagcucuguuguuaaagguucuguguuagacacuugaugcaagcaacacaaagaugaaucagacgagaggaaauaaagucuacacaaguagacaaagaaaaacagugcuuuauauuggacauuaacaaacaaaaggaaccuguaaucccagaacuuugggaaaccaaagcgggaaaauugcuugagcccaggaguuuaagaccagccugggcaacauagcgaaaccccgucucuauaaaaaaauuuuaaaaauuuaaaaaauuuaaaaaauuagcagaucauaauggcaacugccuguagucccagcuacuagaaaggcuaggugggaggaucacuugagcauaggggggucaaggcugcacugcggcaugaucaugcuacugcacucuagccugggcgacagugaaacucugccucgaaaagaaaaaaauaaauaaauagaaggaaauaaacgugugcucaaaggguauuaugguaguagacaccuuuauuccagcagcuaguacuguacaugggaaagagcaaauaaugauuauuuaauaaacagauaauaaaaaaagacugggcugggcgcgguggcucaugccuguaaucccagcacuuugggaggccgaggccgguggaucacuaggucagaagaucgagaccauccuggcuaacaaggcgaaaccccuucucaacuuaaaaaaaaauacaaaaaaaaauuagccgggcgugguggcgggugccuguaguuccagcuacucgggaggcugaggcaggagaaugccgugaacccaggaggcagagcuugcagugagccgagauagcgccacugcacuccagccugggugacagagcgagacuccaucucaaaauaaauaaaugaauaaauaauaaaaaauaaaaacaaauaauaaaauaaaaaacacuguggccucaucgaguuucuacuguaguacaccauugaaagagcacagaacacugaaguauucauugcuacuuauauuuuuaaguuuuuauuuccauucuacacuccagugagcaaaucaaaaugccuacugccaaaaaaggcucauaauuaauacauuuuuacuuacaaugaaggcuaucauuaguauaucaccaauuaaugucagaaaaggaagaucugucaugauauucugaaucgacauuguaaaaaggagaaaauauauggauggaaaguauucuggcauguuucuaguuauuaagaacaacucugcugaacagcaauuugggaugaugugaaaugaaacaaaugauaucacucauuguauucagugugaugaucaguuggcaacaauuacaaaaauguaccaguaaggauauaauaucaaaugucuauagauagucaaaauugcaaauggcauggaaaaaacauaagagaaaaccaucacaccuuucucucuguuuugcagucaaugauuuucucauuuguauucuccuauacuguagacuucccaggacagagauuaccugagguucuucucuggaucucuagacaaagcccacuguccaauacuuaauauaugacuguuaacuauggaaacaaggaaggaaggaagucacaauuucauucugaaaacuaauccaccuucuuaucagccaauauguccuccuucaaggagcagcacuggaaaaacuaaugaaauaaaacaccaggacaaaacgugguauccuucuccagaaugcacaggaaauuucugaauauuaccaagaauuaaauauauuugauuguuauauagccucaaaugggccagcacuuacuugugaguuacuaaucuaaucucaacuauuucuuuucuuuacaacauuguauuucaaaauaacucaaaccuacaauugguugcaaguuaguacgaugaauaccugcaauacccuacuucaacuguuaagguuuuaucauaucugcuuucucucuuuuacacacacagacacacauauaggcacacacucagcaauaucaucaucauuuucccaauugcuucuuagggcacaaugguuuggguauucaagaaaacaagaauaaaagucauggcauccugcagaccaaagcaagaccuaacccuugugugagguauaaucaguaucuugagugaaaucauuucccuggagugaagaguucccagugcaaugaacagugagaacuacaaccggaaaaacagguagcaaagacccuaauaacuccauauuuuaucuaauaagaaaugaagugcugaagauuugugagugggcuuguaaccaaauaaaaugauuuuucccaauauaaauuagagauacuauaucaaacgcacagcagagacaagaaggugguggcaggaaaaucaggcaaguuuaaaacaccuagaguauuagcaaaaaaauacauaauauaacuggauuuguucuauuccucuaacaaaauauaacuaaaaggguuugaaaagucaucggccaacaauauuuaauauaacauacucaaaucacauauauuucaauuaauuagguuucuacaggaguaaugugguauuuggacuuggacauuaaaucaauacuggccuuacaguuacuucccauguucuucagcccuccauuacaauccacuccccuacccaaaaaucaauaccaaagccuuauaugagacagaaaggacaguaaucuuuaaguggaaauaggaaucuaaauuacaauuguaaaugucuaaagcuuguagucuggggauuuuccuaaugggaauauuugaugugacuuuuuguuauucuuaugguugugcucauaagcacaucacaaggaugguuuaaaggcccgagcaccauaaauuagauauucuuuaagaaaucauguucuugacauauuuuuucauuaucugagaagaaugaaacagauuuuuuuuguuaauuagugcuaaggcauguauuuugcauuagcauuaaguuuaccaaaauggcuuuaaaaacuugaacagauggcagaauuauaauaacuuuuccuuaugauuuagguuaagaauaaagugucaugagaauucuccuccuaccuaacuuuucuauaaaguuaaugcauuuaauagauauggcauguuuguuuuucucacugagguguaaacaacucuaucacaccucagaugaguauaaugagaugcgggaauacauuucaauacucucuaccuaggguaaagggauuuuccaggguuuaaacaucaaaccacgcagaaacaacuccaaaccuucgacaauaacugcacaggauggcacagggguugcaaagacagaugucuuuaggggccuggcagguacugaaaacgaguaaaguagacuugcucugaggauaauagggaguagugggaacugcagccagccggacagagcaagcaccacccggggcgacaaacccaacuucucaccaacugcuuucaggaauggaaugaaggcccugaguagcuggaaucacuuauuuuccaaaagccgccccaaaucuaacuuuccuaugugaaaugucccaauaaaaauuucgguggcuaguuuauauuuuuuuaaagaaaagauaaaauaaaaagaaaugaggacuaaagaaaacagucaguggccuccaggaggaaccaugagacauuagucugcagccuuagauggauaucuauaacugguguucauggaccugggagguggagguugcagugagccgagauugugccacugcacuccagccugggcaacagagcgagacuccaucucaaaaaacaaaaacaaaaaaaaacaaacaacaaacugguguucaugguuagugcuauggcuuauuucaugcccuguccuugagggggaucucagccccuaagugaaacacuugaaauuaguaaacugggucggcuugcaagccugauuuuugaaaagguauuauggugaaaccuggaaaccugcaugaauucuaauguggcccaccuuuauaccuaugugagaugaucuugagcucuguaaccuccauugaucuuaccaguggcucagcuagcucucauuuuauuugucuucuugacucucccuuaaauuccccaucgugccuauucccaauuuaugccucuuaaaagucauuaguaacugaaaugagcaaaguuuaagaacuggugccucuuccuggccuccauaugcuuuaauuucauugcagcauuggauaucucaucuucccaugucucuuaucaucaaccucaagcuccccaaauuuccuugcucucacuaaauuuacccauuuuucucaagccuuuuaagauuucuuagaauccagaacuguaagcaauaaauauuuguuguuucuaaaucacccaggcuaagguauuuuguuauagaagcaggaacugacugaggcaaaauguuaucuugcuuaauucagaagacagacccuaugguuacgccauuuuguagaugagcuaacuaaggcuaagagaggacagguaacuugccugagguuacacaacuaggcagaagccaaauccaaauaccagucaagcacuagccaccaggcucuccuuucucaucucccacuucuaaucaauugauaacuuugguagaucccaccuugguuuaguaccuugcauccacaccucugugccaucccagcaccaucauaauucuaaucauacauuucaguaugauuggucaggugcaauagucuccuaaucuccuuaauaucucuaguuucuuucucuucaacacaaauuuccacacucuaugaucuuacuaauauucagcucccaucauguucuucagaaaaagaaaaauguguggaaccuacgcaaugucuaggucuguucagugucuucaagguauuuuacaacucuguuacauuacagguaacuaauaguaaugcaaaauauuaagacaugcaaauuauuuccuguuugauacagguuuacuuugaccuccuuccuuccugccaccuggaggaagaaaacagcuuugccuccauuuucacacacauuucaauauuccuguuuuauaaacaugccuguuguuuggauuaucuuuuaaaccaguuauaucaucugcagcuucccuugugaauuaaauaaaaucuuuaacacagguucauuucuguaucugucugagaguuaugacuuaaccuauugcugaaaauguucuucuaacauguuuagcuccuaacagauccuugcucuaaaaccuucaauggacaccaguugccaaaugaauuaaauccagaaacguuacccuggaauucaaaacuaagaguaucaucuacucugucagucauauauuacacugcuuguccauucacauccugcauggacaauaaaagaaacuccgugggugccacacauuucacucucccaguuuucuuccucugcugaugcuacucuuucacccuggauuguggcuuuucauagaguguucaacauaauagcugcuguggaugcccuaacccaugcuucucaaacauuucacaguaguaacauggcauagggauuaacauuugcuucacugaaguaggggagcaggaggaggacaaggaagguggagguaaaguagacugcuacaagcagaaauuucuuugaugucucaugcuuuagcucaaaaauauaugcagauuaaaaaggaaugagaucauguccuuugcagugacauggaugaaacuagaggucacuauccuuagcaaacuaacucaggaacagaaaacugaauaccaaauguucucaccuguaagugggagcugaauuaugagaacaaauagacacauggcgggaacaaaacaaacuaaggccugucggagggucaacggggaggagagagaauauccggaagaagagcuaauggaugcugggcuuaauaccugggugauggguugaucugugcagaaaaccaccauggcacauguuuaccuauguaacaaaccugcaauccugcacauguaacccugaacuuaaaaguuggaaauuaaauacacacacacacacacacacacacacacacacacaccucugcagauuuuguacacacuccaucauauaucagcaggggcuuuugugaaaaauaauauugccaccuccaaauauuacaauaaaauuucccuuccuggcaggugacuagucugugguguuguacaucccaugaaacacucugugacaacguucaacuuuaccugagcccugugcucccagaaaaccagaauuaagaaaucuucaauccuuucuguaagaucccaucuccaucguuccucaggauucccuuguuuagcggccucucuaaaacuccaggcccacuuccucuucuucaaaauguucuaccauaauuaaugcucucccuguagcaguauccuaaauaaaaucaccuccuuaacuguccagugcauuauaucuuugacauauggcaucccuucuuugaaaaguccaugauuuuagauggugcuuccuaagauuauuacuuuaaaauauuaaauugugauaguaguauaggggaaaaauauauuuuccucacucaccacuaaguucauggcugaggcaccuauaacaaaagguagaucaacaaggaaaaagcauauaaaucuauugaaugaauuuuacgugacaugggagccuucauaggaaaaugaaacccucaaaauagggaagccugugucuuuuucuauguugguuugauggaaaaguggauaguaaugaaaaaguauuauuggaugaaaaaauaugaucuaaugguaauaagcugggagggacuuuggaaggccuguuugcuaaaucuucuuugugucccuguaucuucagagauaaggauguucccuuucuccagaucuguggaggguaccucuugaaugagggucuuaugagaaggggaaggggaaggggaagguaaaagagaucuuccugcuucugcuauguucucaaauaucaagaugccauauuuugaagucauguguccugaacccuauucaguuaaaaaaaaaaaaaagaccuaccuugaugugguuccgaaagauuuuuuucaccuguccccauuuaaaaugacuaccaaaguuauagccgucaaaacuacauaggaaucucugcagcaggccaggaauugcugagguagagaaauagaagaagugggcagagaccuuuccuaucacccuuaaaauaucugaaaacuaaaacuacuggaaauagacacuaguuuucauucaaucuuucuuucaacaaauguugcucagacauagcagaugagcggcuggguacuggcuauacaaucuguucaggggaaagcuauggaaucuugauuaaaacuuugaaauccaaaccacagauaagaugaaaaggaagaagaugaguaguggguguggagagaccuucaaagccggaaggcuacaaaacaucaaaacauucugaggacaggaugggaagaccuuaaguuauggcaacugcaaauaauaauggcuuacauuuguuuuaagggaguaucuuaaaauauucaggaacuaagcuuaguaauuuacauucaucaccuugcuaaauccuuagaguaacuccaggagcuaaguacuauuauuauccccacuuaacauaaaaagcaacacagccucagagagguuaauuaacuugcccagggacuugcagacaguaaguagcuaggcugcccaacucaaaaucauguuucaauaaugcaccccaagugcuguuaccauggguuuucuagaaaggguauccaauauaaauuggaauccagagugagguggagaaagaguaaagagugggucagauuuccuaugccaacucagggagugugaacuucacccuggcaaugggaugacaaggaaauaauucaagggagggaaagcaagaggcugggaccuagcaauggauaccccuguaccacugggccccuuccagagcaugaaaaugaaugagaauaggguagaauacaaccacaggcucaagugucucaauaaccacaaggucagaaaggauuugcuuuaaggcaauauuuaaacgccagugaacacucaggucugaauucugugcaucuaaccacuacaaguuagaagagaaaaaaauauuaguguucuuaaggaagaucuagcaaaaccauccuuccaguucuaagggccguagaggguguaggagguugguucacacuucaggguguaccaauuaaguaugaugacugcagcaaaauagugaguaacacagcuagauauuuaaaagccucaguuacuggauuccugccacugcaggaaacuucugucuugacuaaauuuaaaaaaaaaaaaaagaaaaaaauagugucaggagaaacaaaguguaaaauacagaacuuauuuuucuuccugccagguguaagcguuaaaacuuggcguauucacuauuguuuagaaguuugaaaacuuuuaacaaaacaauagaacacagaagugaaaaagugauuguuggggcuuuagacuuaacacaaagcuuuugcaaauaaaugccucuauaaccuuaaugaauucuaauaaaauauauuaugcuauuuuuuucuuguaucugucagagguguuugaaccagagcaacucuaucuugaauagcggcuggguaaaauaaggcugagaccuacugggcuguauuuccaggagguuaggcauucuaagucacagacgagauaggagguugacacaaggugcaaaucaccugauaaaacaagaugcagaugcguaaagaagcuggccaaaacccaucgaaaccaagauggugauaaaagugaccucugguuguccucaaugcucauuauaugauaauuacaaugcaucagugugcuaaaacacacucccaccagcgccaugacaguuuacaaaugccauggcaaagucuggaaguuacacuauauggucuaaaaagaggaggaacccaacccucagcuccgggaauugccaaccccauucccgggaaagucaugaauaauccaccccuuguucagcaucuaaucaagaaauaauuauaaguauuuucaguugagcagcccaaacugcuuuccaaauaaacuugcuuucacuuuacuuuuuggaauacaaaaguauuuuggaauaaaaaaaguacuuaucccuuuacuuuccuaauaaaguugauuucacuuuacucuuuggacucacucugaauucuuccuugcaugagguccaagaacccuuucuuaggcucuggauugguacccuucccaguaacauauccacgacaggugagaaaagaaaaacaaaagacauauauaucauauuacauccuaccuaagaugguaccaaucgcaaggaacguauuaauuucagagacggugaguauuagaaucaucaaaauacacuauaauuaucacauucaugaguccuguugauacauuuauuuuacugucuaaaauucaggaguuuaugguaagggagucuauuuguaagagacccuguugauuuucacaagucaagaaacaauaaacuucaagacauacuaaaaagaaaccagccugaugucagauccucuucaacauagaaacuauccucauaguaaauuaaauugaggaaauauuuaauggauaagcuugacuuuguaaacgugccuuccugaccaauagguacguuacugaugacguucaggacaccccacuuuggcacuggaggaaacagcagaagcaagaaggucucuuggaccuucuuccugcccuucuccucugaagcagacuauacaguaauucucugaccucugcaguacaucauuaagacucccauuucagagguucucucacuguaccuggagaaaaggaacaucucugucucucugaagacaaagggacacagaagaaucugaacaaacaggccuucccaagucagcccaguuuauuaccauuagaccauaaccuuuuauccuccuauaauauuucuccccuaccaucuacuuuaucaaacugaacauuaaaacauguacauuucccuaugucuuugggucuucauuuuggaaugauccugugucacauaaaacuuauguuaaauaaaguuguauguuuuucuccgguuaaucugucuuuugucauagugucucagucaugagucuagugacagaugaaaaaucuuuuguccccuacagcaucuaugaagauccaaagaaugucaaaguauaauuuuuaaaaaguuacaaacauugcuuuuagauaaauauaaagcaaacauaucaaaaugaauuucuuaaugagggaaccaguagcaugguguauucauacaaaaagaauuaaagaaucuaaguacaaauaggcccugacaaugucaaacuuuaccugagcccugugcuugcagaaaagugaugguuaacaaccaccccuacaaaccuuuugaaaauuaaaggcaaaacauccccacccuuuuugguucugggaaauggcugcugaagagaacuacccuuccccaaaugacuuagauaugacuauucuuacucuaucauaauuuucacaaaaugugcagaccaccccuuuuguuuaccuguaacaaggccagaaagagacccaacccuuuuuaccucuagccaauuucccacucuguggcucaggauugauuagcuaagauuagaacucuuuuuaccccuaaaacugcuagacgcugaaauaaacauuuccuguucagcuaacugacugaaauucccugacggcaaaacaaucccagcugugaaucucuuaccuaaagaguuaaccaaauaaacucuuuaugugguuagguacuuuauaugacuuaguacauauaaaguacaaagaaaaaaagauaaaaaaaaaagacuuggauuugaagaacaaagaacuuuaguucuuugaaaggcacaguuuaggaaauaaaaagccaagucacagacuagaagaacauauuuuuaaugcaaauacuuaauaaacgacuuauaucuagaauaaaaaauaacuaauaucucaguaagauagucaacccaauuaaaaaugagcaaaguacccaaaaugacaucguacaaaagaaaacauaauuacaggaaaaaaaugcuuaucauuagucauuagggaaaugcaaauuaaaacccaaaugagauacugcuacacagcuaaauagaauggcugaaauaaaaagacugacaauaucaaguguugacaaggauuggcagcaauuaagaacuuccaaauguugaugguagagugaaaacugauauaaccauuuuagaauaccacuggcaauuccuuguaaauuugacuuuaaauauagcaugugacucaguaauuccacuuguagguaugcauccaagaaaaaugcaaacauauucuccaauagacucaucuaugaaaaauuauagcuuucuucauaauagccauaaaguagacacaaccuaaauguccacuaucagaugacuuaacaaacuguaguauaaucaugcaacaauacuacucagcaaugaaaaggaaugaacuguugacacaugcaguaacaagaaggagaaaaggccccaggaacaaaaagauacaugcuacaugauuccauuuauacaaaauacuuaaaaagccaaaccuaaucuauagcaucacaaagcagaucaguggaugccugaggccaggggugguagagaggagguggaaugcaaaacuguggaagaaacuuauugauuugaugacaguauucuacaguaauccacaguguauguaaauuuuauguguguugcuguauauaaaugauaucaaaaaauuaaaacuaaagaaauaaagucuuuagcuuaaaugcaucuuucaacaaguucuucauuugcaaucuagcuuaucacauuagaauaauuggcagucuccuaggaaacuggucuggagaaagugaguguuuuuuuuuuuaaaugaaaagauuuuagauuuacguugagaauuuuaccaaucaucuuaaauauuuuuccuuugaaucuauuugaucuguucaaauuaaacuuguuauguccugaggugguuagcuaaggguaccaucaacaaaguauguggcaucagcuuccagugaauuccccaaagugggggagaaaaauauuagagauggauccaaagagaaagccuuucaccaaaaucuccauucagccuugcuuuucaucacuuaaauccuagaagaaaauguucucugaggaccacucuguauguaggaguagccugaugagcaaacauaauacuucucaaguauagacaugauaaagcagcaaagucaaaaccauggacagauucaagucauaaaaggauuuugaauacauuuagccaugcacucacugauaaagccuuccuaccaauaguucagcucauauuacauauaacaaggaccaguagcuagaaaagcuaaagcuuaaaaagaaaaaauuaucacaguggaaaauuaucauuagaaauacucaacuuaagaaaagacuugaaaaccucuucuguacacacagcacuuuaucacuauaaguuacugguucuauuaucuuauuuaauccuaauaacacuaacaauaauacauuaagagaguuaauagagaguuaauauaaaagcacaauagagcaaacacugcauauagagcauuuagaaguccuucgaaagccucugcuaggaauggcuucaaaacccagggaguugaauguggacucuccuuuucuccuuucuuuuauuucagugguucuugaauguucaaguacauaucaauauaucaaaaccauguacucauuaaugagccacuuaaggaaggaauuuuuaaggcaauugugaugaaaugcgacuuucaccucacuguuucucaaucuuuuuuucaucaucaucccugcaaggagcguuuucuaauugccccccugaaauuuuaauaccacagauuuucuuuauauccuuauacguauugucucuaugucugcgcuuuacacauaaaaagaaugacuuuuuauugcucccaagaauuaauuuucaccggcuugggggugauaucacucccacugagaaugcacgaccuaaccuggaccucuagcuuaauaugaaccucuccuguuuaucuucaauggcuccuuucaaugaaaagucuacaucccagagccuucuugguugaagcauaucuauuaaaguuuguuuucuuuauaccaaguuuuucccaacauuucugcugaaguacacaaugauaguggagaaggaacauacaugcugaaaaugaaaaacauauauagacauauuuagcaagcaggaaauguauuugagcucugauaucuuaaaacauuaagcaaacagagaaagaguagucuuuuuaagagaugguccuuggacaaguggauaucuacacacaaaagaguggaaggcuccuacuucauagaauauauaaaaauuaacucgaaauagaucaaagaccuaagaguuuaaaguauaaaacuuagaagaaaacauacauguaaaccuucaugaguacggauuacacaggggucucuuagcuaugucagcaaaagcacaagcaacgacagccacaacaaagaaaaaauauauauaaauuagacuucaucaaaauguaaaaguuuguauuuugaaggacaucauuaauaaagugagaagacaaucaaagaggaaugggagaaaauauaugcaaaucacauaucugagaagggacuuguaucuagaauauauaaagaacuuuuucaacucaauaauaaauagaugauucaaauuuuuuaaauggguaaagguuuuaaauagacauuucuccaaacaagauacucagauggccaauacgcaaaugaaaagauacucagcauuaaaagccaucagagaaauggugaucuaaacaccaugagucaccauuuggcacccacaaggucaccuauaacuaaaaaaaaauuaauaaugauggggaaaaaucagaacccuuacaucuugcaggugaucauguaaaaugaugcaucuaauuuauuauauacauaaagauaguauauauaaagguauauauauuacccagcaauuccacuccuaguuauacacccaagagaaaugaaaacauauguucacacaaaaguucuauaugaauguuuauaacagcaucauccauaaaagccuaaaaguggaaacaccccaaauuuccauugauggaugaaaagauaaauaaugugguacacgcauacaauggaauauuauuagcaauaaaaaaauaaaguacugagacacauuacagcaugaugaaccaugaaaacauuauucuagcugaaagaagccagucacaaaagaccacaacugugugauuucauuuauaggaaauguccagaacaggccaagauauaaaaacauaaaauggaaucauaaugcccagggccgcggagggggcuucaugagaaacagaaaugacugcuaaugcaucugggguuucuuuugguggugaugaaaauggucuaaaaaugacuauggugauaguugcacaauucugauaauguuccgaaaaccacagaauauacacuuuaaaugggugaaugguaugcuacauauauuauaucucucuaaagauguuugagcaggggaagggaaaggauuaaggaggaguuagauccucagaucccaucucccacuccugauagccaggagauugcgacacccccucauccuggccagugacuuaagcuuuguuccuguagagaguaaaauagagggucucugacauagaguaccccagcaaaaugagagagcagggcugcaggagagaugucucuaggaagaugaaagugccagaauaccagaagugcaugaacaucuugagaagguauuuagacaaccagugaagacuuugggggcuaagacagugauaaguauuuacaaaaccaagcaaauuaaaaaacaagaaaauuauuacauccagagaaaucaaaagucaggcaggauagaaagugugaugguaguuuacuccacacuucagcuuuagaugacauuucaauacuguacuaauaugaauauuaauuucaucaaauuugcaguaaaauuacauugagauaagggacagaagaagagcgugugcaauagaagugaagggaagacuagugauauuaguuauguucucugcuuccauagugcaaaaucaauagaaagagcuugaaauguaaaaaauaaaaaaguauacauauuacuuagagauacagagauaaauacuaaaauaaucaguuuaaaagaaaugagggagaggaaggagggacaauguagggguuuugaauuauuuuuuaguaacaagccuuauagggcuacaugaggucacauauacacacacacacaauaaaugggaaaugcuugcaaauugcauaauguaaugaaaauuuucaaauacuuuauaaaaauaccauggaaaaauuaugcuauuauaagaaauguuaugugaauuguguucucaauaauaugauuuuugucauaauacaaaaauauuuuaaauuacucaguagguaaaguauuuaacuuuguucucaaauaagcaaaauuccucaaaagaugcagcauguuuauccuaggucuccacgggccucugaacacaauagcaauuaccacuauaaaaucccagucugagauuuugugcuuaacauaugaccguucuuccacacuuagcauuuucuacuguauacaucauuaauucguuuaguaaauauuuaagcauuuacuaaugaucaauucaaguaaaauaaaaauaucugaucuaggacugauccuaacaaauuaguuuucuggaauuauauuuuuucuagauugcugaucaccacguacaugaauacaaaacuauuuauugaagaugugugauauucagccuaaaucuuguaaaacuuggacuugauagucuaagaagcuauuaugugcacacauauuugaaggacauuuuuaaaagugcuaaacuauaaauauucugauucacugcucucuuacaugcacuaaaaaugacuucgugcaaucacuaaccaggagguagguuuuguaucuuacugaaaaugucacuuaauaaauaaccuucaaauuuaaaugcaaacuguggauaucauucauagaaccucaaacuugcccuugaagucuaaaugggcaaacaagguaacuacaaaaagcuuuucaggcguuaacacccuacugcuucaacuccuugaaaagcagucugaacuuuugaguuuuuagcauaauauucuuaugcugaauaaucucuaucuccuauagcauuuaggcugaggacguuaaguaugauguacuguugggauaauuugcaauuuucacuucucauucucagauuagauuacuaacaguguuggaggaaaucacuuuacugcauaguucauucauagcaguucauuugucuauucaaaaccugaugucuuguuuauggcuguauauccuaauguguugcauuaagguguuaacagaacuaguugcaacccuaaaauuggacuaggcaacaugacuugggacuggcacagucagagaccaggaagcuggacauuuauugaguaagaagaaagggaaauuuugagacagagaauuugcaauuauguauuauuuacauuaugugaaguugacuuuuucauuagccaguauacauccuugauugugacugcuauauauaguuuacuuuuauauccuccauaguaucuguguucacaguagguguagguguggucgacagaauccuggccaccuauagauguccauguccuaauacucagaaccucugaauaugcuuacaugggaaaggggcauuaagguugcagaugaugaagguugcuaaucugcuggccuuaaggcagggagaugauccuggauuaucuaggugggcccaacauaaucacaaggguccuuaaaagauggaagagacaggcugaagagaaggucacagugaugaaaagugagaagucaaccugcccuuucuggcuuuaaagauagaggaaggggccaugagaagcuggaaaagucaaagaaacagguucucuacuagagcuuccagaggaaacacagcccugcugacaucuugauuuuagcccagugagagccauuuaagacuucuggccuccagaguuguuaaaugauuuuauuuuuguuguuuuauguuacuaaguuuucaguaaucuguuauggaagccaucaaaaacuaguaaaugauuaauuuaaaacuuucaaaguaaaaaauaagaacuaagaagaacaccuaaaggaauaaguaugagccaucaagauauuuucaguuuucuacgucuuuaaccuuauugggaaccuuugguugauguaguuaaucacuggaguuuuccuguccauucauuugaaaucuagaauuucuuuccauuugaaauaguuuucuuuuacugaccagaagcuaaacuguccuggaucaccugcuggcuguucuuuugagaaaucuugguauuuuccagugaguuaugacugcacuaugggauacuacuuccugagaacacaaaaguugcuuuagcuuaucgcuuuaggcagauauuuuugccucaguuaucuuuuagcuguguaugacuuaaacacaaaaauuuuaaaaaugugggagugcaaagaaauaucuuuugagguaggcagucuuuuaucuauuucuccauucaaccagcauuugcuaagcauuuaaaauauccuagcauugagccaggcauugaguaugugaagacugaacaacacagggucauuuucuucaagaagcucacagucuagugaagcagauagaaauguuggaacaaauaagaguuuaagaaaggaaucuguaaguguuacaggaacuuugagggagaaaugucuaacuucauuuuaaaaaacugccauuucgguucauaaaaaauggggaguuacaccccuaugggugaacauuugcugaccuuguaauuaguuauaaacucauggguugguuagaagauucuuuuaaguaucuauucaggcccauagcuuucucugaaaaugaccaggccucauacgacgccagaacuaacaugaccaaggggguguaucugacucuacacugggccagccaaucagauucucaguccagagaauuuggaauuagaauucaugggaugagguuguaucuguugugacagcgaagucaggugacagagacucaguggucuaagagaccaggccacgcaggcgcauggagccccagcacagaaggcagcaaacagagaaaaagaaggccaaagcacagacuccgaccacaacugcaguucuugcuugccucccccagugaggcuuuguugcccucucucuuuccugcugcagugagagacacauuuguguccuucacauacaaucccuauuuugguuaaaguuacuuugaguuucuauuacuugcacagugacaugguucuaccuuuuuaaaacagauuccacauuuucaccaguccauuugccucaauaaccuuaccugcaauaugggaagaggaaagcaguuuccuuucagggaaaaggcaguagaacucauaaaagauguucaaguauaaaagcacuuggacuauaaauuaucauacacaugcagaagauugaaaucuguaacugguuaugaaauauuguucacaaaugaccccuauuaaaagccaaauggaaggauuuuccagcaaaaaugagguaggaaaaaagcucaaauaaaaaugggccaagauucuaggcagagcucuaauauucaguuucagagauuaguucggcuuuggccauuuccaagugugaaagagggauggggcgaagaagguaauggcaaaaagagaaagaaucuacaaagaaccauggggaggaacaccggcaaggauuuuauccuuccagagaaagccauaucugcuguuaaaacacagugcacagcagacugacaaugaucuucuugcaauaggucauagaaagggcauuaaaagacaacuuucaaaggucucaaacuagauaaaccgaaaucaguaauagaggacuuaugcuggaccuauaggagauuuucuuccaggugacuauuaccagaggaaucuacauaacaguggacugcugcuauuugggggcuaacuucugcugcccaccuuugaagucacuaauagcuuguuagcacagaagccacgcuccguggcucacaccuauaaucccagaacuuugggaaacaaaggugggcagaucucuugagcucaggaguucaagaccagccuggucaacauggugaaacccugucucuccaaaaaaaacuacaaaaauuagccaggcaugguggcucacaucuacacucccagcuacucaggaggcugaggcaggugaaucgcuugaacccaggaggcagagguugcagugagcugagaucccgccacugcacuccagccuggggaaagggagugaaaccuggucuccaaaaaauaauaaaauaaaauaaacgcccauuagcauagacaaagagaaagacaagaaaguaaaaccuuagcuuauguuauucccuauuagcaucucugauaauggauuuguucauuaacaaguuaggaacuaauugaacuggagauucaaaauaaucuaaaaauuucaguucuugauguuaguacugcugucucuaugcacuaucaagugcacggaaaguauagaggucaauguauggcacaucugcuuuccauuaccaugaaauucacuucaacacaucacugucauaaaaaaguccuauacuaagcauucuguuguugguauugauccuucccuuccauguuaugaagauaguuauucauuuuugcagacucaacauggcauaaugccuggcacagagcuaauacucaacaucugugaauguauaaaagagcagauaguagaggcuccaugcacuucugaauugcugaccauaauuguuaacauuuucugaaaacuuaccaaacuccagguguaguaccaagugcuuuauguacauuguuucauuaaacccucacaacaacccaaugaggaaacugaggcacagagaccuguccaagaucauagacuacuaacuggaggaagugagaugcagacagaggcagccugguuccagagcucaagcucuacaccacgcugcaguacugccucccguauucuaguccucucaugaaggcuugcugauggucuagcacauccuucaugcucugcgggacacaaaaccagacacaauuuuaaccuugcucuuuggaguuaagagugagaguuaagugguauuuauacaauuaacuccaauaugaagcagaauuuaacaaguaugucuagaaaugaggcugaagguacagaagacaggaacacaacucuuagcuaggaugggagagaaauggaagguugcauagaccagggacacauaggcugggccuuaaauuauauagaagaucugcaaaggcagagauagagaccagauuauagucagcaaaaucaucacaugucagaaaagucagugugugucuggggcuaucuggggcacaggguaucuucaggaagcaguaaugaugaauccuuuaaugauacucuaccaauucccccggugugaaaacauaucaaaucuugagguacagaaagggggacaaaccgaggacucccaaaacuaaucaaagaauacuccuugaaguucugaacauuaaugaggaugaggaccucacugaauggccacuucuguacaaacugaguuugaagucacagaaauguuagaacuguaauccuaaaacucaguuaagagggaagugcaucuacaaaucaagacagaccuccagcugaaaaugccucaacagacacuugcauaggccuuccuuccaccuuuccgugugcaaacggauacugugauuuugagaaugaaacaugauagcuccugcauccacuacuaacaaaagcaagugacuggcaaugaggguaaaucaggccucccuugaguugguccuugaaggugcuaucaaauuaacguaugucuaacaauucugucuccauucaaaucaauucgccuagguagcuaaccugcucacuguuucucuaacaagguaaacaauggauuaguaaaaacuacacauaucagaccugguuucuuacaacauuaggcucaaaaugcaagauuuacauaaagagaacaucuauggugagaaauaauuugcuuagacaggaaauuuuaucacugccauucaguuaguuggaaaaugaagauuuagagauuuggggaauucucuaauguucuacauaagcauaggguaaaauaaaaacuucguauuucuuugaauuaauauccaauucucuucuagaggaaauuuuauugaauuggaaguguaauucuucuguuuaaaagaaagccucagccaggcaugguggcucacaccuguaaucccagcacuuugggaggccgaggcggguggaucacaaggucaggaguucaagaccagccuggccaacauagugaaauccugucucuacuaaaaauacaaaaaaaauuagccaggggugguggcgggugccuguccucccagcuacucaggaggcugagggggagaauugcuugaacuugggaggcagaggcugcagugagcugagaucacaccacugcauuccagccagagcaacagugcaagacuccgucgucucaaaaaaaagaaaaaagccucauuauuuuuuauaaugaucaugcugaucauacugcuauucuagucacugucaauaaacaaaaugacaauaaauaaccauuacaaggcagcaauuaacaugaugguaccuccuaacuucuaagcuuguuucuuuaacgugaaaacacuauuucuauuggcaaguauguagaugagagcugagucuuccugaaggacagauugaaagaguuuucacaaauauuuaaaaucacagaaaaaguaauguucugaaacauuuacagaaauuaauaaaaguaucucaucuuuguguagauuaaauauuaaaaugcacuuauauaacuuuuauuaaaauaauuaauauuuaacgaagacaauugaaagaacacaacuaugacaaauuacauuuuggcaguaaugauaagccuuugaguucuaguucuuucuccuuagggauguuacauaucuguuuucucuacuuaaaucacucugccucauuaucaucucugccuucuacucucaguucagcuugaaaguucaucuuauacaggguuacacgauuuuauaauaucagauaacucucuuucacaccacuuaccagagcucuaauacuaacuuaugugucucauucuugguugaacauuucucuaccucacuagauuauaaacuccuugagggcaggcacugguuccacucucuuccacuaaauccccaacuccaaaacccuaacaccuuaacaccuaauauauauaucaccauuuacauaucagucacucaauaaauauuugaagaacgaaaugacaaaauacccuuuaccugaaugcuuaccuaaaaauguaucuuauauauggaaugaaugauccacacuuacuacauggauguauaaacucaaacauuauacuuuucuuugcacauuugagaauaugugucauaagcuauguuuacaaugauauggaaacaaaaacuugucuauaacaaaaacaugcccauagcaauaacagcaacaacaagaagugguuccaaauucaaggugguagcacagcuuuuuucaaaaauuugagaaaaaacaaaucuauuaaaacagaagauauagucucuuggacuccacuaaaaugagucuguucaggucuacuacaaaacacaucuuuaagagagauucauggccuuaguagccagacaguagguauggcccagaccuucccagcacagccuauguauugaagacuuuagugaaaacacucaugucagcaaauuuagcauggauaauugcaauaggaaguucuauaacuuugcuuuagggaaaaaaauucuauuuuaauuuucauucccaaacagaauuauguuagaauaacaaaauaaacuuccccacauuuaucuguuuuuuaaaaaugauagucucaaggaagagaaacuuucuuuucauucauuuaauaaagauuuuugcauuuuauuuaaagacuccuuauggcuauauuuuaaggauucaaguucauuuauuugugauaacuagaaaaauuuuuugucccuuugugaaaauuuuggaacuaggcauauuuucauuacuguuuucauuauuacugacaacuuggcucccugcucugggaaauauuucuggaagaaaagaaaaaaaaaaaaaaacuaugaaucaacuaacuuacuuagcaaggucaucagcuuacucaccagggcuuauuucaagacccucucugugccacaaacacaagacuacuuugucuaaacucuuguccaauuccaaucauuucucugacuugcaguaccugccuuaaaguaaugcagaacaagcccagaacuccauaaaugugcucuccuaauuuauccauuuugagcaacuaaucagauucucucaaucuuguauauucuuuuccuauagaucuaaaaucauagcuuugcuugaucaacagguuuuuccgguagucuuguggaaacuugacaguaggcauucaucuuauauccacuacacagaaaccugaguucacagauguugucuuagucaaugccauacacacacacacacacacaccugugaccagcacagugguuggcacauaauaugugaucaauaaaugcauacuuaggaaagaagauuuuguucuauaguauuacagagggucaaaguucuuauaaaggagagucaguuacuaaaacuaaacugauauucuaucuucucauguggucuuucggcaucaguccuauccuacacaauaaugccuugcaaucuguaguugugaaauuagacuucuuuuuaugugugcacaaauuaagccaguuucuacaaauuaaagaacauccagcaauuauugcucuccuucaagcugaccaauaggauaaguuuaagcaguaguuuugagaauuuguuuuugcaauuuuuuuuuuuuuugagauggagucucgcucagucgcccaggcuggagugcaguggcaugaucucggcucacugcaagcucugccuccuggguucacgccauucuccugccucagccuccugaguagccgggacuauagauacccgccaccaggcuggcuaauuuuuuguguauuuaguagagaccggguuucacuguguuagccaggauggccucgaucuccugaccucgugauccgccugccucggccaccuaaaguacugggauuacaggcaugagccacugcacccggccuguuuuuguaauuucuuauacuacaauguuuccuucuggagacagaggaaguccagcagaugaagucuaaaauacucugcuuauuuugugaaaagaccaggcauucacacaagcguuuuucucaaagcugagaaaaaggaggcugaaggugcaaaagauaucagaguacucauucagaacccaagagucuauaaaauauaaaccuggugagagaacuggccucagccaauggagaugccucaauaguguuugugucacgagcgaacaaggugaaucauaaaaauauuuuuuaaacuucuguuucaaaggugcaaaaggcauauauauuagucucuuugcauuacucuaaaggaauaccugagacuggguaauuuuuaaagaaaagagguuuauuuggcuauggaucuguaggcuguauaggaagcauaacacuagcaucuguuuggccucuggugagggccuuggggagcuuacaaucauggcagaaaacaaaggcgagccagcaugucacagggcaagagagggagaaagagagagaguagaggaagucccagccucuuuuaaacagccagaucucaugugaacucacagacugagaacaaacucacucauuacugcaaggaugacaccaagccauucaugaggaauccacccucaugucccaaacaccucccaccaggccacucaaccaacaauggggauuacauuucaacaugagauuuggagcggacaagcauccaaaguauauaaguacagcagcuagaacuuucaguuacuuaaaaaaaaucuugcugacaucuuaauuaccugcugaaguccugguggucagcaagaaagcagugaaaacauuuaaaauuucaauuuucauauuaaugguccuaauuucuggaucugguuuucucuuuuaaccauuugcauaaaaauguuuugugagggacauauaaagaaguuggaagcugcagauauaggcguuaaaaaggaauuauuuagcagacagugaggguauggaguccuccguaagguuuuccuuugaaugaaaagcagccgccaaaucauuuucuuuucuaacaaagagcagccuguaaaaucaagcugcagacccagacaagcaagcuggaagcuugcaauggaugaaugccagcaguugugccaauaagaaaaagcuaccugguacuaagcaugcucaaaauggcagcuccaucuucccuuuucuuugccagccacauguagaguaacgagcaggcaacauggcgccagcugggagaagucgccauuugcuuaagaucaggguagggcauccagcuuccucgcauguuauguaaacaucacaccucguccaaccaaucuuugggcccuauguaaaucagacaccgccuccucaagccugccuauaaacuccaaugcacucugccacaggcuggaagucucauucaggcacccuuuucucucucaagagagaaagcuguucuccuuucucuuucuuuugccuauuaauccucagcucccaaacucacuccuugugugugugugucccuguccuuaauuuucccggcaugagaugacaaaucucggauauuaucccagccaaugacacugcuucacugcaauuugcaacaagaaaaauauuuacgacaaggaaaaaagaugaaccaacuggaaauuaaugacuuuuuuagauucagcagagaacugagguccaaagcaaacuaguauccccaaauuuggagaaacauguaaacacaaagaaucauaagaucagauuaccuaaagcaaaaacagaaggaccuaggaacugauacgaacacguguaugauaauuuugacaaauugcuggaggcucagugcagacuagcuugagaguuaaaaacucuugcagccuagucuuaggggagacuauacuuuucugaguuuuauguccaagaacccuaucauguucucauggggaagucuggagaaaaaucucagggaagagaaaaaguaaccauuuuggaaguuucccagauuguucucuguaagaaagacacguccuuucagggaagcuauuuuaccagaguucuaucugacuugggagaagggcaauuaguccccuccagacucuuuuagccuuccugucuaaugucaggggacgaaaaaagggcucagaacauuucagaagaucgcagccuagaaacucaggcucacuaagaaaacugagauguaaucauaauauacaacaauuauccuuccugagaccucaucaccacgugaagaggucuuuggugauuacaacugagaggugaaacacacagacucuauugaauaaggagcucuuaggaaagcccaaagacaacagggaagacaaaaaauacgagcacacagaagcaucuggaacuuaaagcuacagcaagcauuaaacacaguccagcucuaagcuagauuaacauaaaaccucauaacaaaaaaaaaaauucuuaguucccaucacucgagguauuauuuccagcuuucaacaacaaaaauaaggcaugcaaaaagaaauuucuuaaagauaaacuuuaaacuauuuuaaacuaaauaaaaaugaaaauagagcuuagcaaaauuuguggaaugcaaggaaaacaaugcuuugcaggaaauuuaaagaacugaacacauauaucaaaaaagaagaaagaucuaaaaucaauaaucuaaacuucuguuagaaacccacagaaagaaaaacaauuuaaaccuaaagcaaucagaagaaaaacagaauagaaauuagagcagaaaucaauuacauugaaaauaggaaaucaaucagagaaaaauuaacaaaaccaaaagcuaauuauuuucaaaagaucaauaaaauugcuaaaccucuagucaggcuaaccaggaaaaaaagagcaacaauacagauuacuaacauuagaaaugaaagaggggucaucacuacugaucucacggauauuaaaaagaugauaaagaaauaugaugaacaacucugugaucucaaauuugauaacuuagauaaacagaggcaauuccuuaaaagaaacaaacuaccaaaacucacaaaaagagaaauagauaaucugaauaggucuauucagguuauaucuauaucuguaucuuuuuaaaacauugaaucaauaauuaacuuucuaaaaauaaauaauaaauuggguccagacaauuuaacugaugaauucuaucaaauauuuaagcacaaaaugauagcaauucucuacaaccuucuuuagauagguaaagcagagggaacacuuccuaagucauuauguuauaccagcauuacucuauagcaaaaucagaauacacgugcaaaccccauuaaaagaaagaaaaacuagaaauuaauaucgcucgugaacaugauauaaaaagcgucaacaaaaucuuagcaaaucaaaucuaauaauguauaaaaguuauuauauacuacaacuaggauuuauuucagguacacagcugguggaacguucaaaaacucaacaaacauuccuagcacuuugggaggccgagacgggcagaucaggaggucaggagaucaagaccauccugacuaacacagugaaaccccgucucuacuaaaaauacaaaaaaauuagccagguaugguggcaggcacuucuagucucagcuacuugggaggcugaggcaggagaauggcgugaaccugggaggcggagcuugcagugagcggagaucgugccaccgcacuccagcgugggugacagaacgagacucugucucaaaaaaaaaaaaaaaaacaauagaagaaaaccaaacaacaaaaaaaacucaacaaacguaacuuagcguaucaacuggccagagaagaaaaaucauauaauagcaacagauacagaaaagcacugacaaaaucccacacucauuuaugaguagaaacucucagcaaacuaggaauagaugaaacuucgucaacucgauaccaaaaaaucuacaaaaaaaccuacagcuaacaugacaucauacucaauggagagaaacuggaugcuuuaagaucaguguaguauaguaggcugacuaaugaucucccaaagauaucaggucuuaacuuuuaaaacaugaaaauguuaccuucuuugaaagaaaggacuuuguagcuguaacuaaauuaagaauuuuaaggugagaagauuacccuaaguuaucugagugggccuuaaugcuaucaaucauaaauauccuuauaagguagaggcaaaggugaaauaacacagacucaucaagaagccagugugaccaggaacacagagaucacugucacacccacacccacaacccaaagaauauauggagcuaccagaagcugucaaggaauggauuucccuccacagcuucugugggaguacggcccugcugacaccuagauuuuagacuucuggcuuucagaacugucagggaagaaauuucuauuguuugaagcuaccagucuguaauaauuugauauagcaagcuacugagaacaaggcaagauuuuccccuguuaauacuccuauucaacagcauaauggaagaccuagguaaaaguaagacaagaaaaggaaagaauauuaagaaaaagauauaacgauugggaagaagaaaauaaaacuguuuuugcucucaugauauggcugacuauguagaaaaauccuaaaaaauugacaaaacauucucuagaacaaauaagcaacugcagcaauguuucaggauaaaauuuuucuuuuauccugaaaaaaacaggauaaaauauuucuuuccaauaugccagaaaauaacaaauggaaauugaaauuagaagcacaauaucacuuauauuagcguaaaaaauaaaacacauagauguaaaaaucuaacaauauauguacaggaucuguaaggaaauauaaaaaauucugaugaaagaaauaaaaucuaaauaaacgaauagauauucuguguucauggauaggaagacuugauacuguuaucgguucuucccaacuugauuauacauucaacgcaguuucagucaaaaucccagaaaguuauucugugaauaucaaaaagcugauuguaaaguucauagagaagggcucaagauccagaauagccaauaaaauauugaagaacaaaguugaaggagugauacuacucaacuuuaagacuugcuacaaagcuacagcgaucaagacagcaugguacuggugacagaauagguaagugaaucaaaagaacagaagaggaaauccagaaauagaccaauacaaacauaaacaacuugcccuggacagaggagcaaaggcaauucaauagacaacaaauagugcuagaauaacuggacauccauaugccaaaaaaaaaaaaaggggggaucuacacacagaccuuacaccuuuuacaaaaauaaacucaaaacgcaucacagaacuaaauguaaaaugaaaaaugcaaaauguaaauccucugaaagauaacacagggaaaaauacuagauuugaguuuggcaauuuguuuauagauauaacaacaaaaaauuaucuacaaaaaaaauuuuaaauugaauuguauuaaaauuuaaaacuuuugcucuacaaaaaauacuguuaagagaaugaaaggacaaggcacagaaugguagaaaauauuaacaucauaugucauuaggggauuacaaauuaaaacaaugacauaccaguauauaccuauuaggauagcuaaauccauaagacugauaauaccaaauauuggcaagaaaguggagugaugggaacguucaugcauuguugguggaaauaaugguaaaaugguauagccacuuuggacuacaguuuuacaguuucuuauaaaucuaaacauaguuucaccacagaaugcaguaaccaaguuccuaagcauuuacucaacugaguugaaaacuaauguucacacaaaagucugcuuagggaagcuuauagaaacuuuauucauaauaaucugucuuucacaacacgagaauguauaaacaaacuguggcaaauccauacgacagaauacuagucuacaauuuuuucuuuaaaagaacucuuaugccauaaaaagguguggaggcaccuuacagacauacugccauaugacauuauggaaaagggaaaacuauagaggcaauaaagggauuacuaguuaccagggauccaauauaguuucuuagggcaauguagacuauucuauacgaaacuguaaugguggauacacgacaauaugcaucuguaaaacuccauagaaccacagaaggccaagagugaacuuuaaaguaaaguaugaacuucaguuaauauaaaugugucaauauugguucauuaacuucaguaauaaaugugccacacuaaugcaagguauuaauaguaggagacacuuggugguggggcggggaugggggaauaguggcgacacggaaggaaaauguuaugguaagucucucaacuaucugcacaauuuuucugaaaaucuaaagcuguucuaaaaaauaaaguauuuuaauuuuauuuuaaaaaguacaucuuagaaaacauaccuaggaugaucucuaggcucuggauccagaaaccccuauuucaaacaaguaggaagauucuuauggcugcuaagauaucagcaguccaugguuucaggaauacagagccccaaggugaauacaacaaccagacugaaauaagugcaguuccaagaauggagcuuaaacuggaaagacuagagagcagcuggcuagcuguuuagagguaacagauggcagaacccucaggaucaagucauccugaaugaagaaagaccuuuggagagugcacacuugaguaaauagcggccucuguucauguucuccaguaacaaagaaauaaacuaauuagauggcauucauaagcaagcuaaaauuccuuucacuggaaaucuggaaagaacugauuuaggagagcgaaaaacagggauauauacacacacacacauacacacacacauacauguuuguaguaucaggaaaugcucaacuuugcucccucaagucauccaguuccaauguuuuauauaugcuauuauaugugacaaaaucauauaauauauauuaauacauaucauuaaaaauauguaacuguuaauguagcauagguauauauuuuucacauaccauaacauuuauccuucuaaaauauguaauucaaugcuuuucaguauauucagaaaaacauguauccaucaccauuaucuaauuccaggacccaauuuuguuuuuaacacaucucaaauguagauuacaaaaaaagaauugauccacuagggauacggucuguaagaagcagccuagauuuuuuaaaaauguuuuucuucuacucuacauguaaauaagucugcauccugucaguauuuaagguuuucuuucuuucuaacaaucauguaaggcugguauuuuuuaaaguuuccacucagaagacugucuuccugaccuguaaagaaauuaaguguaaaaauguaugcaauuggacuaaauaaugaaaaagagguugagaagagugcaccgaaagagguaaaaaaaggagacuaugggccaaagguauacaauagggaaaauaaaagaaguuucuagggcacugcagaaagacaauguauucuagugauuaccuuuauuagacucuauuggaucaggagccaguucauuaaacauuaauggcaggggaaugccauccauauauuauaaauagccauuaaguugagauagacagcucugcccagggucaguaugaauuaauaaaaaaaacugaagcuggcauuucagaaucauaaaaagauagguuuaguagaaaauauucaauaagaaggaagaagaacaguauauauuacacuauuugucugaagagcaaacugaaaaugagaacaaacuuaacauaaaccuaaaaagacccuucaugaaugaaacacuuauuucucgaaaauggaugucacuuacauuuaagaaucguaacaguacaaugugugacauuggcaaaugguaaauguaaagacaaaugagguguagacguucagcuagaaauuagacaaaaugugaaugcaaacaaaauauccucacugaacacaguuccaaacauaguauguggcagcaggagaacugaaguuauuaacagauaaggucuaauuuccaauuuaucuauugaguuaauccugaaaccuaucccacuugccuguauuuacaagguaggucaucuuaguuuuaccaugaguuuucacuauuuuaagagagaaaucauguuaugaaacaugguacugauaagauacuuacauaaagagcuacacuuuuuuaauuuauuuuucucacuuucuuugcuaauuuacacccauuguuucugaguaaucugaagaaugagacauucccauuuuuuuauguaucauaauguuucuaagauaacgcauggacuuuuuaaagaauuucaugguagcaaauauuaugacucaaagucaauaugacccugguuaacaaaaaugaucaaaaacuaggaaauaaagcuaacaguagugguagcaaugguguauguggcgugucuguucaauacuguacuagaauuuuguuccccaagcccacucaaggauuauuuaauucucuaaaagaacauaucuguguuuggcuuugcuauauacauuuugauuauuguaccaccacugucaaguuauagguuaacuuguaguuuuugucuaguacgaaagaaccacugaaguuuaugguuuaauuguccugugggauacuaaucagucuuguauaaaaccuaguaauuuuauucaaauauucucccucuccaacuccuuuuuaacaaaaugucuagaaguacccagguccucaaaaugccccuggauugcacugguuucuucauuaaagacauauuaaauguugguauauauuuauucuguauuuuuauuauagucauauuaacccuuagaaaguaguauuuuucacuccaccaagcaccuguguaagauuuuuuaaaaaaauaaacauuugccaauguuuugagaggugaauuaacucaaguaaggcauaaccaguaaugccaaaaauagguuuaugccccaugaauuaucucuccaguggucugccagccacccauaaaaguacauuuuuaaguuauacuauagaaugagugagauaaauaaaaugaauaaugaacggcagacuuaaaaauuaugacauuuucuuaaucuucauaaagccugugauggauuuuucacuugucuacuuggcuaaggugaacuacagucccuccccacuuguucaaacacagaucuagaugcugcuguaaagagauuuuucaggcauaauuacagucccuaaucaguugaguuuaauuuuaggaaaucaucuugggugggccuaacuuaaccaguuugaacacuuuaaaagaagacugagaaagucuuguacuugguguuggcugccagcugagaucuuggcugagacugucagcuagaacucuauuuuuuaaauuuuauuguuuaaauugacacacagucgauguacauaguuuugagguacaugugauaauguaauacauucauauuacuuagcauugggauauccaucaccuuaaauauuugucuuuucuuuaugcuagauacauuucaauuauuuucuuccaucaacuagaacucuuauaacucacggcuagccacuccacgugauuuggcuucucucacagcauggcuguuggauuccaaagaaaagcaucccaggagaggguaaguggguguagagggggaggaagcagggguggggagcacacaccaacaugcaugaggugaaugcuauucacuccaccugcacugagugcauccuacucuauucucuauccuaguuucaacagaaggaagagaaaacagacuccaccuccugauaguguaugacaagaaucuggaacaccacaaugaacuagaaaugcagguguggccacuuuuggaaaauguaauuaugccacaacaaucuuugacuauuuuucuauuguaucauuuucauaaugguuuuuagaaacuuggaauaaauuagagucauuagcccuauguacauaauaugaguugcaaauauuuuucccucaaacaaauguauuuuuguuauucuuacguaucuuuuaucucagaauucuaagucccuuggaaguaugcaaauuuuauugaagggaauugaauuuuuaaaagaagcacuuguagaggacauuuucaauauuagugcuaucaguuaaguaauuuacaguaacucuuaugguacccaaucuuucucucacagugauauuuacaaguuuaaacauuuuuuaucucaaacagaguggccucugaauuuuccuccuaacaaggagcuuaaucuacuauagcaaccauaaugaaaauguuauuuaaaaaucagacaagagcaacagggaaagucgguguuugcuauuuaaauuguuuuuguaucaaugggcuuagaacacuguggagcuauaucauuuuauucaguuuucuuucauuuuaaugucacugaaaggucaagcaauaauccagagaucaauuuaccaucccaugcacauugcuucccuccaauuugggaauauaaauucaaauguaagauggucuucacccaagcucuucccugcaaaaaaaaguuaaggccucagauauuuuuauaucuacagagcagagaaggcuuuacuucaaauaaaugcuguugcaauuagccugaugacccuucuuuugccuuuuaauauuuugauauuagcagguucuacuuuuccuccugaugccgaaaaaaccaugucauguuaacaaauuccuuaaauguugaacucagucagaucaucuauaaaaugcaacaauaucaucucccuaccuaucuguuaaguuuauuaugaagacaaaguaaaauuuccauuuuuuuuucagacagagucuugcucugucacccaggcuggagugcaguggcaagaucuugccucacugcagccucugccucccagguucaagcaauucuccugccucagccuccccaguagcugggauuacaggugugcgccaccacacccggcuaauuuuuguauuuuuaguagagacgggcuuucaccauguuagccaggcuggucucaaacuccuggccucaggugaccugcuggccucagccucccaaagugcugggauuacaggcaugagccaccacacccagccaaaauuucugucuacuucugacauuagacugcugagaguacuacauauaugacaguuuauuaguauugcuuuuaauacuuagaacacuguuugagacacauauuaagugcuuaauaaauuuuaccugguguuuuugugauaugcuuuauuuuauuuaagaauuuaaggggaucaaguguggaaagagaagaccuaccaucucaucaucaaguauuaugugcauauagcaugagaggaagagagaagaaaaauggggagacaaagaaggaaaaggaaaagaaaggauucaggguucucugauuaucucugugcagguaagcugagggaaacugcacacacuucaucagcaccaguggguucccauccagccucuuucauuuacuacugauaugaccuugggaaagauacauaaccccucuguaucaguuaucuauugcuacuugacaaauuaaccccuaaaauucagggcuucaaaccaccauaaauauuuaguaucuuauacagguucugcaggucaugaaguuugaagcugauuagcugagugguucugacucaaggucucugggaaacuggagucacaacacccaccagguugggaauaaucugcagacuuggcugaagcugaagcauccaccucagguucacuuacaaggcuggaaguuggcgcuggcuguuggaaagaaacuuuauuccuugcuagaggaagcucuccauaaagcuguuuaaguguucucacaaaauggugacuagcuuuucccaaaaugaguaagauuuuaugaccuagacucugaagacgcacacuguugcuuucacuguauucuacuggucaaagagauaacauaauacaaggugggaggagaugucacuaggaggagaauuuuaaaagguaaggaucacuggaagccaccuggaaggcuggcuaccgugcccucaaagucucugauccagcaucuauaaaaugagaauaauaaugacuucuaccucacaauguugguggaaagauuaaaugacaccauguauucaaagugacugugguccagcacuugcuccacgaauugcaaaccuccuuaaucauucuguuuucuagguucuggcacaguguguguguguguguguguguguguguguguguguguggaggggggugugggugugugcacgcacacaugccuggguccauuuggccaccugaugaagucuguguacaacuuccaaaaaucauacuuuuaaaaaaaaguacauaggauuaugagaauacagauuauacuagaacauagccaugaaaauauuuuaaaauauauguaauacacuaauauuuguuucuuuauuaagacauuauacaaugaaacccaauggaagcuuuaacaacuauaucuucaaaggaaugauaagcacaaauguuuugggauacauauaauaacugaaauaugauuagacaguaucugugauuucuauuggugagaaagucacaaguacugccaaugccaccguggucuuuugccuauauucacacuugaaagaaaggcuaaaaucuacucagagguuaguguaagugaagauaucauuuuuuuaauccaaguuuaaaguuuucauaaacacucuccacaaacccaaugggguucaccggacccuggacuaaacuuaauuuacuuuaaaagaaagaggaggaaagaagaauaagaagaccauucuaguauuuaauauucucuacaaauaauuuucuuccuauuaaauuuccuacuguacacaggaacaucuguucuccaugguucucucauuucaaaaugaucacucauuucauuggacauauaccuacauaauacuuucauuuaaacauauuuuaaugaaucuuuagaccuagauaaauggauuuacagaagugcuacauuaaaaggccauuuuaaguuugggaucgaaaggaccuuuaauuuauagcuccagaaaauauccauuccauggcucaaagauccuuguggauuauaaaagaggaaacgacuaacagaaaaggaauuauucaccacauuauuaaacaugacaaaaagcuucugaauuggagcuuaaaacgggcuauuuaagauuccagcaaucccuaggacuuuggcaacaaaaauguucaaaagccuuuuauaguugcugucagauuucuguaaagcauuugagauuccugugaacuuauuuauauaacaagcuaaaaccugaagcugacuugaaagucuuucuauucuaauuauguagaaauggaaaugccuagaaaugauguuccguguucucccaagaauauccucuugaaauggugguuucagaaccggguauuuagaagaaggaaugagaguguagcugcuaugguuuauuacacggaaccauucagcagauauacaaacuauaguuuagcaaaguggcuucaaagaacugccauuuaguuauucucucugcagcagcacauucuaaaugacuguucauauuguucccuccuggcccacuacagugguuuauuucugaagcucuauaguucauguguaaucauguagcaaaguaauucacgauauaaugacccaccaggaucucagcugauugugguucuuaucacaauacuguuucugaugcuaugcguggcuuuccaaagccaacuuuuuaaccucuuaugcuucagcauuccaauuugacaccaggccccucuguguuccgagaagucagcacauacccuaagcuagaaaugcuaggagauauuccaacagaaaaaauaagauggguuuugggaaagaguacugugcuugacagcuucuaaaauggcuccuaauaagcccaccaccuccugcuauucacacccuuauguaaucuucucucacuuugaaugugggcuggaccuaguuauuuccuuuuaacaaauagaaaugugauuuguuuauaaaugacugugacuucauccuuuucacccuuucucugcccucuuccugcuugaugagacaaggcaagcugaccuauggagagccucauguggcagagaacugagaccaacagucaacaacccuagaagaacugaguccugccaacaaccgugugagugaaucuggaaguggaaugucucuaauccugacaauaagauauugacaccaacagcagagauguuaaaacauguagggucucagaccuuaucaaggaaaggucuagaaaaggaauaugaaaccauuuuuuucuaguuccaaagccugugcuucauucacugcauuacacugugucuccaaaugaguccuguuccaaauacugaauuggguuuugccuguuuggaaguuggaacucauuucccuagagauaaaauggcauaacugaaauuaacagagaucugacacaauagcagagaggggaagacagaggacuuggggugggagggcucacaaagguggcugugccaagaacuccugagucuuagcagucugauccaggcagcucaugggggcuggaggagugaaguccaaaggcuggacugagaaaaucacuuccugauuugaguuagcuuuuacuugauacuaggaucuuuguggauuaauuaauuaaaaaucuccagaugagacuaaagcggccucauugucugggaugauaaucagguucauugucucacagcugaggaaaucaaggcugcagacacacaaggagugagguuaaauggggaaguuuaauaggccaaagaaagagaauagcucucugcuggggagagggguucuggaaaaauggguugccgguccacagggaaauacaggggguuuuauagauaccuggugaggaggcagagucugauuuacauagggugaaagacuaguuggaccaggugugccauuuguauagggcaugaaaaaccgguuaggacuagguuugccauuugcauaggaugcaaauuucuggucgccuccacccuaaucuuuuauuaugcugucacguccucuaucugagcugugccauguugcccguuucuuuacuguacauaugguaacaacaaaaaaagggaagauggagccuccaugucggacaugccugggccccagguagcccuuuucuguuagcacagcugccagcauuccccugugcaagcuuccagcuugcuuauuuauguuuucagcucgauuuuucaggcugcucuuugguaggaaaaaaauaauuucuugggaugcuuuucauuagaaagaaaauucugcugagaacucuuuuacccuuacuaucugcuuaaauaauuucuuuccacuuccugugucaaaauuauccauauuuagagugagccuuaaauccaaugacugguaucuuuaugagagaaaggacugggagauuugggcacagugacccagaggaaaagaucacauggaaagagaggaaagauuggagccagagugccacagccuaggaauaucaggagccacuagaagcucgaagaggcaaggaaguaugcuccccugaagacuucccauggagucuggcccuguccauaucuugauuucagauuuuuggccuccagaacugugagaugauagauuccggugauuuuuaagccaccaaguuugugauaauuuggcacagcagcccuuagaaaugacuaccaacaccagugauacuaauauucaacuagacgugagagccaccacuugaagcuguggcgccaaccuugccaggugaacuguuauugagcucaagguagggcccagguggaaaucacuagcaaugagaacaccagcugcaauaaucaccagaaaaccaccuucaucuucaaaacaaaauauuaaaaacccacuguguuaaaaagucuuuuuuuaagcaaggcuguugugagacgcuucgaaauaguugaauauaaaccaagaccuauauuauacuguagucggauaucaucucaggauuagcauacugugagcaaauccucaacacguugggaguuccccuuccccuuccagauaaaaguugaaaagccugagaaaaucagggguguccuccuaacuuggauguuagcugccguccauuucucuugagguuuuccuuucuuucuuuaacuuuuacaaccaaauauuuauaguuaguccugcucuaagaaagccuuagaagccaggauaagagcauauaauacucagaacaaaacugugugaaacagccauauuauucuaucugugacuugauaauuagauguaacuaaauugccggccaagauaucccauacccaagcaauuauagacaccaacuaacgaagacaggaaaucaaagaaugaaagcugaaugccaucaguggacauaucagaaaacaucaagaaaagcuuucuaugaagaaaaaaagugugcaacucuuuuaaagaaagccuagucauaaaaugaaauugaaauguguauuuuuuuguuuuauuggcuuuauuucaaauggcuauuauuaaaucccugauagucaauuaaaaaacauucaccaaacuagaaaucugcugaaguauacauguauaagcaugccuaaauauauuacaaacuauugaauugaaacauuaaaacauucuccauagcaacacuaaaucaaacugauauuucauuuugguuccccugaugccaauacauauaguacauuaaacccacagcuuucagagcauaaaaaugucuuugaaaacauacguaaucuagagaugauguucaaauauaguauaauauacaccuugguuuauaguuauuauuucuuucccaagauuacauuucuaugagaaagaagaggagccuaaauaugauauagggucauuaauuuuaaugaugaaaacagaaauuuugacuuugccaguucugaccauuggggaaucugugcccauaguaauagauuacucaugucuuacuugcacuuuucccaaaaaucucaagucaaagaccacagaauuuauacgcuagaaaauauaagaaaaaagggcacagaagcuaaacaagaaaagaagaggaaaaauauuccaguuauggcuucaaagucacuaauuuccauggaaggagauuaagcguauacuuuaucgaccuucucugccagcaaacaacguuuuauucaugucacuuaauggggaaggaggucagguacagaucugaaggucaccuaacuauaugcuuucuuccacaguauuauagggcauagggaaagagccuaaaauaugccugcugguuggaauugaaaaugaaacggucccuuguuuaaugccauaaaaaguauccugagaaaguguagcucuuaggcuuuuccucuccgaggauuuagggaaaaucaacagugcccacuggacaaaaccacuuuagauaaagaggaauggcaaauuuaagggcucacaaaauguacuuaaaaguuuagaaauugggcuuucaaauuauaccagucaaguuuuacaugaauuaaguccuauuuugagcuaggaugcaucauuaugggagguaaaccaaaaucuuaaaaaauauauuaguuuagaaugagaacugugccucaggaggugccauggaauucacuaggagguaaaccuacugcaaauuacauuuuaaaaagcaaucucagcaauauauucuucucuaaaaccacaaauucauuuugaaucaauauuuguuaugaguccuuuucaacauuuuuccaggagcaacacagcacugugucuucaggggucgaagagggaaucuacaggacuuaaaaaagcauagggagugaauauggggucauagcuucugucauuguugaaaagagaugccaguaaguucuaugcauuaaaacagaccacgcaaagcacaucugauggaauaagauaaauaacauaacagauucacucuugcauguccaagcguacuucugagauggugaaaugcauuugaugcacugaaacaugaaaccaucaaaaucuacagcuggaagggaccucagagaugaaucauuugaaagcccuccagaggaacccagguuccaggaaauaugaagaacgugaccaaggucacaaguuagcuggcagcagaacuugcaccagaauacugaucuaauuuuauuauauacacuuuuaguuucuaaacaccaagaggcaugaauuuacaaacaaugaguacagccacaugcugugccuaaaauaacaauuacaaaaguaaaccuacagccucaguuaaauuacuuaccuguguuuuucccccaccauacagaacauuaccauucgcacaaaggucccucauguugccccuuucuggccacauuaauuugcucccgcccucacuccucuaaccauccuuaaucacugccaaccacucaucuguucuccauuucuauacuuuugucauuuuaaggauguuauauaaauggaaucauacaacauauaaccuuuugaaauuggcuuuuuacgcucagugaaguucucuggagauuaagcuguauguaucaauaguucaucugaaugcagaauagccuccgugguauggauguaccacaguucauuuaacuauucaccugcagaaggacaucuggauugcuucuaguuuuuggccauuaugaauaaagcugcuaggaacauuuguguaacgguuuuuguguggauccaaguuuuuguguuucuuggauaaaugaccaugaucacaaaugcuggguugucucaguccgcuugugucgcuauaaaggaauacaugaguagccaggucaguggcacaggccuguagucccagcuacucagaaggcugaggugaaaagaucuguugagcccaggaguuugaggcuacagugggcuaugauuacaccugugaauagccacugcacuccacccugggcaacacagaaaaagaaaucucuuaaaaaauagauauaaaggaagaccugaaacuggguaacuuacaaagaaaaaagguuuauuuggcucacgguucugcaggguuuacaagcagcaugaugcuaacaucugcuucugaugagaaccucaggaagcucccacucauagcugaaggagaaggggagccagcauguagagaucacauacauggcgagacaggaagcaagagagaggguaaaggugccagguaguuuuugagcaaccagcucucagggaaaugcuccaggaacuaagagugagaaguugcucauugcuacccggacagcacuaagccauucaugagggaucugccaccaugacccaaacaccucccauuaggccccaucucuaacaguggggaucaaauuuugacgugaggauuggaggcuauucaaacuguaguagguuguaaggcaguuauauguuuaguuuuuaagaaacuacuaaacugucuaucaagcgugacuguaucauuuuacauucuuaccagcaaagaugcaaaagcaguuuaauagagaaaggauagcuuuuccaacaaauggugcuaacgcagcugggcauacauaggaaggagggugauaugguuuggcuguguccccacccaaaucucaucuugaauuguagcucccaugauucccacguguugugggagggaccaggugggagauaauuaaaucacggggguaguuucccucauacuguucuugugauagugaagaagucucacaagaucugaugguuuuauaaggaguuuccccuuucgcuuggcucauucuuucucaccuccuuucauguaagaugugccuuucaccuucugccaugauuguguggccuccccagccacguggaacugugaguccauuaaaccucuuuuucuuuauaaauuaccaaucuucgguauguucuuaucagcagugugaaauggacuaauauagaggggaaggggggaaggaggaggggaaagaagaggaggaacagggaagcaagaagaacuuucacauaaaccucacaacuugaauaaaaaucaacacgaaaggaaucauuuuccccgcaucuucaccagcauuuaguguugucaccacuugucacucucauagaugugcagcgauaucucaacgugguuuuauuuagcauuuuccuuagaguuaaugauguagaacaucuuuuuguguguuuaucaguuaaauggcuguccaugucuuuugcccauuuuccaaaugguuugucuuuuuuguuguuguugaguuuugcgaguucauuauaaauguuagauaauagcccuguuuuggauaugugguuuucaaauauuuacucccagucugcagcuugucuuuuuagccucuuagcagagucuuucagagagaaauuuuuuaaauuuugaaguuaaacuaaucaauuuuuccuuuuauggcucaugcauuugaugccaaguccaagaacccuuugccuagacauagaucccaaugacuuuuuccucugcuaguuucuaaaaguuuuauuuucuaaaaguguuacauuaauguucaugagacauuuugaaugaauuuugugcaaggugugagguauagguuaauuuuuuuuccuaacuguacaauuuguugaaaagucuauucuuucucuaacugaauugcuuuuuuauuuuugcaaaaaaaaaaaaaaaaagaccagugggcauauuuguguaggucuguuucuggguucucuauucuguugcauuuaucuaugugucuauacuucugucaaugacacauggucauauaaauauuacaaguauguaagucuugaaacuggaugauagacuaauuccuaccaccuuauucuuuuucaaaucuguuuuagcuauucuaguuccugugccuuuacauaugaauuucaggauaaucuugucuauaucuacuaaaaauuguugcugauauuuucauaagaauuauauuaaaacucuguaucaacuugggagaacugacauauuuacuaugaugaaucuucuaaccugugagaauaugucucuccauuuauugagaucaucuuugcuuucucucaucagcauucuguaguuuucaccauacaaauucuauacauuuuuugauagauuuucauguauuuauuuuuguguguguguaaaaggugcuguauuuuuuauuugguaucuaucuguugauugcuaauauaaauaaacauaguugguuucuauaugcuggucuaauauccuggggccuuucugaacucaucuauuauuucuaggauuuuuuaaaaagauuccuuagacuuuucuagguaugacuuacaaggaagucaccugcaaaaaaaaggcuaguuuuacugcuuccuuucuaaucuguaugucuuuuauuuccuuuccuuggcucacugugcuggcaagaucaauaaugaaaguauuaaaaguaucagaacuugcguagggggcauaaaauacuaaaguguuuuccuacucucacacacuacucaacacuucucacaccagauucuccaacagacgcuaacuggguauccuagaauucaauucaguucacacauuaucuacccagagauauugucagauccaacagguuagggguucagucccacaagacagcucccacuuuggaugucaguuguguaccccaggcugugaagugugguucugacuggccagcuauaaaucaggauuccuacaaccuccucuucauguucaagaaauuugguagaguggcucacaggacucagggaaaugcuuuacuuaugcagauauacaaccagauggaagagauggagaggacaagguaugugggaaggaguguagaccuucccucucugggaaggugcccucucuacgagcaccacccuccaggcaucaucacacguucuguaagcuggaaggucuccaaauccuguccuuuucagguguuuaugaagcuucauuucuuaugcaugauugauuacagcauuggcuacugaugaucauccagaccuucagacccucuccccucccuagagucaggagauaaggcucaaaguucugaugcuuauaccacauaguugguucuccuagcaaccaguccccauucugaggcuaucuaggggccccagccaccaguuaucauauuagcauuaaaaaacacucuuaucuccagagauuucacaaguuuuaggaauugugcacccggaaccaggggcagaggccaaauauguuuauuauaucaaaauaucacaaaaguauucgaucuuccaacacuguguugaauaguagcggugagagucaccaucuuugacuuuuucccaaccguaaagaaaagcauucagucuuucaauguuaaguauguuacuuuuuugcagauauucuuuaucaauuugaaaacauucucuuccuuuuauaguguucuguuuuuaucacaaagugguauuaaauuucaccacaugcuuuuucugugggaauugauaugaucaugucauuuuucuuucuuagccugcuaauguguaugaaauuagauaauuuaaacuuaaaauaagucaacuuaaagcuguuagagcuuuaaaucauucugaaccuugagagguggcucugcagccugagucaaguggcaugcagcugcaacuucuggcuuuuuucuuguaaauaauuaagaagaccaagcagugccagggacaggacccccucagaucauuacccuuucucacagaguaauaaaguaaucuuccuuugaauguagcaauccauaaccaaucaaauuacuguggcaugugcacuggucuugcauggaaaauguuguaauccugcuggaacuucucugucccugccuauguaaaugaaaccucaacagcaccaaauugggcugcugauccauuuguguagagucagccgugacgauccucaagcucugcacuaggauaaacuccacauuuaaucguauucuuugaaccucauuauuuacgguugacaugcgguagauuccauugcugauuuucaaauaaacccuacuugaucaugauguauacuucucuuuauacauugcugaauucaauuugcuaacauuuuguuaagaaauuuugacaucucugucuaugaaggauguuggucugcaggguuuuuccuacuauuuucauuuggggcaauacaacuucaaaaauuaaaaaauaaaugaauauucuuccuucaucugagagugucuugauuucccuuucauauuugaaagacauuuucacuagacauagaauucuaaguugacaguuauuuucuuucaguauggaaaaaauaugaugccacuuuugccugccugggaaacauuggcuuuauuacuacugggcaggggagaaaguccuaauugucuauaaugccucuucugguaucaccccugaguggaggaaaagguacuucucuacuguugguagaggugaaaauccaggcuccccauguggacucguuaccacccacuggauaugagaauucuggcucucuacuuggcuuucuguaauaccaaccugacaaggaggcuggaguggcucauuacaucccagugacgauaguaguuuuggcucccacuuggccuuugcuguuggagguaggaguagguaggccacacguuuuucaauguguguaugugugguguuuagcuggaguaguacagauauuaucuaaaaauuuucucuauauugcuagacugccccuuucccaguccuucaccuacagugagcaggcuuucgcuguaaccuuuccuuuugucugugcccucugucagcuaaggguuacuagcuucuuuaguuccagggcugggauagcuaaggcaaaaacaacgucuagggaauucacuaccauauuguuucuugugucuccaggucucuagcugaucugacuucucuccaccucucagaauauuuuuaguuuugucuuauauacaauauucaggauuuuuuacuuguccuaaaugagaggaagaggaaaaaguacaccuuuuuccuagaagugaaaguccccuuguuuuacuuuuucaaaaaaacuaaaaucuuucucuugacuguuaucacaacagauccuaucaaagaagagaaauuaagaccaaaaaaaguguaacugagggauaguaagagaauauucacagcuuuacuugagaagaaaaaaggaaggguuacaaaguggggaggauuagagucaaaagacucaaguucuaauggaaagauggucagcuacuagccuugcaucucuaaauaucacuuaaauauucaggcagccccauauuuuguuuuguuuuguuuuuuccuguaagauggggaugauaucaccgaggugcccuuccacaguuguggucguauaagaugagauaggaaaugggauggugcuuugucaauuuucagucaagauauaaauaaagggcauguuauugcacuccgaugauaaacucccugccuacuucccacuugcuccaacaaaacccaguuguuuccaguuuguccuguguuucagcauugauccagcaacuauugauccaugugcacaaacuagaaauaugggaggcauuuuggauaccucugacucccccuauuccccaccagucaaaauaagaauaucacaguccugauguucuccuuccagauagcucucagauccaucugcuucacuccaucagcccuagauccagcccccauucucuuuuaccuguacuguaauagucaucucccaaguuucccugcuuccaaacucaucucuaaaaagcagcuagaucaucuuucaagcacccaaagcaucucucccgaguccauucuagauucccccggaucccuagaguucccauuugggcuucccguuucucaggagacuuaucuguucauuuauuuaaaaaacugaaacgguuuucucuuauuuauccuaaaauaaaauuuugaccugaaaguaugauuuuaaaacacuuuaauaccuuuauagucaacaaguaaauaauauuucauaauaggaaaauaauuaugugacaugucauauuggcauugcuucauaaggucaagggaaaagcuggacauauaaacuagagauaguguguuucaccauagccuuauguacguauuacuaaagaaugaaaacaucagccauaacuugcaaaucugcauuaugacucaugaaacaaguacacuguaucucgccaagcuauaauuacugacuaaaccuaaacuucuuuaucacaaacucauucagccucaugugcucaacccauacacauaaacucuguucuagaaacugccuaguugaucaauucugacccagaucuacuaggaccauuucauggcuaguucuagcucccaaaaccuucuccuacccuucuccaguuccuuuugacauaccccccaguuucccugguguugguucaccuuugcaacagcaagcucauaacaugacuuagaaucuaaaaauuguucugauacucuuuaacggguuuuagcaaaauaagugauuaggauaaacauugaaaauuuuacaccuaauuuuaacaguuacuaauauuacuucuaguuagaggagaaggacuacagaguagggagcaggguguagaagcacagauuacucuuauuuuucuguaaggacugaaguucaaacaauaaaaaugcacucauacauuuccucagaaauuuuaaaaacacacauuaaaugcuaaauauacauccugucaauuaaaaacuguaagaguaaccuuauaaaaggaaaaaaaaguuugcucucgggagaugauuaaauacccauauugacuaaauauauuuaaagugguuaugauucaaugucagacuaauauuuuugccucuacuuuaauugcuuuuuaaaaagaaguaucaggagguuccaauuagaaauuuaacugaaggccacuuugaaucaauaugcugugggaauuaaaugaugcuguuuuuauguuuuccuuuuugaagauauuggucauucuuuuuuuaaauuuuuaucucuaagaguucaaggaaagcuugguuuuuauugguaaggcaagaaaugcagcuucugacuaaauguuuauaucuucagugugggaugcccuucucccuuucucuccuccuggcauauuuaaucaacagaauauucacagaucuuuuaccuccuacaacaggccuacuccaacccugcauaauuucuccuaucuuagggccucugacauuuaucccgaaaaagacaacuaaauacuugauucuauguuuuaccauauuucuuuucuuccuccacaucucacuuuuuauuuuuagaaaaugccucuaaugcaauuuagugaucaucacagugccuaggacauugcuuggaacuaaauaacuauuuaaaagaaaaaacaaauaugguugauuaguauaagcaacuacuuugcagaacuuugaaaugugacuucccauuucaaagguugucuuucguauuccccagucuuccaacaaucauauuucacugacgucuaacacauauaccugauuugagaauauucugaggcugagcuccuuuaucaaaguuaauugguagaaagugucacucaccagaaaauuccaucuaauugaaaacuggacugaaauggcuaggcucaaaugggggcugaucuaaauuucucaucaagcaucacuuuaagguaucuuagacaagacugccuugagcuguaaaaagcuuugaugccaucagccuuacaccaggaucaaaaucaauuuucaacuuuuauugaaagcuuuguuaauaaguuucuccccuguucgucacaguuaugaaaaaccuuuaauauuuuuguugcaugggaauaaagcuaggaaggauguaaauuucagacaaauuggagguacauuuuaaaaauauugucaucgagacugacaacugccaaaccuggaaaccacuuucucccacaucaaacacacccugaaguaauggugaauucaaauugauaugcaagccugugacagaggcuaucagaagaaacuauuucuuuucaccucuaaaauacaauucacuaagcaugacauccaaauuccuauugucauaggcauuuucacugguuuagaagaagacugcaggacggcuaauguguuuucguucucagauaaggcuaauggguuucagcucucuugccaguuugauugccaaaugcugccugugacacaguaaagaauuuugaaguugcucauggacuuuguggaggagaguaacacagucuaucagcaacauuuaccaguauggcaaagcagcauucacuaaugaaucugagcccucucccguugcuggacccauggaagaccauuuccagagccuucagugcagcuggacagggccacaugaccaguucugucccacaggcugugaucaguguugaugugugccgcuucacagcccauaugugauuuucuaugcuucucaucccugaagccuugagauaaaggugccauaagacagcaguagacaaucgugcugagccaccccuuggaggugagcuguccuggagcaucaccuagaaccuccgcaggcuuugcaaggaugagaaauacucccaguugguuaagccacugugauuuucauauuguuuguuauugcauuauaacccaacccacucugacuucuacacacagcucucagaugagggacuggagacaggagugcccagcacuuagaggauuacagauuaauaguaaggaacacugguuccucuuacauuuaagacacccacaacaucaugaugcauuucccuccaaugagaugggaauucuuguacccuugcacagcuugcuuucauuuugaugacuacuaauugugaccugcaccuuggcucuugcuugucuccuuuauuccuucucuccuucuuuacguagacacacagauguucuagagcaugccugauauaucacacuaauacauuuauuaaguaucccuuugaaaagcaaaaugaaacauuacaauuucuguggcucuuuuaaaugccugugaacacacuagcacauuacauuuuuaaguauuucagucaaggggucacuuggguuagccuacauuuuggcaaguaaaucaacaauugcugccaauugcaucagaaagauuccuuuacuuuuagcagaucucuaccaggagaaaaggagcaaauguauuggcuuauuggagcaaaugaccaccacaccucaggaacaaaagcuuauacuuucacauugcuuacuagaugccaggaaacacucuaugagcuuuacugguaucaaugaauuuaauccucccaacaaccuuagaggucauggccacauuuacuccuauuuuacagaugagacaagugugugaguuuacaugcuuacaaaaagcacuuaucuuuuaucaucauaaaauagaguuuuuagauaaaacauaggauaagcaguuaaucuuuagauaaauaauaaaacaguuuuaguauaugugccauauauugcaugggacauacuuauucuaaacuguuuuuuacauuuaucugaaauucaaauucagcugggucccuguacuccuauuugcuaacucugggaacucuaaauuagaagcuggauuuaaaauuucaucaauucucaguaucuaacuuuauuaagcaaccaagcuaagcugauuguacaucucuaucaaacaaaguuaaagacaaguuuuuauuaaaaucucugaaucuaaucuacuauaaaaauaaaaugccaagaagauuuuuacuacaaaaauuugcuuuugcuuuccuacuacccagucuguggcaauugagaaggauacagacauugaauguagauucuguccguugucacauuuuauaucuaaauuggugaaaauccuaccacucgugucuguaagccauucacuuuguuuggauugggggcugggguuugcaagaaaacacagaauauuccuuuuuguucuuuuuuuuuaaacuuuuauaacaugggaccuguuaagacagaagcaugaauauucuaggucaggcagagaugaaaggacauaauaaauaggaaacacugcucucccaauguauccugaagaaguccuugucaaucauuuccaguaaagugaauaaaaaaugcuuaccauggcaagagcauacacugaguuugauguaguggggacaaaucauaaaauagguguagggugaggccaaauuuuaaaaucuaagguaccuuggaauaauauacuuccagagauucucaauaacagcauuuuaaauucuucuucucucuuccagguucuguuucaugcagggccaugaguuacugccaacaaguuaauaucuacucucggcuguugauucaacccaaacacugugcaucuccaaucuccauccaucaagggcuucaaaacaauguguuuaucuuucuacuuguugugaauauuaauaaauuaagaucuuuaaacugucuaggaagaaguaagaaauaacugccaagagcuuggguacagaugagguauuuacauacauuagagaaguaccauuaacaguaaguaauggugcuuuuacauucucagaaugcagugcaauagacugucgauuuguuuugaaggugucugcagucauaacacguaucucaugcuaaauggauacuuagcaauuuuuaauaauuuuaaacugaugugcuauuuaaugguuuggugauaacgcacaguuuuaugaagacgguuuuugaauuuggaauuuuuauugaacuugauuaaauuuaaugagacugcaucacuuacauucuaccuuaauucuuaauguuuauaaaggucacaacaacuaauuuuaaaaguuguauuuuagaaaagcaaauucugucaguuaaugacuauacaauuuaaaccauaauuccaagauuuucuaaagcuagccuacauguaguacugugguaugucuucaugagggguauuaaagcguaaaagucuaagacauaucacuguugugaaggaaaacaaauaggagaauuuuauuaacuccagauucuuuugacuuugucugacuuuugauuagaacuagaguacgcaaaacucagcagacuaugguaaagaggauuuacgucaacucaacuucccaagaaguuaaaauuaaaaacauaucuccccuaagucaauacaucccgcauuauuucacuggugacuuuagucccaauuuguuugaggaaacuaaagguaaaagagaaaacaaauuugcuuugaaggagucaaggcuauguggaauagaaaucucugcaaaaauacuuaacccagucuguagccuuuccaugaagcaaagaaaacguaaaacagauuuuggggcauucugacacgaauuacuaagauaucacuuauaugccuguuuuuagacugagaggcuccucaauuccuuuuucuuucugucugcgucauuuccaucaggaacaacuguucaacccuuacuuguagaucuucauaaugauucuugacaauacacgugcaaaauuaaaaugggucucuuugcacugcuugcaguauggcaagagaguuuacaaggcaauaauucuaaauauaaaauaaaaaacaaacacauuacaugauuuuacaaauuuaagggaauguguagaaggaguacuaaucacacuuggcauguuuaaaaauacacuuggugcucgucagugcucaaagaguacagucauaucguuugaauuaucaauaauaauaaaaucauggaggauugaucgugagaguguuuuccuucaucuuagccacaguaauaagaccucuaugcugcacuucuuuuauaauuaggcaaaaaucugacagaaauccugugaaggcagagguaguuauuucuguguauucuuuagacuuccacauuaagaaaaccaugcccccuuuugacaugacuaucucuuucuuccccacacaacaaaacugagaacauaaaauuauggacacaacugggcagcuaaaugcagacacgcugacugcaauaaggcucucaucucacagaggaggaggcaguacagcacucugucuccaguaaaacaucuccucaaaaacuucaaacuuucuuaacaucuacagagaagucuuaacagaaaagucaguaaauucgccugccacacaccaucuugucauuugaccuuugauuucuauaguucagcacucccuaauuccaauagacaagauucaaagaaaugucuguaauacuucaucugcccgaaggaagacagugagauaauauccacacaagucuugaacuuuuaaaauccauucucacugauacaggggaauaugaacuggaagaaggauugaaugccaugcuugaguuuuuaccaucaaauaaaaucuucaguguguuguuugacaaugauauuuacuuugaguguguuuuaaaaaaugacaccugcuacaaauaucauggaucuguauauccuugaugucucacaggucauaaaacagcaagggcaaauauuuuaugagcuacauugcauuguuguuuuguucccaggaaaagagguauuuucucaaauacuaagagaccagucuauuccuggggucagcugaagccaguguugacccuggacaaacacugggagagagcuguuucccuacuaugaugaucccuggagcucagaugcugucugugcccagacccucaaggcaaccauggccaagguagagaaggugaggacacugcucugagacacaugugguucggcacacacguguacugugauaauuguugcuaaugaugcugacaguagccaacauuuaccaagggaucacuaugcagugagcacugugcacagugccuuaugugcugacucacugaauccucauaaugucauuuggagguaaguacuaucagcaacacuacuucgcagauaagaggaaaacaacggacaguaaucgugcugcacagcagcaaucuugggaguugaacuugauaaauccaugcauuuauuaagcucaagucacccauauaaggagucagacuucagucagucucagcuccaccuuuacuauaaccuuggccaaguuacuuaaccucacaaagccucaguuucuucauuugucacauauggaugacaguauuacuugccuuacagaaaagucaucucaaacuuggaaagaggcgauugagcuuacugcauuccuucaguguagaguucccacuauugggccugacuuucuguuuacaggguuaacugacaacucucaggagagggaauaauuaguaugggcuguuacagaccaggaggacaucauccuuucuguaucuaacccaacacucuaccaaauugcacguauagguauagguauagguguauguguauauauauauauauauauauauauauauauaugccucucaaaugcucuuuggacugacuuuaacguuacauuggguccccccccaacaauuagugagcugaacaaaaucuugauguguucauuuuauauuugcaugagagcaugaauuugccuuucugccaacugucugaacacaacauuguuuuaagaauugagauaaugcauaugaaauguucagcauaggaccuggguuaccgaugauucacuaaaugucaucuaucacaucacuccuauaaucaucucuauaacugaucaccaaaaguauacuauuuaaaacuuuuaaugugaggaaugguuguuucuauuuacucauauucaaauacaaacagagaguauuuaaucacuaacugugagaauagcucugaaauuauauacuguuauccacagcuggggccacuuuaaaaucuggccuagagagugauuaucucacacaucacacacccaguacgaaaauggaguuuuuaagauauccacuuucuaggcugcuuggagccuuagugccgucaccucugguaaacaggauucauuagagugauaauugacaguuguuucccuuucuaagugauugcucuguaguuccauuauguucugucagggaagugcuagcaauuaauuaccaauaaacuaaacaccagcucugcuugcagcggaagguuuggaaccauuuaucuuggggguugagggagguguuugggagaggggaaaauccaccucaccaaauacauaaagugcuguguaaaaaccuuauuacaaggguggguggggaugguuagaggcucugggaggacaagagacccccauuuccacuucugacacuuugguauauuaaaagaaaaaaaccucaaaccagugguccaaaaaguaugguccauuuuaacauaggcuacuuugaacacuaaaaaaaauacacugcagaaugauuaugacagucccaagaugacgacaaaacuuuuuguuuaagccaaaagcauagcaaggaaauacucaaguggugugacagaggacuuuuuaccuucuauuaaagauuuucugugcauuccuucuacuggaaauaauauauaaacuccaaauugaggcuuuuugugaaacccugagauccaaggguuugagcuuccucuccucaguaagccaacagacucugaggucagauucuucugcaaaccaucugagauccuauaccauaguugcuugcuuccuuuccuguuuaacuuuuuuuuucaauauagaaccaugugguggcuuuuuauauagauccuggggauacauccucgcagcucuccaacuuccucuaucagcucaagucgcucccacagccacaauggucucuggguucccuagauucucacuacauauuacuuacuauaauuuuuaaaauauacuuaaucacacgugcuuucaguccacuucacauucgagugucucauuucauaagacuguagcuccuugaggacaaggacacgucuucacaggguaauuaacaauuacugagcaccugccugcugucuggaaucaggucaugcaggcagagcaggcaggcaagaaagcaaguaaacaaaggcaaccuuuauuuacuucucccacauuucucugccgugggaaaggcaagucaaagcugaaagaaaaaccaaaauggauuucauggauuucaggucuccacagagcccaugaccuguuauuugaaggcuuuugacccaccaguauguccaaacaucuguugacaucugccucucuguucugugguguuuuucaagggaugcuagguguucuucaaggucaaaagggaauggugcucucuuaaagaaacuggugcugaaaagaauaaggguuuaguuaccuggggcaagaaguagaacaagaauuggguggaggucaagaaaagccuaaggccaagugagaaagaccaacagaagcaaaggagacagacaaucaaugauaaauuucccccacccuaggccuaggggucaguacugauaaaagaggaacagaccaaaaaggcacaggugcaggaggugaccaguccaagccucuccaguuggcuucugagagagcuaacagcuacuggggaaaacuggagccuccaguccaaccuaaccuggccuuaaaaggcacaacccccaagacaaaagcacucuacguauuccugaaacacacaaggacacagauuagaggaaagaaagaaaacaaagggcucauuuacaaaugaaauuuguaauugaaauuauuuugaaauuuauuucaaacuuaucuacaugguccaagaauuagaugaguacaggggacaacuguguaugccccagauucacugguuauuauauuuuuccccaucugccuaucauuugugcacuuucuugcuugcuuucucucuguauacacacuauuuuuuccugcuuccuuugaaaauaaauugcauuuagcgcauacuucuuaaaacuaaaacuaaagauauucuuuuccaccccaguacaguuacuaauuucaguaaauggagcauugguacaauauuauauccaguccacugucuucuguuucucaauuuugucaauuaacccaacgucaucccuuuuggcaucuuccccucuuuaauauaaaauccaguauaggaucuuauuuaguguuccuaacucuuaagucuccuuuaaccucaaacauuacuuugucuuucuguuuucuuuuuuaacaguacaccuccaugccccaaaccccucuaccccaacguguguguguguguguguguuucauuuuguuuaaauagaacuauuccucauuuggggguucucugcuguguccuugaguuuagauucagguuguauauucuggacccaaguaccauauugguuaugcuucucaggguacugcaucaggagacacacacauaucucuuugcucaugaauggugaugugaauucugaucacaggucaagauguugucugguuucuucacuauauggcuacuguguuuuuccaaacacaagacugcuuaauauucugaguguauauuaggcaggcaaagaaucuagcucauuauauuuuaguuauacacuaacaaaguacgcacauuuauaaaagcuuacaguuguauuuuguuugucuaaaauaaugacacauuaggaccaaugcauaauugcucacucuguguugucuaccauucugagcuauaagcuuuuauuaugcaaaggcugugguuugugagcuaucauuuguaugggcuccuucaggcccucucaauaaaaugacacauacaacaaccaauaaacaugcccuuuucuuaaacauggucgggguggacuuucacauuucauagagcaucucagggcuguucaagcuaacagauauuugaaaucaauuaguccaacccacacauuuuuacaguugagaaaaucaagaccuaaggaagaaaaaaacgacuugccuaagguaauacaguauaauaguucuuuauaaacugaauuauaaaaucaauuuagugggccgugaccagcauguuuuaaacugaaauacaauuuuuaaaaaaaucugaguacuuagcauacagcaaggguaaacacuguuuggugaaaccuuuaauuauauauguguaggaguauagaugcucuccuguacuaaugggauaaaaaaaucuuuuuuuuaagauggggguagcccaggcuggagugcaguggcauggucauagcucacuauaaccucaaacaccugggcucaagcaauccuccugccuuagccuccugaguaacuagaauuauaggcauacaccaucaugccuggcugauuuuuuuuaaaaauuuuuuuguacagacaaggucucacuauguugccuaggcuggucucgaacuccugagcacaagugauccuccuugccuuggccccccaaagugccaggaccuuagccaugagccaccucacccagccacaaaauguauuucuuacugaauucugugguuaaaauccuuuaaagaacuccauuagaacuaacccaaaaccaguggucauucuaccaggaaaguguuuuugcaaaguuuagugugaaaacaaauaaagguugaaaugcagcuucugauuuaacaguucugguauggaccugagauucugcauuuccaauagguuccuaggggagaucuaagcugcuccugccagccuaucaacuaccuuugagaaguaugauuaaaaaacacugcaucugagggaggaccuacuuuauuuuuaacaacgccucccugaaguagguacuauguauauacauacguauauacacacacacaauuuuuuugcuaacaauuugaauaggaacaacuaauucuugaaaauguuuaaaaauaacaaaacaaaaccuuccacaaagaaucaccucaauucacuacagagaaaaugugcuaauugugaugguaauaagagcgcugguauuuacugguguucacaaugacacgcaugagaccgagugcauccauaacccaguugauucagguugauaugauuucccccagauuacagaugaagaaacagacccaaauuaguuuauuuucuccaaggucaucuugcuugagaguggagggacacagauuagcauccagccaauuaauuccuaaggccauacuccuaucauacucacugacucacagauguauguuauccacacaccuaugcacaugcucuaaacauuacauaugauauaaauacauauuuagauacgugcauuagcaccuuggcauacacuuuuauaaacacucuacaauauucaggagucagggaucacaagaggaaacuaauauguaaaaacccaguucucuaaaauuaggugccuucucaaguaggucaagcaaccgcauuuauauugucuacauuaaagggaucucuugaaaacagucacauuagcagaauacaggggcugagugagcaggcuggcaggggaggagugugagcaggcuaacgacuagagcuacaaacaagauuccaucaccuauaacuuagauuucaugugguauauuuaguucaaacccugucacuuuauacaaauagguugucacguaaagugcaaacaacucucuuuugacaaagugauacugcuguggugcuggguugauggcuuuauauuccacaaagcuuuuuaagugacaaaugauagcugagucuugaaaauauggugauaugaaaugacugcauaaauccuuucaggcuucccggggggagcaaaagcauagcauuuugcacauuaauuaaaaaagaaaaucugagaggaugagguuagaucuuucuaaucuugacucugugcaaacggacuuugaaguuacuggcacaaaauugagagauggccccagaaaagucuucaaaugagauguacaauguuguuuaaagaucaggcucaagugcugcucuuggcccaaaugaggccaggcaagggugcaauaauuaucucugcuagagacuguuggugcacuggcguugaaaucuuuugauauguuggauaaugcagauuuugugugcacacauugcuuucccaagcugucuacaucagugucauguucaaaugaagccgaauaguuuaaaaggcucgcuuucacacuggcuuuauuuagcuugcauaaacauuuucccuucaaucucauauaaagucuugcugcguaaaugcagcuguccugcucuugugucuuaauacagaucuuuacaaagaggccuguugggcaacauauuucugguagaugauuaauaagagauauaggauuucuuuuaaaaaaaaucaugcucugacuacagagggcaaauucauuacccauaaaucaaaaggaguaagggauuucaguaguaucagaagccuuaucuggcuucaaucugacaguuaacuguaggccgugaaugauuaaauaaaagucuaaguucacccgagccuggauaaaauaaaacucaaagcccagaaacuucaaauaaaauaagaaaaaaucauaauuuuucaccucaaaaggaaacugagaagagaaguaugaugugacagaaacuaugauuucaaauggaggguuucuuuuguuguuuguuuuucagaacuagacucacauuuuacaaaaggcucccuacccauaaggaagaaaguuuugagaguaaugagguugaucugaacuguuaaaaacuuucuaacugagauauagcaacauaugguguggcagaauaaaaauggccacaaaaucuuuaacauuccuuccauccagaagugaggggucuauguuccuucucccugaguaagguggggccacugaguauuuucacuaagagaauucagcagaggcugggugcgguggcucaugccuguaaucccagcacuuuaggaggccaaugcagcaggaucacucgagucccaaguucaagaauagccugggcaacacagugagagccugucucuauuuuaaaauuuaaaauaauaauaauaaaagaauucagcagaacuuacuaugcccaggccucaagaaacuggcauuucucuucaaacacuagcuuucaaauccugaauugcucuaagauaagaagucugccacccugaggcuaccauauuaugaggaagcccaagacagcauguggcgagagaaagggaaagaugcccacccaaccuccagcuaucugagucaucccagcugaggcuccagacauuaaugaacugcaguaagcuauucauccuaaugcccugugggaaucucucacccacaaccuugggagacauaauaauaauaaauugucuucagcuauuguguuauggaguaguuuguuacacagcaacagauagccagaacauacaauaaaaugggcuaaucuuaaguguauagcucugcucuuuugcauauguauacacacgaguaaccaccaccuaggucauaagacauguuuccagaagccucucucugacccuacccagacauuucccucaauaaacauccccauccuacccccacacaaauaagaaaccaguauccuagcuucuauuaugauagacaaguuuugucaguucuugaauuucauguguaggaaaucacauagaagguacgcucuagcauccagcuucuuccguucaacauacuaucugugaaauucaucacugcugcugcacagggcaguagaugguauguuuucauugcucugaaguguugcauuuuguaaguauacuacaauuauccauucugcugcugcugauggauauuugguugcuuccaguuuggggcuuuuaugaauaaagcuguuaugaacauucucauacaucuuccugguggacaaaugcacucauuucucuuggguauauaccuagaaguaaaguugcuggaucgcagggcagugcacucauuugguaaaguauuaguucauauuccaacuacucaaagaauugcucaucugggccacguuaucauuguuuucuccccuauaacuagcaaauauugaggcaaaaucaugcugcauuaaauuaagcaauuuaugauuuguccuuccauauugaccuuuccugacuaacuacacaauaguauuguucucaaugaugucuacugucaugaacaugacauuguucuuggaaaaauccuaucaggcaaagucaaccucuaaaauagcauuguaauaaauaugcagaaaugucacuuuuugcauuagcccaaagguuuuguauagcuuaaggauacaugcaguaagcuaacuauaaaaauagaaacuugacaguggggauguaugugugugucaaaauaauauuacucuuucuggguguauggcagaaaaaaugacacuacauccaccagcaugauuuuuauagaucugccucuuugccagaugucaccuuuuauaaacugcuuuauaaaaacaugacaguauaagugcaauaguguguuuauugcuugauaaacuuuaguaauaaacuuaggauagguugaaaauuaaagccuuagagccuauucauuaagcauuuaggacaagugaguaagcaaaaaaugcaaacuauuaaauccuaaauguaugcagaucaagccacuagcagcaagcacuauuucucaaucaguaugucuuauggaaauaucugccaguuuccuugucauugagcuaaaugcauuacagccacaucuaaagcaugccauuugcauugcuacaaauuugaaugaaauccagaauguuacaacugccacaggcucacucaaaacagauuaagucuuuuucaaaacuguucuguaacuuagcacagcauauuuuacauauggcaaaccaugguuccaacaacuacuuuucugaaaagacuugaaaagacuuuaaggaauuucuuaaaauaauuucauagcacacacucaauauuuugauuacugauggauuauacacagcaauguaguguggucugaggacuuuggauuaccugcagagcuuguuaaauagagcgauccuguaguccuuuccuaaucgauugaaauaaaaucucuggaacaagggacccaagaacuaggauuuuauuaaguaauuccaaaugauccuuauucacaauaaaauguguuaaccauagcuauacaguaaucuaauaaaaagaaacuuuacaggaaaguauauuggcccagaagggugucauuuuaagugaauaauguauucuuacauucuuagguucaaacuguuacucaacauuauauuuuuaaaaauucaaauggcuuauauuaguucauauuccuuuuuuuucuuguaguuauguaugaacacccacaaaauaaaaucuacuuaagaacuuuugaaaaucaaucccuauaacaagugcauauauaacuaaauuuuccugaugauucuauucauccuggacugacaauuguuaucuuuguaauugauaaaugaaaaaagcaguaaaauaaaacaaucccuuuaccaaauggucuauuagaauuccucugaugcucaucacauuuuuccacugcuuacuauucacccccagaucucauaaaauauuucaguaguuaacuacagcaaagcuacuaacaugcaguuuguguuggguggauccucacaaaagugaugcuaauauauuggaaauauauauacauauaucauuauauauaauuauauauaucauuauauaaucauauaauauguaauuauauauguguguguguguguguguauauauauauauauauaauauuuuccccauuaacaaaucagugugccaacaugacaacaaguaggagagacugucaaagcuucacaguugcuacagaacucuaguacugggaaguacuaguucaaaauuccauucugggcaaguuuuucuucuuuuuuuuuuuuuuuauuuugagacagggucucacucuguugcugaggcuguaguacaguggugcagucuuugcucacugcaaccuccaccuccuagguucaaguaauucuccugccuuagccucccuaguagcugggacuacaggugcaugucaccacacccagacaauuuuuauauuuuuugguagaaacgggguuuugccauguuggccaggcuggucucaaaccccucaccucaagugauccaccugccucggccucccaaagugcugggauuacaggcaugagccaccaugccccgccccauucugggcaucuuaaacaaaagcaaaaacaaaaaacccugaacacaucaugguauaaugcagugauaaagcaauguagggcuuuucuggacauuaaaauguuugaaaauaagcaccaagaaaaaaaucacauuaaggagcaaaaauuacaguaacugcuugccuuuuucuuuggacaucaaaagaaagaacuaacaaaaggaaagucuugcucgauuucugaucauuuuauuuaucuuauugugaaagaaacaacacugaaucaagagugaaauagaaaucaaccaaaugaaaugacagcaaaaguugcaaagaaaggcaucuggggggugaaaaaauaaauguuccuucacagaaagaaaccaguuguuuaaaaacaaaacagaacaaaacaaaaacuuacaaaaacacagaaauaggucaagcaaauucuacccaaaucccucuuccuuugggccuugucacaacaaguaaaccucaucagaggggucaagaccacaaugacugacauccugaucaugugaugugauggacagagaacuugacuccgagucagcagaaucguauaguccaguuugacuucaauacucauuaauucaccuuuuaaaaguuucugacucucugcauucauuuuugauugcugcuguaacaaguuaucacaaacugagugguuaaaaauaauacaaauauauuaucuuacaguucuggaagccagaaguacaaaaucaguuucacugagcuaaagucaaguuguuggcaggcugauucuuucuagagauucggaaggaagaauggauuuccaucuuuuccagcuucuaguggcugccuauacuccuugguuuguaguucuuucccucaucuccaaagugcauccuccaguuuccgccucuguugucacauggccugcucucugauucugaccuuccuccugccuuccucuucuuacaaagacacuaugacuacccugcacccacccacuuuauccaggauaacuuccccaucuuaagauucuuaaccugaucacaucugcaaagucccuuuugccacauaagguaacauucacagguaccaggaauuaggacauggacauacuugggggccaucacucagccuaccauaaucucuuuggauuuucuucuuaauacuaguucauucuuuguucauuuacucauccacccacccacucacccaucacccucacucuacaggaguuggccacagcuucccgacuaguauggcagaacaaaacgguguguuguaaaccuucaaaggaucugcugacaaguucugaucaauauguauaauugauuuuugcugcaacagaguacacauucugacagggugauguuuuuaagggaaaaaaaaaaaacaacgaacagaguagaugauggaacgguauauagauugggauaacugacugccaguaaaagggcagagacauugauucacauuaaggugggaccaaagaaauguaucagguuuucuggaaugugcagaacuguguuuacaggaagauacagaaauuugucucaugagcacauagaaguccgugaccagaacagcaaacagcccaacucaaacagcagcacagccacaaugaaaccgcacaaauaaagugaucaccguggaagcuuccagagacacugaggggggcuguuucuccccagcagugguugcacuguaauuaccauaguucguuugggguugccgacuuuuggucuuuucaugccaggauggacuccugguucugaggguagaaucaucuuucuuuaauuucaugggaagggguaggguaggugccuacacaaaacaggguuuuaucaggaagaaaaacaggaaaacgaccuaagaggaugcacaauagcagcucucacaaaaccgcagucacugggggcucuuucaguaccucaauuuaaagcgcuccguaggaugacaacuuauaucuuaauuucucccacacaaaaucccucuaaggugaguuucuuuaggcaccauccagaccacauuuuaaguuacaccauuuaaaauaaacuuuuuaaauucagagaaaacuauccaaguacguugacacucuuacguuguuuauguauaaaaacaauuacaacguuaagcuuccucuucauuucaaauuuguuuauucuuacauaagcuucuagacaaaagcauacucucugaaggaaaacuggggcagauggggguggcgcaggauagcggcagcguuauugugacuagguggugguuaagaaaauauuuucaagacaacaaccugaaaaucaggcuuaagugccagaaguaaaccaaaaagaagcaauagcaagugacaaaaauggcuaacuggagaggaaaaaaaauaggauuucaauuaaaucauaaacgauggcuaauaaagugcguuuuaacagcuguaacgcuaaacauaaugcaucuuacucuguuuuaauucaaauauuaauccuuguccaaucacuguaaugggagaaaaaugguaugcucugaaugucacauucgaauuggguagcaauuaucuuccugguaucaaugucagacauucacauaaaucuuuaaaaaaugauaaacuuacccaaaaacauccaaucaaauaaaaugaaaagauuucuauaaaacuugugcuauaauuuauuuaaaauuacaaguaacauaagaaagauggauaauuacaauuagggagauauaaauuugaaauggaggaacauauuaauauuuuaaucuuucugauaauucuuuaaaauuaccuaauauuuuuauaucagcaaauauugccucaaggacucaauugaaacccaaaucguaaugaucacuauuuaacuaauuuauuaaauaaaacauguucaauuguacacuaaaucaaaugacauggccaucauaauggcagagcuacaaauuuuaaugagacugaagaaaacaguaaaaggucuuugaaccuguuauccaugugaucacagauaccgaaaacaugcuuguuucucuccuuuguggaggcucagggacuccccaacucuaagcaacaguuauaauaauauuuacuacgugcuucccacccugcgaagaauggacaggcaguaucucauuacauucugacagcaggccagguacaguggcucaugccugcaauuccaguacucugggaggcuggggcaggcagaucacuugagcucaggaguucaagaucagccugggcaacauggugaauccccaucucuaaaauacaaaaaauagccaggcgugguggcauacaccuguagucucagcuacucaguaggcugagacaggaguauuguuugaacuccggaggucaagucugcagagagccacaacugcaccacuguacuccagccuggugacagaucaagacuaggucucaaaaaaccaaaaaaaauucuuauagccaccuaaaagguuaucuucacuuaagagaugcauaaucaggcauugagggguuacaaaacuugcacaagaucccagaacuaaggggcagaggaacuccaaagccuguaggagaacugcugaaaucugaggaucuccucucucuguauauauuuaaaauaugauuucugucucagucuauugaagcugcucuaucaaaaugccuuaaauugggugauguauaaauaauagaaauuuauuuuucacaguucuggaggcugagaagcccaagaugaaggugcuggcagcuucagagccuggugagggcuugcucucugcuuuaagauggcgccuucuugaagcaucuucagugguagaaggggcaaggaagcucccuccaaccuccuuuaagagggugcuaaucccauucaugagggcagagcccucgugacuuaaucacuucccagaagguccuaccucuuaauagaaucauguuggguauuagguuccaacauauaacuuuuggaagaacacaaacauucagaccuuagcaauauucauccaugcuucucaacucucauuuuacagcagaauuucccauggaauuuucaagaaacacauuuguccagguacagcccauagaaauaccgugggcccaacagcuuauuuucauuaugcuuuucugggcaauuaugaugccugcucaauguguggaacuccugcucuguguauuucaggagauccuggaguauauuagcacuaaaaugucucuuuuucuaauaguaguacaucacauugguuuuauaaauacuuauaauacaugacauacuacaaugugaaggugguuuugcaugugucaucacaugugacaucccauuaacuuaccaagagucacagggaaagacuuguuauuauacccaauuacaguuugagucaauaggcacaaaugaauuaucaacuuuuugaccuuggaggccaucuccaacuuuauauuacauaauccuuuugcuuuauuaacaagaagucuaagguccagagagauucacugacuuuuacagguucacccaguugguaaauaagggcaccggacaagaaaaacaagaauucagcucccacaacugauaugauguguuauuuguaacaccucacccagaaugucuccagccaccuuucuuugaaaccugcacuugcacuguuaaacugggaaaagauuaauaaguacaaucguaugaucacauggguagucacaacacuguaaucugagaaauaaucauuauagaugauaaagaaagagguagaggaggaaguacuauuuuugugcccuugauuaucacauuacaaagacagaaacugcgacgacuauaaaagaugaucagaggaaaugauaucccaaauuugaaccgucugaauuaugaaaaaaauacaauguuuaacuagaauguucccuaaacaugucacacuuugaauaaaaggagcagaaggacuguauagaagacuggcaacaaagacauacaggaaauguaagauucacuauuuagguaugaguuuagauuuuuuuguauggaaguagagcauucuccccacccuuucuccuacuuccaacuuccugcaaaaauccuacacagaggcaaaauauauaaaaugucuuaaaaccaaauuguuaaggcccugucuccuccuacuggggcccaaaguaccuccucccucaaggggacgcagggcucccaggacaccaccgggaaucacuguuucacauucaugaaauacguagucagugaugauaucuacauaacgucaagcgucuaagugcuugacuaaauuuucccauuauuuucacuuugccaacuacauggauaauaaagaaaaaaaugagaauuuuaaagcuaaaagacuccuacuggccaauuuugaguacuuccugaggaugagacacuuuccacauaagccgguuagagagaucucagugagccagugucccaacagaacauggaaaaugaagcccagggaggucauacaaccugguauaugguacaacaucgcccugcaggcuggaaacaaggccaggucacacugagguuuccagacuccacagggagaggaggaaauccuagggagcagauccccaucuguguugaucuucaugauuuugcucacaucccugugccuccuguacuaucauuccggucugucuucuuuacaucugcucaguuccuccuuaaauuacuuugacuuaaauggaaacauucuaucuguaccauaaauggaaaaccaguaucacuugccacagauagacagcuaacccuguuaaccuugaaacaaaaggauauuaaacuguagccggaagggaucccugccugaggcucugagccuggggccugcccacgcuuuguuauaaggaagauuagcaaauacuagaaaggugagaaagcuucccccuggcuaaugagaaggguugaaagaaaugaaagggaauaacuucccaagcuugccagaaacaccaagguagggcaguuuuuuuuaacccugcuuugaggucuagaauccuuuguugaaaugaaaucuuauuaacaauagaagcaauaaugaugaugcugauaagaaacagcugguuguauuaggauacaccaggcauucaaauacaaguaaacucaguacuuagaaguauuaacucauuuacuccucauuaacaaacuugugagacacagaaaggucaaguaaugggccccaaaucucucugcuaguaacagccaaaacccugguccuauaaccccagagucccuguuuuuaaugaccacccagacugccccucaagauuccaguuacuaaggccgggcgcgauggcucacgccuguaaucccagaacuuuggaggcugaggcuggugaaucaugaggucaggagauggagaccauccuggcuaacauggugaaacccugucucuacuaaaaauacaaaaaaauuagccgggcgugguggcgggugccuauagucccagcugcucgggaugcugaggcagaagaauggccugaacccaggaggcggagcuugcagugagccaagaucgccaagccugggugacagagcgagacuccaucagaaaaaaaaaaaaaagaauuccaguuacuagcaacugacaauagaguugugguugaaaagggauuaaggagcuaaaguguuaugcuaagcaugguuaugaacaaaaggcagaaaaagaacaaaugcguccacuauauggcuugauuugauuacuugaaaauuauucauuuguuuuacucuuuagcucuuugcuuccuuuaagguaaucacuuuuaacccucuucucauauuacuuggcugaugauauaccuugguguacuguuuucuuuauuugaacaaauaugguuacugugccaguaccuucaacagauucaaaucuuuuuaaggguaaaaaggcuuuucuauuuuucuuagacuacaaauaaugacuaaaguaauucaaugauaaugagcauucuagauauuucugaagguuucugaaggucacacaaaggugacuguuucuacugugcuaauauaucccuggaauuuucauucuuaauauuuuccaaagagcaggucaacacuucacagcaaaaaaacagagugaaagagaaaacaauuuuuuucauauuauucauauauguuuuuaauagaugauuaaagaagaaaaacauacccuggaaauguagaaauaugaagccaugcuacauauuuuuauaauuauguuuuauugcguucuguuaacuggccagaggguuuuuaaaaugccaaaagauuccaaauuaaauuaccauuauuaagccccuuaagccucauauugaguuuagacugucacuaaaaacuuuugauaaauuaaauaauaugcaguaugaguauuagaguuugaaauguuuaaaaguuucuuuacacaucugucagcauaaccuaagacauaaaauggcuuacauacauuuuuuucaaugauaguguuuuguuuucaauuuguuuuuuagaaauguaauuaaugaaagcuacagagcaauaaucuagcaucuagaaaugccuucagaguuggguuuuuaaacucuucucuaaauuuauucuguugcuaaaaauacauucauuacauuuuuaaucuaacagguuuuagugaauaaaacaaugauguagauauaaagcuaaauuucuacaguacaagacauuucaaacaucauaaaccaaggcaaaagaggauuuacaauacagagucaaacuacaauggacacuucagaauaaaauucagucaguguccucugcccugccagcagggcauuuacuguaguggagaggaccaggaaggagauucgcuuuauaggauaaucauguuauguuaugcuuuuauugaaugcacuuacauuuuggacuacacaauuguucuugaaauguuuccaaauguguguaaucaugaccgacgugauggcagggaucuacuuaauuuccgcauucaaaggggaacaugaugcaaauacuaucaagcgagggcacuuccugucauauaacacagaagagauaagaacuugaccaugagcuggcaauaaauucaucaacauccuaaaccagcagucaguccccaaccuuucugguaccagaaacugguuucauggaagacaauuuuuccacagauggggguggaguggggcuggcagggggguggugaugguuucaggaugauucaagugcauuacauuuauugugcauuuuauuuauauuauuauuacauuguaauauauaaugaaauaauucuacaacucaccauaauguagaaucaaugggaguccugagcuuguauucuugugacuagcuggucccaucugggggugaugggagacagugacagaucaucaggcauuagguucucauaaggagcgggcaaccuagaucccucccaugugcaauucacaauaggguucacauuccuaugagaaucuaauccugccgcuaaucucacaggaggcagagcucaggcaguaaugggagugaugggggagcggcuguaaagacagaugaagcuuugcucaauugcccacugcucacuuguugcuguguggccagguuccuaacaggccauggacugguccaugacgcaggggcuggggaccccuguccuaaaccauguuugcuucugcccccucacccuuucccagagugaaugguaauuacuguguacgauauuuaaaaaauggacgauguccccuuaacaguauuuucugccugaguccagagcuacuaguaguagugacugcugacuaaaggaugaagcuggaguaaaaccuuuccugugcugugacccacaucuccccauugcugaagaagagaaauguaaaaaugcuuucuggaagaagaauuucacaagguuauguuuucccucagcuuuccaugaucacaguaaucgaaaaauaacacucuuaguuuacagauuucaauuuggcaguaucuggcaauguuaauuauauaaaugagaagagagagauaagaggugggaaacaggaagugaaugccaggaaaaugaggauccaggucuccuccucauggaggucguccccaggcuuccugcaccagugacagcaccugccaaccacaacauuuccuaggcuucuucccugauuuauuuucucccuagagcuuaccccucuauaacacagucuauguuucauauuccaucuucuucaucagcuucuuuaucccccacaacaaaaugugcuccaccagggaagggguuugaaguuguuuuguucacugcuguguccccaggacuggaugacagaggaugcccaccuuauuuaccaauauauucccagcaucuaguccaagggucugucacccuuuucaguaaagugucagagauuagcuauuuuaggcuuugcaagccauacaaucucugcugugcagcuacuuagcucugacaccguagagcaaaaacagccauagccaauaaauauauaaauaaacgggcauggcuauguucuaacaaaacauuauuuacaaaaacagccagaggaccagauguggcccagagcuauaguugccaacuccauuguagaccaugucuugcauauggugugugcuaaauauuuaauauuaugaaugaaugugauaacuccaaaccagccaacccuccuauuuaucauuccagaacaaagaagacucucauaaaagacaaccacuaccagauguuuuaagguaacagguauuaaaagcagaauggguaaguaaaacauagaguuuguccucagugacuggagauggucucugcuguccugacuaaaugaccuauauuagggucccagugggaaccuaauucaauucagaugguucaaaugaagagacucuaauaaaaggcuuauuaauggaggggcuggcaggcgaaggaaacaagaagggagguggaggcacucagacaagagcaagagcaggaggucauggcaucccucaaagggcaaggggaggccacagugaucccagagcccugugagagcuaaaacauggaggaaggacuaucaaugucaaauguaaugcucacucaaucagggaagaagcaagaaagagaaccccaacuuccuucugcuccaguccucugauuuucagccuagccaccaugcuugucaaucccagauccaauccaacuguaagggagcacaggcaauguagucuauuggaaaaguuggaaagggcaggcacugaacacagaguaaggcaggaaugagcagagacagggaucuagaugagaguggcagacugagcaacuaacacauggaucaauuaagaucaaaacaaaaucauuguauuaguucauuuucauacugcuaugaagaaacaccugagaauggguacuuuauaagaaaaagagguuuaauggacucacacuuccacauggcuggagaggccuuacaaucauggaggaaggcgaaggaagaguaaaggcaugucugacaugacagcaagcaagagagcgugugcucgggaacugcccuuuauaaaaccauuggaucuugugagacuuacuaacuaacaggagaacagcauaggaaaaaccugcccccaugauucaauuaccucccaccaggucccucucacuacaccuggggauuaugggaauuacaggauagauuugggggggacacagccaaaccauaucaaucauccuacugaguacagaaaugaaaacuucagauuccauacacuugacauagauuacauaaaagaccaccaauaauaagauugugccccaccuguauacaaugagcuguuccaagccaaaaaugugucuugauuaaugcuguggucuuuaccaggagcaguuuucccacccaggucacagucuucacaaauuggaagcagcauuaccucuagaguaagcaauaaaugaaaauggugccuuuaauuucaaauuauaagguaacacacugauggauaaccauagcaugauuagucgauucaggaccucaauacacaauagaagaauccauccauuaucugcucaaaguaauucuuucaucccagcaacuuuaacaacaacccaggaaaauuacugucccuuagcaaagccuuuugaauuucauauggauuuaauuaguuaacugccaucucaaggaugagaaccaugacaaauaguuguucuuuucaaauuagaagaauagacuguucaaugagcaauauugauguuuccccucaccuauuuauacaagagauuuucuacuuuuuuuuuucuaauuuagcuaaccauuuuaacauuuaucgaagcuuuugugaucacuguucucuagcugaguguucuagccauuagccauuagcuuuaaaaaacagcugaaagcagccucccuguguacagaaaauaccguguuccucacuagagaccccuggcaaucugaaccacuacuagaggauucuaacaagacauucuuuaccaguggacagaaaagcaaauagagaauauuguucaaugaacaaugcaacuacuaaucauaacagugcuguaucuuaaccuguagucaugaaccuaacccagcugcuugaggcaagcagaccccucuuucuuuuuaacuguggaacaaucuauagcaugggaaauggguuaagauuuggaaaagaaguuaggugaguaacuagcagcagaaagccaagcaccguaagacucuaccuauuccaucugcauuccugccuuuucucaaaaagaucucaaagcagaaagaagcaaucagaacaaagccagucagcucugguagcuugcucuuaccucuauucuagcuacaugucaccuccugugagacccucugccccuccagacaguuuaagaaacuucucagaagacuagacacacacuuuguggcuacuagugaacaauuuauauguguguuuauauuucuacagaacuuugaaaaagacuugcaucuauaugguaaguaaaugcuccugauguagaaaaaagacaaacaggaaagacaaaaccauuuuauuugguaucaucaaauuaaaaauuaauugccccauauguucaaauaauaacuuauagccgauugugguaauccaacauauuggauguuggcuuucaugaucucaccaauacauuuagcaaauggcuguggaaucuggcaauaaaauauuuccagucucuaagucuucuugauaauucacucuguguuuuacaaacaacugggcucccgggauucuaagcacaucacucagacugacagagcaaguauuccagacaauugguuccuggagggucaagacagcaaugcucgaucaggauucaaacgggucauaaacccuucauggaucucucucaaguggguggugaugucucccuagggcugcucaucauuugcugcuacagucaagcacuugucauuauagacaaacaccccaucagucuuagguccucauccagcagagucuuacugccaccgguggagacaaccaccgguauaaagaaauccaaacaaaaauucggcaugugugcccauccaggcaugacuguucacugugcauuucacuucuacgucugcacuuucagcauggccacgaaacucagcaccuguuuaucugccaugauuucaggcauccagauuguucuggaaccauauauaucaaaagcucuaaaacaccaaacccguuucuagaaauuuauccuaaggaaauaauuggacaaaugccuaaaagauguauguacaaggugguucccugcuguguucuuuacagaagugaaagacuggaaaugcaucaaucucaguuugguugucuacagaacgggauugcaaaaucugauuuacacguguuacaauuacaucuugucaccuaaugccaggagcagacuauauauggcuuuaagcuaaaggaacaucaaagucaugagugccuuggaaaacagagacaggagugugcauauuuuaaagcagaagcucccaaccacagucuuguucacaucccucaguucuuugaaaggcagccagaccuccauuucuaagggacaaaugugaccacaaccucucccuuuucaagauucuuccaaggcuuccuccugucaccagaauccccugcauaucuuagcguggaguugaaggucuugugcaaucuuaaguccaacucaccuacugccacuuuucuccucaccuacacuaugcucuagacacucuggauuucaugaaguacccuuaccuccaggccuguguacaugauguucauccauucugccuggaaugccuuucuuuacucauccaucagcuuagcuagccuccuaguuucuugcaccucucagugcccuuuccugauuuuuuuuuccauucuuuccauggguggauauagguuccccucuccccacaugucccuaagugccaaguuucauguuuccucuauacauuauaacugcccuuuucauaucucuuucccaucagaccuuagucaccuuggggucaggaacuuuggcuuauucauguuuuagaugacaaagaacacaauuuuaggcaaucucuaacucugcccucaugccugcccuagguugggaagacuugguagcuucuuugucacuccaauucuuuaacauagaaauauacucgguccggguaugguggcuugcgccuguaaucccagcacuuugggaggcugagguggguggaucaccugaggucaggaauucaagaccagccugaccaacauggagaaaccucguaucugcuaaaaauacaaaauuagcugggcgugguggcgcaugccuguaaucccagcuacuugggaggcugagguaggagaaucacuugaacccaggagguggaaguuguggugagccgagauugcgccguugcacuccagccugggcaacaagagcaaaacucugucucggaaaaaaaaaaaaagagagaaaagaaaagaaauauacucuacugacacuccaggaagcaugcccuaagaucuguaccucaugauucucccacauuauuaagguacaauuguccugaaugcacuuguccuuccucaccauuucuguguaccauguacacaaaaaugagggguguauccaacaagggagcugcaaacuagaacaagugccacuagauucuuucauuaaugcuaauuaaauaucuauucuauacuagguacuguccuuagcucuuuacauauauuaauuuauuugguauucacagcuaccccagaagcaauguccuacuauuaaccucauuugagauaucagaaaaugguaugagagagguuaagaaaauuuucuacuaucucaaaacuccuaaaugauaaagccagaaguugaacccagguagccuggcugcagcaucuguggcacugcugccuuuccaaccuacccaagaugacugagccuccuggccugaucaaggagguaugcuuggcuauagaguaucugcucagacacuagaguaucuacgauggaggaaaauucgagcagacaguaucaucacagaaagaaacugauuaugaaugaagaacgagcuaggugucaaauggacaugcagcaacagaaauagacaaacuagcuggaucauucuuuuccccagagggcugugggaucuaggaauggguguuaaccaucacacuacuucugaaucucauauacacagguggaaccugugggaaccuccaaaagacugauuuucccucuuaaugcuauuauucugucccuagaugugaaaaggcaacuauuuuggggagaaucguuuucaacaauaugaggcuuuauauaaccagcuucuacucuucugagccaucccuuccuugauuucccccaccacuccaucccuaucacaaccaagaauuuguucuccagaaacaaagaugacagaaaucaaguuagggacauagagaugcuaucacagccaacucagaggaagauuuuugcccucccuuaucucaaaaccugcauuggccgacauugugucugcuccuagacaccacuuaacgaaagacuuuaaaaacuuuaggaacaauuuauuuaaagaaaacuccauuuccaguauacuaugacuguauuccaagguaauaaaguauaaaugagaacaaggaacaagcuaauaaacugaaaugaaggcugcauuucaauaacaagguuugggagccauuuaccagccacguguaucucacucucaugacuuauaacauuggcugaauuacuuaacagaaaugaaagcgcauauugcuucuguuauccaaugcugaacaaugugacauuugcuucagagcacuuguaucuaaucgauacauaaugcuaaaugugauuuaaaaucaauuuaauugugcucuugcucucccaugagucaagggggaaacaaagguaucauuugagauaugaaaccauuaggcuauuucccaaagaaaucauagaucccuugcuucuaauggagcccaagaaguagauacaguuaguuuacacuaaaaacuccacaugugaaaaacaguauugcugaaacaguuaagauacugugcccuaaaaggcauauuugaacuguuuuuuuuuuugaauuacaaaccaauugaacuuuuaaaaacuucuuuauuuguugugaccuuucuacaaauuauagcaaauuuaaaaagaaaaaauauaauuaagaaaaaaacauaauauugcaugucauauauauacuuacuuuccuagauuacauacuuuuaaaauaucuguauuccuacauauugaaaccaaccaaauugucccauagagcuaauguguaugauuuauuuuaauaaacauagaaauugauucucccagucuuaaaacaugagaaaguuauguuugucuuuucugaguuccuuucucaagaaaccaaccgucaggccucccagauaggaucaaggagcugaaacucaccagauuacuguauuuggacaaugagaugucagaucccucacccaucaugauugccuaacagaccaccugcuuccuguugaucaacuucucucccuuaccccucccuaauuccuguuuuccuacacaugguuacauuucuucucugccuacauaaaccccucauuuuagucagugagagagauggguuugacacugacuucccaucuccucaguuacagcaugugauuaaagccuucuuccuuggcaauacuuguugucucagugacuggcuuucuaugaaacaaauggaaggaccuagacugaaccccugguguuucaguaaccauguaauauuuucuauuauauuguuucucugaaaauaauuguauaguuauaugcugagccaauccugaguguguacaaagauuuggacuuggagucacuucuagcauccaucugccugaccaacaguuacugaguccccaguuggcacaagguuguauuacuuauacucaaggaaaugaggcucagaccaauuuuaaaggagcaaauucaggacucaacuaauaauacaagagucucuagacuuuacuuuauaugaggauguuuaaacaauccaaaacagucaguaaguuccaccugaauugcaguacuuggguugagugucucacuuuuaaaaacugauguauuggccagcacagugacucacaccuguaaucccugcacuuugggaggccaaggcagguggaucaucgaggucaggagcucgagaccagcauggccaacacagugaaaugccaucucuaacaaaaauacaaaauauuagccaggugggguugugugugccuguaaucccagcuacaugggaggcugagaaaggaaaauugcuuaaacccaggaagcagagguugcagugagcugagaccacgccacugcccuccagacugggcgacgccugggcgacagagagagacuccaucucaagaacaaaaccaacaaacaaaaaaacuauauauugauuaaacgaacuaucugugauuaauguacagccuguguguauuuuuuuucuaccugcauucaagaaauuguauggcuauaguauauaagaaacagaaucuuuuuaaauuauuuuccuaacaacaacugaaaauagucccauacaauguacccaacaaaacuuccuuuuucaaaauuugcuuuaaauggacaaaauuauguaauagugaaguaaacuuuuauuaaaaagaccaaauuacuaguugaaguuaauugggauaggguuguuuuauaacacuauaacaaggacauucacacaagauaaucucugauuuguaaaggaaaaaauaaaguaguucacaggaaaauagucaauuuuauggcucuuguguuuaaauagagggaagaaugucaaaauuccuauaaacuuaaaauuuaaaauaucuucagaaguugccacaacuuaaaaaaaacuugaauugcaccaaaaauaucuagaaaaauuuuaagcaguaaguauauucuuauaaacauccccauauuauuguaccuugucuucccccuugaccaagguuuuagacuaaauucaguugacaacagguaacauagcugauaaacugaagaucucugcuuggcauuugauaguucaucauuuacaugggcaaacaacccacauaaauucaaacacuaugauucaaacauacagauucaaacacuaugccaggaaugagcaucuacaguguaugcgguucaggaggguaaccaaucaccacacaucaucauuggguacuugauacaggguuagcccaaaucgggugcuguguuagauauguccuggauuucaaagacucagcacacacacacacaaaaaaguaacacaaaaaccucuuguuuuuauauugaccacauuuuaaaauuuauuagauauauuggguuggauaaacuauauuaaauuaauuaugccuguuucucuuuacuuaaauguaagaauuacuuuggugaccuacuuucuauuagacagugcugguaaagaacuuaaaaaaaaugguaugcuccaaguuaccacuaagaaaaauuuuuaaaaauacauuaaauuaccaauuacauuuuuuucucagaugaaacaugcauauguuaacacagaacauauucugacagaucugacagaaaacaugaaaaagugugcuuucuaucauaaugauuauuuuucagauaacaacagcuguuggccuguacaagcaagaagcuguuuuuccacauacuaccaaguauuagcauucaaucaugaaagaaaacuaauucuccaugggcucucuccacaugcuuuacaucagcagcaagcugugcacuccuauguaaucugaaaagccgaaccaaguuggggcugcuucuuggcucacugcuuugccacuucucucuaauauggcaaauacaaagcacucacauuuugcugauucagaaguaaaugaaacauucaagaccugcacaaaaacccugaccaaaaggaagucucagacaggugagcgccauuuuggcucuucuuuaguuacaaaggagauuaaaaguaaucagucucuugaaugccuaugaaaagagugguuaaaagucagcuguuaaagaauggcuuuauucuagaacacuugaacauagcccaaauuuuggaacuugaaaauaguuuaaaguucccuuauaaauuucaagaucucauuuaucacauuuugugcucaagaaucaccucagcugccaaaaucuaaauagaucugugcuauccaauaugguagccaccagccacacauggcuauuuaaauuaacaaaacuuuaguuaauaaaaauuggaaauucagguccucauuguccaugaccacauguggcuacuggcauaguagacagaacaguggagaacauuuccagcacugcagaaaguuccguuagacagcauugaauuagauaauaacauacaguaaguuagcaauucagaaaacuuaaagagagaagcaaauagggcagaggaaggcaugugacuagaaugcagacuaagacuauuuaaaaaaacucacugcaguugcauuaugucaaaguaagcaaaaaaaaaaaaaaaaguucuuugucaguuugaugaguguaucuguuaugcuugaagauguagacagagagaaaauaaaaucaguggacagaaauuucauuuauauauacugguuacguacuugccacgaccacacacaaacuacaacacagaccaaaauucauuacugaugaauuaugguuuugcuuuucuacaagacggagguaagcuuggcaacauuuauucuugggcuaaguucacaauugagacaacaauucuuuccuuaaugugauaaauuaugcugcucuacauuagggaaugcauacuuuuuuaucgaaagguaggaaaaaucgcaaggugugccuucucuauuuuuuuuuuccgcccacuaggaagacaugaaguucuaucagggaguuaaaacaguuaaauaaugguuaaaagccugcuucuggaaucugaaaaacucgguuucguggcuuuacuacuuucuagcuauguaagcauguguucugacugucuccucaucucuaaaauuuaaaugaaguaaugccugaauaauucuugguacacaccauuucuaauuaaagggaugcuuaaugaugcaaucauucuuccuuugcugcuaauuacuaauuuugaaauacauguuauguuuugucaugacacauacaaauaagcauaacuuaagugacaaaaccauaaaccuauggcaaaaauaccacagaccacucauaucccucagaggcuuucaugguggacaaguuagccgugcugucucguacaccccacugcacugaguugcuuugauaaacugaguuaugauccugggagagaguacugaaauaagacagacacacuaaaggcuucugggaaaccacaugacauacagguguaccugggguuuccauaaagcccagagauggcagagaaagacucuugggggacuggaaugucugaaaaucccauaaagaaaacaguuugcauuccuggucacuggguacaaucaaacucaggaaguacuuuguaugggcaccgaaguguauccuggaauacacagucacacauuacuaucaagccugggcauuuuuaccaguucgaaaaaucgaacacccaaguuuccauuuguaagguaauuuuucaaauaauguuucuuuucgaauuuuuuuucccauuuauguagagaccuugagagaagugucauaccugagaugcagcaggggacaggauggaaugcguuuucuagagaaucuuccauaaagggaagcauacauauauucugcaucacuaagauuaaucagaagaaauugcucaaauuccaccacauuccacuuuaagacuauagcuuucccauuaaucgcuacuagcccgaagaccuguccaaugcuauaacaguguaugauaaagcauauauaccugauuuuucacaaucaucuauaccacaaaaacucuauuccuguaaaucaucuaauuauuuagagauccuauuuauuuauuuacuuauuuauuugagacagggucucacuguggcgcccagacucgagugcagcggcaugaucuccaccaggccuuggcuucucaaaguucugugauuauaggcaugcgccaccaugucuaugucuggucccaguauuuuauuuacauccauaguauauaugucagauuguuucuuauaccuagaauugauagaaauccuuuaucacaugcugccuuccaaaaaagaguucaaaaagcaugguuaccacauaaagacuugcaguuacuagaccacuuagauguugccugagaaagauagagcacaugugguuuucugcaugguaugacauaucugaacagcaccagugaauacagaagaccauggcacauaauggugguacugugauggggaauaaacugccuauuuauuuauuagagcacauaaauuaccaacugauacgcaaaacaccaacugcaaauuaagccuucccucagaauuaaagagaaaagaggcuggggaauggaaagaaucagaugggccugccucaaaccucagcgcacuacuuaauagcugcaugaccucaguuuccuuaacccugaaauagacauaacaaggccuccuuuacagacuuaguguaaaggaggggacccacagaagauaccaucuggcauauaguuuguaaaacuuuacauuugcuauuucuguuauguauuuaugaauauacacauauaauuuuaugauaucuauugcuauaauauaugcaauauguaaguauguaugcacauaugcauauguguguuuauauauaaaaugagugauuuuugcucuuugaucuucaaauauuuucuuuggaugucaauuuuucuuuccuuuuuuuucuuucuugauuuggaucucaggauccaaaaguaaacuaacuuuccuaaaccucuucaguauuaaagagagauucauuuugagccagcacacuauauuucuaguccauaucugaauccauaucugaaacaaagaccacgucuaaaaguaauacucuuauuucuaauucucaccuaacacacccauggaagauaagaaaauuaacuuaccaggcagcaguaacuucuuggaauucuaugcucacacuuugcucagcacacauaggcguucuguugacaguuggcucucaacaccucaaguacgugucagagggacgcgagccgaucaguuuacccaagcuccuuacuuauucucauuuacccucuagaauuuuauuuccugccucagaaagaagaaucccaucugccagaaggaaauauuuguagccaacaugacaaaaguggaaucccuauuuuguaacagcugugaaucaaaacacuagugacugaaauuaacuacaucgugcuucggaacagaugugugcacagaaaccaacucaagcucugguguuccugggcaccauguguaaaucauccacagacaacacggugggccauguucucaccuuguugcuaugcacgcucauuuuuaauguucuccugaaccauugcagacuuugagauuuuuuuuuaaaggcuuagaaucuuuauuuccaaaagaggagauucugaaaguugccaaucacucacuggaagaccuaacuaaacagauggguuuugacaccucugguuugauuuuaaaugcaaacaugucaaauuaugcucuggcacagguucuucugccucaaaauuuuauggagggguguuuaauuuuuuuuaaguuuucuucucugaacucaguuguuccaccauuagcaauuaaggcaauaaaggacuuauuacagaaacagugauaugauugcuguauuuuaaugcagcagccuuaaguaauugaaaaucauuacuaaaaacuuuaggaaauaaauuucaagaacagacaucugcaaaugaaguugaagguaaggucacauuuuuauauaaauaggaagcgagaagaaaaacauauggcuuucuuuggugacucuucccauaaucaacauacauguauuaucuccuacaaccgaauuagaaguaagugguacauugccucugaucacuguucuugggagcccauggcagacaaugguaauccacugcagcccuuccaccauccaugcccuucagaugcaaaagacuugacuagcugcucugaacagauacaaaucaagggaggacuugaacuucagacaaguaacuauaugguuagaaagauuaaauauacacaaauguaaucacuugagaacauuuuaagcaacaugucagaauaugcaagacgaugggcugcaggauaauuaauuauugagaauauacaguugacccuugaacaacacagguuuuaacugugaguguccacuuauaugaggaggacuuuuuucuuuuuuugagacagagucucacucuguugcccaggcugcagugcaguggcgucaucuuggcucaccacaaccuuugccucccagguucaagugauucucuugccucagccuaccaaauaucugggaccaugccuggcuaauuuuuguauuuuuaguagagaugggguuucacuauguaggccaggcuggucucuaacuccugaccuugugaugcgcccaucucagccucccaaagugcuggauuacaggugugagccacugcacccggccuauaugagaauuuuuuuuaaaugaaacauggauuaauaguauagcauuggggaauaugauaccuccauauuuggauggcugacuuuugguaucugcagauccacagagccaaaugcgggacuugaguauucacggauuuuguuauacgaugaguauauccuugaguacacagaaggaugacugcguucucauuccaccguggggguguguuguuuugagcuggauauauccacacagcacuuuaguuuguaagguauaccuauauuaagccucaucguugcauguauuauuuuguaauaauauguugaauuuauaauuuuaaaggguuaaauaaccaguacaguuuaaaaauugaguaaauaaaaacugagaaauuaaaaucuguucaaauaagcacugcauuuaaaacccauagauacacaaacucuacagaagccuggagaaccaggcccacguggagacaaaggcaggauugaaugagaaaaauguguuucuaucacaaaucauaauuacuuguagaaaaucuuuuuacugcguucuaagcucuguugggauccaugccuugaagguaacacaccauugguugcuuuuuccugcucucccucuugauuuuuuuuuuaauagacugaagguaggaaaugcuauaugcuuaucucugagaagaugccucuauguagucucucugcuuuauaauuagcaacagucuuucccaaauucuacacuuagauugacuuccaacuuaacagauguuacagugaauuucuuuuuucuuuuugugucuucauggguauuuuagugcgagguaaccaaaggcuguguguaaggcuaccagggaaauauucgcaccgccugggucagaacccuguacguggcaugggucuuaguaaucuugcagaauuuuguuccuuaguucagccaaaacgagguucuugucacaugaccagcgaggauuagaaacguggacacauugaaggguaagggaauuggaauuuauugggugaaaaagaaaaaagaaaaaaaacucucagcaaagcaagaggggauccugcuaacaggccaucaccucacacauugaauuccaagccauacacaggaccugaagaugccaggcuccuccccacugcacaggaggugaacuuccccuggcuucacccuguucucccaauaaugugagggugggucagagauucuccaggacccuccuuuuaucugcauccugcaucuaucaguaaguaguuauugaauacacaauugcaugagcaauguuuaaggagcagagagagcucuuugcauagcauaucaggcagcugaucacucaauaggauuuaaaagucacugaauagacugcuagguuccauaguguggcagauauaacacagggucugagauucucauccuagguuuaugaauguuuuguguuuggacaccaaauucugauuuuaaaaagauuacugugauaaaaccuauuuaacauaaaauuuaccauuuuaauguuuaaauauacaguuugugucuuuaaauacauucacauuauugugaagcuuuuaauagauugaauauucuucucuucugaucaacagcaagaugauuuacauaauucuguaaaacuaugaguuggcccauucccucaaguaaagcaugaagacuuaaaagcaacauggaacacagaaagagaaaaaacuuugagcccaacaagauuuuggcuuugaaagagaaguaagauguuuaacuaagacucaauggaaggaaaaauauugucuggagauacugaaaguugagaauuauaaagagugauuacaaaugcagaagguaaaaguauuggagcaaaaauuggaaaucugcucacauuuacuggcuuuuuaagcaaguucuaucauagaggaucucucauccaaccuucccaaggaauuugucaucacucuaauccacagcuaauuuuggcacagaaauuauauuaguaaacucagccauauugucuucucacaugaagacaggacugauguccucuaaauaaaaaauuagagucuauagcgauuuguuuacaauaacaacugauaguuacaccccagggaucuucuuuuugcauauccugguuuuuaauaaugaauuauaccuucuauacauucuuucaaaauguaaaucaauauacuaaaaaaacuacagaauaagucaacauaaauugcccugugugagggugccuaguagaccaauacuaauauuuuggaggagauuucuacuuuguagaaucuacugagauucugaaagcugccugcaauucugcaaguguagggaaugggggaagagacagggcagaggaaugaagcaauggacuuaucuaaucaaaagccugauuaaaacacucccuagcagucucuaagauagaacuauagggaggcagcaggcaaucaaaaggaagagguccagcuauuuaaguauagcucauaucuauucacuccguuguuugauuagauuuuuaccuguaccaagucuauguagguaugaugaagaaaggugguguauuaaagaugaggaaaggugguguauuaaauauuccuaacaccacuuuccccagauaugcuacuaauaccaccccaaauuuuccacuacgcuuugccaucaugcccuuugaaaccuaauuaauaauguuucauuuuuaagaugauagucuaggcugcaauuuuaaauugguaagacuaauaucacuaucuauaguagaauaccucuuuccuccacccacauucugaugcacuguggauacaucuguccacaacaagagauuaaaccaucccuuucugucuuuacuucuccuuuaaaagcccuggacugucuuaauuuuugacagaaacuaacuucuuucccaacagugguggacuacuagaauuccaugaagcaugcuuuugguggcucauguuguaaaaaucauguaucacuuucucuugugaccugucaucaaaugugacauaauuuaaugcaacagcuccaauuuuaaggauggcauuuugcacuuugcuuucaaacucuaugacuacaguuauccaacagaagcuggccgaccucaguggaacagacggggaucuguuaacagguugccaacuuuaaauuacugcugaguagcuuagcauaucucuagaauaauuccuuuaaaaaguaauuaaucauuauuucaaaaaggucuucagugaaguguauuuucuauauuuuacugauggguagcauuugauuggaaacagcuaauacuucuccauucucugucuugcauuuacauuuuuacuguuuucaauauugcuguuuuuguuugaugacaacuagggacaacucagggagcagacugagaugcguccaacaaagagaauaugaauagcaaucuagaagagugaacauuaggcagcuaaugcauagaaauacuuguauuuuguaucuauuuucuccauauuucaacugaagauucuugccucauguuggaaacagauugagaaaagucacucgugucaguacuacagagaacacauuccaugagcccauaucuucagcaauguguuugcauccuagaaauuauuucagauuaugcucucucuugaggccauaaaaggcaaacacuggaggaggaacagugaggagaaacuacauaaauagcuacaggcuguauuuuagagacgccuccaaacuuguuagaagauaacguguugacuuuuaggguuugucaggaaaguuaauaaagcuagauuuauaaguaucuuucaagauuuuuuuuucuaauugaaaaauaagccacacgaaaacuguauucuaacacucuuuggaaacugguaucaaaucaguccaucacccacuucaaagaauuuuauuagccaagauaucauaaaagucuacauuuuaagauuuuuucuuuuuaucauaaaaaauuucaaagacauagaaugauauaaugaaucauuuauaccuccacuaucacucacaaaacuauuuaaaaacaaaucccagauguuacuuaaggcaaugucauuagcaaauuucccuuuguauaaacacuauaaauugcuuuaaaguaaacuuuaugaaaaucauaugcuuuauuuaagauuaggaacauccuaaucccuuuuccccauacuucacaaauuuuaaaucauuugugucauacugguaaugaacaaauuacuaaguguguacaacagagaugauauauguuguccuccuauuagggacauccaguacguguccaugacaaguauuccccuggaucuuacuacaggucccuguugaagcugggcagggccucacagugaguuccaacacagcacaccagguaacacuaacucaucaauuagagacagcaugagaacuacugaccuuccuggucuacagcuuacugucaaggaaucucauagccaggaauaagcuucuuuaccaauuccugcuauuguuaaauaccuacaaucacacuguucaacuaggaggagaacuaaguauucaugauggcuuggaccuauguggauacucuccuugcuuuucaagcucacagagaauggauaaauuauuagauuucagaaaaccaauuguagacuagaacgagaaccuagaaugaucuaccaaauccaguuugugacuaaaagauggcauuguuuccauugucaaaaucaugaaaguagacuaucgucucaagauagaaacaccaucuuuaccuuccauuauggaccuuuuaauaggaacacagugcuaaauuccuaaauuacaacaguuuauugaaucuugaaugacaucaguaguaagaccuaccauuauuuuaugcacuuuaagaaagaaaaugucuuuuugaaaacuaugacaugcuaucaauuauaagaaacaccugguuucacaguuacuaacauauuuguauauacacacagaugcauucuauuaauuuguauuuaagcuaacauuucuuacuugaagaugcauugguaauuuauugauaggaaaaucacuuccacaacuaaggauaguuuuucaccuuuguugcucugcaaagcuuggucuuaucuauucuuccuuuuaagauuucauuuccaccaucaaucccaagggcaacugguuuaacguaauagagaaaguccuggcuagggaagcagaguguguucccugccaacauuugcccaugucugcgcccaaauacacagugacuccuuagagaguccucacgcaauguccaucaauuaauauuuuuauuauuagagaggcuagugcucuuuacagcauuggaaaccuagaaauucuaccagcuuagccagcuuuugcuaccuauaagaguaguggaaaaauaacaacaugguaaggauaucuuucuguuuucacugaucugaagucacaagccuauaaaaccauucaauuauaaaugugaaaauaaauaaugcuaauaaugacagcucuugucaacuggacaugcccaaagcagacuggagccagauaugugcacugagggaaguggguggagccacagggaauuugcaccuuacccaggggaggagccugugcucuucagcucaucuguguggccuggaaucgaucuaugagaugaggaccuguuagcaggaaucccccacgcuuugcugagaguuuguuuucuuuuuuccuuuucgccaaauaaauuccauuccccucauccuucaaacugucuccaugccuaacuuuuccugguggugugacaagaacccaguuuuagcugaacuaaggaacaaagcucugcaacaguugcaacuaaauugcauuaaaacaagaugugcaagaugaguuuugagaccuacauccuuuuauuaaggcagaaaaauucaaguccauaaugaagucaauaugaaaaggaccugaauuuagguuucuguagcaauccauuuuauggauguugcuuucuuagaaauuuuauguuuuaaaauagauuuuuaaaauuuauuaccuuaaagauuuuuuccuguagaucauauggacacuuaauuucuucuaucaggcguaucaucuagaaauauaaugcuuacaugggaaauauauuaucuuaugauuugauaaaaaauagauggaguugcaaauauacuuuuaugauauucuugaauuuuuuuuuuccaaugcaaagauucccaaucugccuaccaacugaacuguuuuggucgugaaacauuaccuucucgguaugugguaugccuaucagcagaaaaguaguaaagaagaauagacuaacuuuaguuauuacauuugcauugucuacaaagccauuuacuuaauggaugagucucauuagcaguccaaccacaauauaaagaauacaaugauguguuucauagguucauuaaaauaauauuucaaaggagucauuagaauaaaagaagcugaaguuucaacagacaguaaguugucugcaaauaaaugagauggaaccaacauguuuucaaguaaguuaagagacauguuuacaaauacauuacagccauuaaaaaaggaagcaucaacuuagcaagugcuggggggacgauuacucaugcaauuuacuaaaacaaaacuguaacacucucacaucaauaguuauuguagaugcaaacgccuguagguacaggaaaaugugucuuaagaaggaaaauucauucuacagccccgagaugauucuccacuuggaagcaaaauugaaaacauucaauccugucuucagaucaccacugguuugggggggggggggguuuguuuuuuguuuuguuuuguuuuguacacacuuuuguguuauuugccccaaaccccaagcaugccuaucuuuucauuuuuuuuugagacaaagucucgcucuuguugcccaggcuggagugcaauagcacgaucuuggcucacugcaaccucccccuccuggguucaagcgauucuccugccucagccucccaaguagcugggauuacaggcgcccaccaccaugcccggcuaauuuuugcauuuuuacuaaagacgagguuucaccauguuggccaggcuggucucaaacuccucaccucaguugauccacccuccuuagccucccaaaguucugggauuacaggugugagccaccacaccuggccuacccuuucauuuuaaaaagaaauucaugguaaauuaguaacaugaauaauccuguaagggcaaaaaguauacugaaaaaaaaauugugucuauuuguaauuaucuaaccacaccuaagaauugacaaauguuuguuuaacaaaucaauggaugaauaaaugaaugaaaaaagcaauuacuuagcaaaggagaguuuuuagauuagguuguuaauuauugcugcuuuaucaauuuuuaaacccaguauuuccaccuguaagcaaaauaauaaacagcuuguauauauguucaauaauguugaaaucuuuucacaaauagcagugucaaauuuuuuuuaaccaagaucauagaguuuauauuaaaacuaaggauuuuauuuuuggguuuuuuuuucacaaagaaaauuaacauguagaacaaaauaaaaaccacuaaaggaauagagauugccauuuauuuauuaacuuuccuuuuuugaaagagcuuagauuuauaauucuaagaaauacaagguaagacacacacauguguaaguauaccugggacuuggcaauaagucacaggcaccuagaccacagcucuuguggcagagagcaaaaauggccccauguaauuugcaaugucuucccacucugcauccugacucaccuuuggaugcuuggcuuagccauguaacuugacuuggccaaugugauaucagcaaauggacuuggaaagagacuugaaaaggcuuuguguauuucucuuugugcucuuccuauuugccaucagcauuagaacaugccagggauagccugcuggcggauacaaaauauuuagagcggagcuaagucauucagccaagaacagccuagaucauugcccagccagcuaacccugacaugugauugaacuuagccaaccucagcacauuugccuaggugaccccagcugauuguagguauaagagaaauaaacauguguaguauggcacuacuugacauccaacagauucacauauaagcuuuguacuuugcaguaagauuauucuccaaauagaacaucagguugcauaaaaucaaaguaguacuggguuuuauuaaaguaacuaauaaaaaauuauucauuuucuauuuuuuaaaagagaaaagacaaaauuaaauuuguaugcacagucugaauuuugaagugcuggaagcuuacucaacaauacaucuacugcugaauucagcucacaagccaccaagugucaaccucuguucuagguacugagaagauuccaugauuucaagcuguuuacggauuuugugagaaggacagacacauagugcauuacauaaaagaaauuaaaacuauuaugucuuaaugcuuaccacguggacgaauauaaacaauuuggauuuccagauguuuucuggaaugcuugcuauuuugccuaaaagguaauaaucagaccaaucccuacaauuaaggaguuuacucucuauuuuuuaaauauauaauugauaagcaaacauauuccaaaagauucauuguaagucuaaguuuuucagaagguacuaaacuccaaaaauauacaagccuccaaagauaaacuguuuauuaauaaacguauauauaaggacuucagcaaacauagcuuccugagaaaaagcaauucaaagaucaauauuuccuuuuaaauuuuacacaacuuggacaaaauuuucuaaagaaaucacaauuuuaaaaauguuggaaagccaguuccauugcugaauucauaagguaacuuaccguaaaucauauaugauuaucauauuuauaacuaacaucacauagccccuuccagacugucaacuccaugaggguaaaaccuaguuauguugacaucuguuuucucaagcaguuagaauuuccugauucauucucuugucuaucuggcuggaacagcuaaaauuaaggcaguggagaucauuaguuugauaaaacaauagaagacaauugguauugguguaggagccacucaccagaaaugcuguaaguaaugacuagguucugcagaaauaaaauuaacagauuauuacaguacacacucccauaccuacaucaggagugaaaggaucaagcaccacaguuaaaauaauaaugucaguugcaacuggggaacugaggguccuggagacucccaacucagaugccugaagaagccagggcagguauaguaagcaagcagggaaaacuugguaauaguguacauguguacuuggcuucugaguagugggagauggcacugaacuggcaagcccauaucccaacuaaaaguggguuucagcuacuaaucucuaaccaauauuugccauguagaaggguagagcuccaaacucccaugauuuuauauauacauauuaaauggaaccacaaauagcaauuucuacauauuaucuccaaaauuguacguaacgucacaauuuuuaaaaccauuauguagaacaaauaagacacauguuuaagcauuugugcuuucccaaagaugaugucaccuuuguuccugguccaggaagcuaaaaacaaguaagaggugacuuccucccauuucuucucccuccuuccucccuguauuccaccaacagugcuacuuaaaguauggcuauggaauauugccacuccaaaaccuauuuuuuucuuuuuuggucuaagauaagcgugaugaacagguaaacuccaugauccagcccccuguauucaugcucuuguguguaaucuccucucuugagugugaacagugucagugauuugcuuccaaccaaaagaaaugcaaagaugauagaauguuacugcuaugauuauguuauguaaaacuccaucuugcuagcaaacucacucgagagucucucucccuuguuggcuuugaagaagcaaacugucaugaauccuacagccacaaagaaacgaagucugucaacaaccugagggagcuuggaaguagaucccuucccagucaagcagcugaugagaccacagccccagccaaaagcuauauugcagccugguaggacacugaagcaaaaaaaagccauuaacccaugucugaacuucugacucacaugaacuaugagauaauaaagguguguuaucuuagcaccacuaaauuuggaguaauuuguuauauagcgacagcaaacuaauacaaggggccuaccccuuaauguuaauuaacuguaucacuaggcacauuguuuaguuugacugauauuuauuuuuuguaauaguacuuucucaaugaaggaagcaauacauugaauuacacucagacgcaagccaccucaucucacagcagcccaauaccuugaguucuacaguugaugggcauaguggaaagagaggucugguguaacuuuauaugcagaaaaugagaaaggcacauuuucuuccuuugacuuauaauuuugucuaaugauauaugcaacagagguagucaagagcagggucagggaaauggagacuauggugaaggaguuauuaccuguaauacuucuaaguugcaucauaaaaauuugcuaucacuacagauaaaagcaaaggaugagcuaacugauaauaccuguaaaaugcugcaaacaccaccaugauguggugaggaaagcaagauaaacauuccuauagaauccuccuauuacuacuugcccuggggccuugugaaaaucuagagaaucuaauagucuaguacucagcucgcaaggaaaccagucagucaucuuugucauucucugcucauaucuuauuuccuaacacaacaaaaucacuuauagacccaugcagaaaccaugcccuuccuucucaguccuagaccuggcuaaccccugugcccucuaaagauuuaauuagcuagcucuuacccugaagaagccuucuuugauaaguuuguuccuccuuauagcuugcuaacauccugugcaaucuccaucauuucacuucuugcccuguaucguaauuagcucuuccggugacugucuuauccacuggaguaauuaauugcuacuuaagauaagaaaccauggcucucauuuuuguauuuccagcacugaggagcaugccuugcucauagaaggcccucaauaaauacuaagugcagagaaaauaagugaguuauuuuacuagaggcugcauaagagccaagagaagcaacuuaauuaugaggcaacaauaagcuuggaugaugcagacaaaaauaugcuaggagauuuuaagcacucagucugucaguggugagccuaaaacagguuccuuuaaagguaaaagauucauacaaaacaauacgaaacuaagaauuguacaacucaacacauguuaaaauugaaagaaauaucacagguacucacuauacccagaugucaaauucuuucauaucuugcuucaagcagcauguguauauuaacucauauuuaauacaaaaagcuaugcuuuuucuaaaagcauuucuuuuuuaaaauuuuuuuuuaagagauggagucuuacucugucauucaggcuaaaguacaguggugcaaugacagcuuaccgcagccuucaacuccuagguucaugugauccuccggccucaggcuacugaguagcugagauugcaguuguccaccaccacagucagguaauuuuuuaaaauuuuuauucauacuuuuagaggaagggucuugcuauguugccuaggcugaucucaaacuccuagcuucaagugauccucccaaccucagccucacaggucacuggguuuacaggcucaaugcaccauaccugaccuaaaagcauuucuuaucagaguccuacuuacccaguuuugucaggugccaggaaauaggggagcucuuaccuaggagcucccucuggucagaguggccucgcauucucagugugggggauucaguccuacauuuauaccucccuuggagaucaauuccuuaaagcaaaacagguggcucacuggauggcauucacuuucaguugaucaauugauuuguuuggagaucaguucuuaacauuuauuucaacaguuuaacaagauaaauuugaaaucauuuuuccuaaaaaaauuucaaggugaucuuaauauuauuuuaccaacuucaacuaugaccccuucuucagacuuaaccuaauuccuucugaaagccaaaaauucagacccauuuaccaugaagcugaauccuccacugcuucucuaacuaccucuuccaucggcccuaaaacauuaaaaaaaguggggugcugcuucucuuuuucuguaagaugcccaggccugguugguaaaaguuuaacugcuuaggugauuauuaugcacuauacaaaguauacuacauaucaagugcucugcccaguagagggucuacuaaaaaggcuuaagagugaaaacugccaaagggaauuucuuaccuucccucagggcacacagaaccugaaccucaguaccagguguucccuacaucuccuucugcuggugagucuaaaccugaauuacucuucuuugucuaaucaauuuagacaacaaauuaagcaugaauacugcuuggcauaguagccuuaaucaaacaaaaaagugagauuuuuuauuuuuuuaaacaucuaugcaaacauagagcuuuuguuagaaaaaguuacaaauuaauaacauuaaauaaagccaacucuuuagaaaugauacagaauagccaauucccagaaguauuugaguggcugaaaaacaaaucuguaaaaaagucaaucucaagcaaaaaucaaguuaaaaugagacagacacacuuucaaaauugcaguaauuuuuaaaaauuuauaagaaguguguaaagaaguugacauucauacaguccuguucagcugauagcuuuuuuagagagaaauuugguaauaugaccccaaaaccuuaacaaauuuuauauauuuauccuaucuauucuacuucuuagaacucuaaggaaacaagaagagauggccagagacuuauguaguaggauuuuucuaucacgaugaugggcuggagaauccaaaugucucacgauaaaaaaguggcaauauaaaaaaugguaugugauacaauagacuccuaugcuauaauuaauuuuuaugacauaugacaugcuuguaacauauuaaaugaaaaauggcaccaaaauuguuuaaaauacaauuauuuuauuuuuaaagcauacauaaacucauaguaaaaaaguaugcacauuaauaguauuagucauuaccugugaaaggcagacugauuagugacuuacuuuauuauuccuauccuuauuuuaaacuuuuccaacccauauauguggcccaucagauuuguaaaaaugaaaauccaaggcauaggauuugaaggcauacauuccuauacccugcuaaaaacagacucaguuuaguaucuccuuagguucugauauaagaugauucucgaaaaagccccaagccaacccagucugaagaaacagauacagaguaguuaucagaacaagaauucaaugccaguuaagucaccuuucccaaauuuaauucuaauaauaaguccguguuaaaaagcaaagguucaaauauuuuaguguuauugagaggauuagcucacugcugagagugaauauaaaaaacaauucuauaucaaagccaacuaauucaaucuuauuuuuaaaugucaccaaauauggcuucucucaaaguacgccgguccaauugguaauaucugauggcugauucugcuuaacucuacuaaauauaaaccauuaucuuagggaaucaguaguauacuuuauucuuguuauucuuuaguauuuuguuagggaucauaaaauuggacuugacuuugaggacaggacuggcuaagccagggcaguuaguccuauggaccuuuucacuccgggagucugugacuacuuauccuuaaacauuuccaguaaauuuauguuuuaguuaucaaucaguuaucuguaaacuagaacuuuaaagaauccuaaaacauaaaucuuuuuaauccucaaugauuuagacucucuacauuuuuaaauaauucagucaaacaaaagaaggguaaauuagucauuuugugugucagauaaaacacacaugcauacacagaauaaauguuuuuuguucucaaaggauuuuguuguaaccuccacucgucauguaacacuggaacaaaauaguuaggcuaauuacccaaaauuaaguuccacuucucgauuuacaagcuuuccauuuuauucuagcaauucuuagcugucauggacucagaaaauuauuacugccaucaauuggaagauuguuuuagugguacagauggcuguccuuuuauaggccaacuuaaugacuucuucuuaucuaaucugucaucuguuauuuaguugucauuaugaacuuuuuggguugcauaucaauccauuuuccauguuuacuaaacagauggcuuuauuugagaaaaaaaaaagcaaagcaagaaaaugacauugcaugauuaaaaaauuucaaaaggcugcauacaauuuuuaauguuccuaaaugaaaugaaaaauugcuauuaaaaaaacuaaauuugaagucaaagugaaauagauuuuaaaacucaauggacaugcaaagaaacaaucagcagcagcuaucuacaaauagaacaaauuacuuccaaaacagcaauagguuauucuuccaguuuuugucacaaauuuuuuuuuaaauuuaucuugacaaauagaugacaaaugucaacgaaguaacucuucaauucagaagcucuuuauguuguaauucacagguguaccuccuuugucuaguauuuguaaccuuauuuagagaguagguaaugacauaaauacuuccauuuagugaaaauuguuccuuaucuuugucuccuuaugaugauuuuguuuaaucacugggucauuaucaaaucaacacccaaacucaagaagcguaagggaaauuguaaagggcuuguaucaaugaguucagagauccaaaaauaauaacuggcacugugccaugaaagaacacuguaguucacacuguaccagagaaagaacuugacaauuauuagaaacuaaaauacauaaucaugaaauaauuuuauguuacauuuaugagugguauuuaaaauuguguuuguucaggaaggauauuuaccaagucuugggauuugcuguaucagccuauaacaacgcugcaaaaguaaccgagcagagccuucugaaacaguuucccaugccauacuaagcacauccuccauuguagaacagauugaguucaacugugguuuuuuuacuugcccaaguucaaggcuccugagcacaacaaaaccaacaaugaggaagagcaugaucgcauaauuuuuuauguucuucagacaauguaggagaacuuaaaauggacagccaauuuuucaaaaaggacaaauuauuugaaggauuucuuuucuuauaugauaaccacaguaaaauguaagacuaguguagguaauuguccugccacuccauucuaagcugugagugaaaguacuccaucagcuuaaugagaacaccgugaaauauaaaacaucuauuucaauacaaguuauugagaagcuuuaacaggcuuucgggagaagcuaccaaaagaaaaccgaauaccagauacuugauuugagacugacaaaaaucuucuauucuuuccuacggaaaauuaaacaaaaugggcuauuauauagcaggaagacagagacaaaaaaaaaaaaaaaaaaaaaaaaaaacggaagaaagaguaaauuguaugaaucagaaacuuggaauaauaauucuaccucaaauacuucucuuaggucuucugcucacaucuuucaggcagagaacaucuauuugaugccaaauguguggcuagaacugggccaggugcuuuacaugucauagaucaauaccaaacaacuagugaaaucagcacaaauucaaccaaugaagcucuuaaaacaauaaggugaaaaaccacauuguugaggagagccauacaauacagucagguucuaguucaaauuacguuucuuuccuugagaucuucugguccaugauauguuuugaucugucuaaaauauuauguaggcauucucaagugauuaagaaacuccggauuguuucaaauaaucaggucuuccccaggcaaacacuggagaucacuuguuuuuuguuuguuuguuuguuucugagauggaguuuuucugugucgcgcaggcugguaugcaguggcauaaucuuggcucacugcaaccucugccuuccagguucaagcucaagcgauucuccugccucggccucuugaguagcugggauuacaggcacccauucuugaguagcugggauuacaggcacccaucaccacaccuggcuaauuuuuuguauuuuuaguagagacaggguuucgcuauguuggucagacuggucucaaacucccaacuucaggugauccaccugccucagccucccaaagugcuggaauuacaggcaugagccaccacgcccggcccaauaucacuuucaaugggucccaacacauuaaaugaugauuucuugacaaaguuuuacacacuacuuaaggaucaauugacaucaacccuaacucaaagccaggaagcuuaauccaacaugaaaauauucuguggauguuguacuuaggcauauuauucucuguaguauauacuuucauauugauacacauauuuaacauauugcaaagcauauuuuaaaagcauugaucuauguucuacugguaauuuucacaacgcuuaaucacauggccaucauagucuuugcauaagacuaccuuguuguucaagaaugguuuuagcauuccauccuucuccaucauacuggcucagaggugagaacugaccuucucccaguagauaaaagacucucauaauuguauuauguacagcagcaucagcaucaccugggaacauguuagaaguucgaacuauagaccuccaacccaaaccucuggaaucaaaacucaggagauaggccuuagcaauuuguguuuuauuauauccuccagcugucuggagaaccacauaaguuuugagaaagaaggcaaugcaccuuaucauucuucaaggcaaaguucacuucacuuagcuugguauucuucacugcaccuagcacccucaacauaacaagcacuuaauacauauuugugacauaaaauagauuaaaauauucuaaagacagaacucauuuuagagaacaauccuuuccagccacuauuuggagauuuugauacuagagauguauuuggcugagaaguuuccuuuccuuaaccuauugcuagguucugugaacuugccaugaauugaaaccaaggauggacuacagucagaaugaaggaagaugaggaagaaaaaagcaaagaagaaaacaaaaccacucuauuccuucugaauuuggcacaaagaucucagguguuccuuauauucuuaagacguaaaucacaaugaauuaugaucauugagcaaauauuacugugagccuaggucaaaaagcuaaggucauaguguucugacauaaacaaaaucagcuuuauuucagaaagagcauagugaaaggcuaauaaacauugcuaaguaaagaaggggcugauaacacagauacaacaugguaggucuauacuuucuagugcuuauccauuucucugccagccccugcauuuauggcacaucaaucaaaagucuugguuuuggagccaggugaacuggguuauaaucuggcucaggucuucacuaguuguaggucuuuggggaaauuauucuucuccuuucugacugucuucaucuauaaaauggaguaauaaugguaacuaacucauagaauugauggaagauuuauauuaaauaauguguguuguaaaugcucaauaaaugguagauuguuuuucuuugucuauaggagguguugagggcuuguagucuacuuguucaagcaacaggacauaaaacaaaagcucauuaagucagaugugguaucccaucagcacuugcccagcacugagaauacagcagguauuccagaagugugagccaaaucacaugcauuauaccacaguacaaagaaaccuuccccaagagucaugguugagaauuacacagcagagauuuuccacaucacagaacagaguagacuggcuugacuucaugauauuuggauacaaaacugagaaaauuagauuuccaaaauauauuauuacuugaauaugaaaauaucuuuuuuuuuuuuuuuuuuuuuugagauggagccucgcucuaucgccaagcuggaguacaguggugugaucuuggcucaaugcaaccuccgccuccuggguucaagcgauucuccugccucagccucccaaguagcugagauuacaggugugugccaccauguccagcuaauuuuuguauuuucaguagagacaggguuucaccauguuggccaggauggucucaaucucuugaccucgugauccacccgccuuggccgcccaaagugcugggauuacaggcgugagccacugugcccggccugaauaucaaaauaucuuuuucgaauucugugacagcccaugaccccuucaccagagcaagccaaacaccacuuguuuucgccaaagagacaggagcaaaagguucugguauuuaucaucugggcuuuaucuuuuucuggauagauuaugaaauuccaguguauuccagacagguccauuuucauggaaccaaccacugucuucccuaaaagcauaacagcaucacaggcaaaggucccaagauaauagaauuuuauauaucaggcuggcuuucuaagagaagucaauaaaauccaacaaugaugggaaaugcaggauguagcagagauccuuaaaagcaauuagcagagagcagggaugaaaagcaauuaugcaaacacuagaacacuaggacauucaagacuuuuuuuuuuuuuuucuuuuuuuuuuuuucauucuguaaggaaaggacagaucccugcuuuggaaaaagaauacaaaugugcagguuugaaaguuccccauuaggugcaucuaccauuucuauuauauucaaauacuaagcuuuuuaggacuuauauuaaacuccauaaucuuaauauuuaugaccacaacuuaacaauuaaucaaacuauuaaacacuaaaagagucaaaggcugaguauggguggggcaagaaaauuuuuuuuuuugagauggagucucacucugaaacaaucuugaaaagccuccagaagguacaaauuugcuggcacuauaaaagacaaaggcaacuuaaggagguucaaggaaaaaggaaaauaaugcuaagaaagagaaaacaugagagaaggcacuggggccaauaaugcacagaguucagauacuaaauagugaagugauccauucagccuagaagaauguuaugguagaauggaaaaaugcaagucuuugacucugagagcccuggguuuuaauucugucuuucugugaccuuggguaaggcauauaacuucacugagauucacucugagcacccacaaaaugagggcaacaauagcuauccuaugaaauagguaacuaauaaauagcagcaauauuuaauaggcaugcaaauucuuuucucuucccuucaccaagucauaauaaaccuguucuuuaauucaaaaucaauauggccaaagccaaauucacaacaucuucucacaagcuucccuucucaaacagccugucuuaucaaucgagccaccaugucuccacugacccaggcuuggaaugucugacugauagcugccucaacuucaccuucaaaacaaaugucugcucaaguuauaucccuccaacacgauucauuuugaccucuuuaucccuguuuugucaaccacaacccaaaucuaagucugaauuauugaaaaagccuuccguccgacccaugugauuccuacuuuucuccccacaaauucauauaccucccacugcuuagcuuaucuauuucgaauacugguguaauacauccuggugauggcucccuguuuccuacuacucagugauauauucauccguucauccaauaaacaguuacuggauauccaccaaauaccaaguacugggcuauguauuggaggugcaaaaaugagcaagucaugccuuugaaaguccaguggggagaaguaaacagauagauuauaauacaaugcuauaaagaagagaugaaacuagaaauucgcuuuauagguugaacgagacaaaaucucagaucagagauggugcuguauuggaacagcaucucaagagaggagagguguuugucaggcaaaaaaauggaaaagggcacuauucuuuuucaaaggcacguacacaaaaaaauccuguguuuuauaaguaaaagacacccccaccaacuguagaggagguugaauggauuucuugcagcagugaguguguaaaugagugacuagcuaggaugcaagacuccccuccuuugaccaagcaaguaaacaaaggauggauucuucauagaagaugcaauggcaacaggugacaaguuucuuugggcaacuacugagucaguuauguagguaaagggguagagauucaagaaucaaacaaacaaaagacaacaaaagcaauacaauauuucagacacagaaccccacuggccagagagagagacagauuuuaccccucaaugacagugaacacagaacuuagaccauuugaaauaaaaguucuuaccauaucucuccugacucguacaaacaccaaagggcaauaguaaaggaggauaaaucuuuuugagggaagugagcuguacuaucucauaucucacgggaauccauucaugagaaagucaaauccagaagucuguuccacuucagcucucauuuacaaaaaaaguuuucuccuuccuuucuuaaaucaagugacacaagucaacucaagaugugcagcaucacaucgucacucaaccaaacugugcacacaucuucugccaugggugucaccaaucuuaaaucucaguguuuaauacugagauuuaaaaaaaaauaauuuuauugugugcauuugaaguuuauagcaugauguuauagaauauauauagauagugaaaugguuacuaagugaaccaaauuaacauaucaucucacaugguuauuucuuguguaugacaagagcagcuaaagucuacuuccuuaaaaaaaucccuaauacaauacaauuuuauuaacuccaguccucacauuauacauuuuagaucuuuaaacuuaguaauccuauauaucugcugguugauauugagauacaauacuuagaagcuaaaagcuuaucaaacaugaaggcuuuucuguucggauuuuuuuuuggagaggguuaacaaaauguguuguuuuaauuucauuuucagaacaaauuaauuuaucucaccacacuuuuuguuucuagcaagcaugacaccacuagguaugagcugugugcuuauuguggauaaggacaguguguuaguuaccucuuuaucccaucacagugucugccacuuaagcauucagcaaauuaaaucaucaacaugagaaacaugagauacauuuuuaucauguacaugagauacauguccuguauuuuuaucaccuacgugaacagagcugaacaccucaccuauucaauaguaacuccaauuuuauuaacuuucccuugacucauuuucuucaucaauaaaacguggaucagauugccuuccuuauagaguuauagugagggauaaacaggguacaguauacaaaaagucaaaugagucuucaauaaacggcagacaaaucccaaacaaaaagaggggcaaaaaggcccgugucagagaaaucagaaguuaaaucaccauaacaaugaccauaagcagcagagaacuucagaagguauccccagccuuuuggaaauguccuuuaauuucuucauguuggguaaaucuagcaauugaaaaggaaagacgcuguuaaguucaaauguggauguucauuauaggagcugaaugagagacagguaaaaguuuccagggaagaaaaaggcaguaugcaacaaagaguuggguaucaaaaaauaaaaauaaaaagaggugcagaaaacaagcuccuuuucuucucuaaauucguggugcuccuauccaggucggcaaccccacaucaguccuuaccauugcucuacccaguuuguguccccacugaaucacuccccagcuccaagugacgugugugugugccuaugaaguuuuaaggaaaaauuaccuauaauuuugcuugaucuuugugaaucucuguagcaacacggaaaacugcuuaacuuuucaaaacaaaucuaaucaccuuaucauucuuuuauuucaaguaauggcuacaauguauugagcacauaacuaagcacuguaugccagacacuguauuaauugcuuuauauggaucucauuuauucccacaacucugacuuguauacugccgcuaucccuguuuuacaggugaguaaaccuggagauguggagugguuacaucauuuuuccaagguuauacagcuagaaaauaagugguagcuagaacuugagcccacugaauuuuaauggugucacuguaaagccucugcgcuguguaucuccuguccccaucacuccccacucugcuccacugugcucuguaccccaggagucuggccuccgugaacuccaacaagcuucccuggccccccuggccccccuggcuucagugaguuugugugauagacuccaggcaggagaugagaaggagggaagaacaguucaggauauuuauuccucuugguccuuccuggaaggucaccucagucuagcuuccucaaaggacggucaccauccucuaaaggcaggcucuucuccacacuucuguccuuugagguucccacaacugcuaccuccccuugucccuaggucaagggguggucacagcucugccguuacucaucccaguaacucaugcagucacuauaacaucaucugugguuucccugcacccagcccacaacuuuguaaacagucccauuguaaauauacucuuuaauauaugcugauuugaauguaccaucuggucccucuuggaacucugauacagccuuucuaauaaugccuuuggucuaggaauaacaaaauaauuguucuccagucauuccaugcuuuucuacaccucuguguguguguacuccaugcugcuuucaagugaaaugcucuucaccacuuuuucugcuggaaaauucuaacuccuccuuuauaacuuaugaaggcaguuauuuuauucaaaccuccuuugacccccuccuugccaugggcaaaauaaugggcuuuuucuaucauacucuguaagcaccuacaacuuagacaauacauuauacuguauacaugugagacuggcaaaaucucagcaugcaccacuguaccugguaugcaguagguaaaacaaaugaucacugaaggcuugaaugaauauauugcuguuacauauauucuuuauucuguucuacccaggaaauuaaugucacaggcauuccauugagcaacacagaaggcuauauguguacaugcugguucauucuaugugccaauuugacugagcuaagagaugcccagauaacugauaaacauuauuucuguguguaucagugaggguguuuccagaagagaauagcauuugaauuggugaacugaguacaacagauauccuuuccuaauauggaugggcaucauuuaaucaacugaagggcugaaagaacaaaaagguagaggaagggaaaauucacucucucugcuugagcugaaacauucaccuucuccugcuuuuggacacuggcacuccugguucuuggaccuugggccuaauuagauuaaaucauaccauaggcuuucuugguuauccagcuuucagagaauagaucaugagacuucucggccuccuuaaguacaugaaacaauuucauauauauguuuguauguauguaucuaucugaauauauauauauauauucuauugguucuguucucucucauauauuauuacauauaaacagaacauuauauauauaauacuaagaccuauauauacaguauauauuauauauguauuuaauacuauauuauauauaauacuaagaccacuaaaauugggaucuuucuggaaaaucaaaauucaacauaaauuuauuauuucuuuguaaaaaugcauauggaggagagggaaggcaaguuaaccagauauacuuugaauguaagguuacauguucccuuuaaucacuugauuuacugaaaaaauacaugcuuaaaccuuugaaaaaggaaaguuguuuuucaguaguucauuauauacucacugaguuuuaaauucuaucacaauucacguuuuaaaauagaucuuaacaccacacauauuuacauuaaaauaguaacugagucauacuuaccuaaauagccuaaugacucauuaaaacaacuuucuuuucuguuaagucauauuucuuccuucauaauucaguucucauaacucauuaguuauuuccaaagaaggauguaucacagucauagaccacuucuguucuuagaacuuaggaagccaucucuuucagaucaaaauaucuaaaauuucuaugaaaauuuucaaugauuuaacaucaguguuacgucuuaagauuuauuauuaagacaugguuucucagaaagucaacuccuggucuaguguuuuuaaaugauuugacucugaauguucaguaacuuuaguuagcucucaauugauuucauuauggaacauuuuucuuccucucaugaaaauacguaacaacaaaauauaccugauuaacaaacagcuugauccaugcagcauguaacauucauagaugcuaaugccucuuugaagcauacuuaguauuuagaaaucauuuugccuucauugaaugaccaaacaacugguguucaaaauaaaauauaugccugacuauaauaauauggcaaguacauauuugucaguaauggguauugcuuugcaugauuuauuuuuguuuucagaaaaugaguccucgagaaauccuacaaaucacuuuccuugcauagaacugaauuuugguaaaaggaaaaaggcgcuauguucagucccuccgccuuuuugagauggagucucacucugucacccaggcuggagugcaguggugcaaucucagcucaaugcaaccucugccuccuggguucaagcgauucuccugccucagccucaugaguaguagagauaggguuucaccauguuggccaggcugcucucaaacuccugaccucaagggauccgccugccuuggccucccaaagugcugggauuauaggcaugaggcacagugcccagccugcuaaccccuuuucacaugccaucucauuugacccuugcuauguuuugaauauccccuccaaaauucauacugaaauuuaauuacaggaggugggaccucuaacagugauuagguuauggugcucuacccucaugaauggauuaaugcuguuaccacuuaucaugggaguauguuagugauguugggaauggcuauguuauaaaagcaagcuuucucucacauucucuugcccuucugccguccgcuccccugccaugagauuaaccucaccagaugcugacaucauggucuuggacuuugcagcuuccagaaucaugagcuguauaaaucucuuuucuuuauaaauuacccagacugugguauuguuuuacaacagcagaaaauggacuaagacaauccuauagacagcaacccuaccaaagucagaaaggcuaagggacuagcugaggcucugauuccuaaucccauguccuucccauuaaaucauuuugucaacuuauauagguugaggcuauaccuaugcuaagugaaaauauccaucugauagauucaacuugagauucuacuuugccccauuauauuuguucucugaggagagugaagaagaagaaaaggagagguuuuuguguuaggccauuaucaaugagacucaucaauacucaacuaaucuauaaaaugagcucaaccuuccccuaagaauacuaaauacucauagauaaugggcuggcccuuugauuuuaauucucagaggaucaguguuuuuaauguuuuaucauuaguuccuuucaauuaagucagguaauaaugcugccuggacauucaaacccaaaugaauggcuucaauuaucccagggucuauuucucaaucaggagccaaggcccugggaccaaauagcuaacacuccucaaaguaccucuagauuauuuucugaaaagaauucaaagauuauuacauuuuagugaauuuucuagagaaugcacuguuuuuauuaaacgggaguuuuugcuaauuuugcuccuuucuaaagauguuggaaagucuaagaaaacucuuacucaaaaacgaggaagugggaaaaucucaaacuaaacccucucagauuauguucuuacucaaaauacauuugauguauuugaaacacuugaugccuuuaugaacaaauuugccuugauuuauuaugcaaagucauaauuagcuauuuuaauucauuaacugcuuguuuuuaaaaaauauccaauuuuuaaaaacaacaaagcaaaaguuacaugguaugaccuauagagguuuuacaguggaugaauuuuaacaaauguauacacacauacaaagcucuaaucaaguuaucgaauauuucuaccacucuaggaaguucuccagugcucaccugcagucaagcuccaccacuuucauggaaacugcuguucugauuucuaucaccaaaaauaaguucugccuguucuuuaaaucaauauaaaguauguacacuuugguguugaacuucuuucaacuauuuagagaaguccaccaugcacuuacagguauuagaaauuuuucuucuuauaggugaaguaucuuuuauuccaugaaaugaaaauccaacauuuuaucuaugcuuuugauggacuaucggauuauuuccaguuuagaaucuuuacaaguaaagugacuaugaacauuuguguagcaaaacuucuguggauacauacuuuccuuuuguagggguaaauaccaggaaauggaacuguaaaaucauaaaacauaucuuuuuaaaaaaaaaaaaaaaaagaaacugaggaacuguuuuccaaagugauuguaccauuucauacucccacuagcuauguuuaugcauuucuguuauuccaucaucuuauucacuggauguuuuaauuuuagcucuucaaguggaucuacagugguaucucauuccuguuuugaaugugcacuuucaugauaaauaaugauauugaacaccuuuuaauggacuuauuggcauuugaaaaaacauauauauaaauauauuuauuucuuugggcacucuguugaaauauuucaccuuuuauguugccuuaaauuggguuauuaugaagcauuuuagaaauauauauacauauauacacacacauauguucugcauacaugucuuuugucagauauauauauuucaaguauuuuccuccagucuguagcuugccuuuuuauuuucucaacugggucuuuugauaaucagaagguuuuuauuuuaaugaaguucaauuuauuaacuuauuuuuucuuuuauagcuagugcuuuuugugugcucuuuaagaaaucucugccugagacuguaagauauuuuuucucuaauuuguuauagaacuucuacaguuuuugcauuuauauuuaaguguguaauacaucucaaaauaguucuuuuucuuagucuuuuuuuuccuguuuagauaauuucuauugauauggcucaaaguucacugaccuuuuagcaugcagagacuaguuggcuguuaacuccauucaguauauuucaaucauggcacuuuucuuuucucuuuguuuuuuuuuccugagaccgcucacucugucacccaggcuggagggcaguggcauguucagaacucacugcagugucagccucccaggcucaagcaauccucccaccucagccuccugaguagcucaaaucacaggugugcaccaacacgccuugcuaauuuuuuuauuuuuuguagagggggucucucaccauguugcccaggcuggucuugaauucuaggaucaaacaauccucccaccucagccucacacagugcuggaauuagaggcaugagccaccacacccagccauggcacuuuuugauccuagaauuucuauuugauuuuuauagcaguuuuuagguaagauucuucaucuguucuugaacagcauccauguuuuccuuuaaguucuuuaacaauauuauuauagcuaugguaacucuaauaucuuggucaucuuccaucuguuuccagugacugcuuguuuucuucauuaguugucuucuucacuuguauaauaauuaugaaugauauaucccaaggugucuggauuaucuuuucuucccuuaacauauugaguauuuuuguggcaguuaaauuauuggcagauucucuugauccuuucacgcuugcuuuuauacucuguuagagugggccuauuugguuuuauucuucauuuuagauugugauucuccuaagguaggucuccuucuauagccccaacugagcuucuaggcuguuaagcaagaccuucuacacuggcugcgacaggacuccaauaucucucagcauugugugaccuucagugccucuguuaagcauucaguucugcagaaggcacccucuacugugucuuacagagucccacucugugaauauacagccuagccacuggccaauggcacacaaggaacccucauuaaaccaauacaaagacaaguucaacaguauuuuacagaaaaucuuuuaagccaaagagaaaaacagucaugauuaacuauguuggcaauaauuuuaagguacauaaaaaaagauauuuguaacauaucuguauuauccuaauagacaaaaguauccgcuauaggaguacaugauucgcugccuauguccgagagcuuugaaucucaauuccucacaccuggugccauuuuacucauaauauguaaaaggaagagcugcuagaaaaacuuacgucaccuguguuaaguuuauagauauacacuugaauuaacaauauuuuuggccaagauucauaaauacacuuuauguuuuaugaagcccaauucaguuagaacuugaggucaagcaaagaaaucaaguguaagagcugacauaaaaacagguuuccuuuucaauacacuuucagcuaucuuagaaauuaacuguucggaguguuuuucuauucauacuccagaaccucucgcccaauaaaauuaucuccucccagggcuuucacuagugucaauucacuaaagaugcccgugucaacauuucaaggucgcgccuccucaagaguuuaaauauucaucuagauauccaccuugaauucaaaaaccccacaacagaauuccuucucuuguucccgcaaaaaucuguaccucuuccugaaucugcauucuggcugcacuauguaccuagucaccgagagguggacuuauaccccucuucucuuucacccuuucaucugucugaugcaucacuaagccccaagagcuuccuccuuuaauuauaucugaaguuugucccucuguuuccaucucugcucuaaugcaauuuuuuaaaaaucacucacucuauucccacagccuucaaacuggucucuucccuccuauccauucacaacacagcuucuaagugcucuucuuaaaauacucauuugauaacauaguuuccuguuuuaaaauguacuaaguauucccacacaucucuagaaaaaaguucacauugcuuuugugccucucacugccuuuuaauucgcuucucuaauaauuuacauccuaguugcccagcuacaccaaaccaguugaaauugcuuggacgugucauaugguuucagaaccuaagccguuugcacaaggcaaaccauccacaugcucauccuugggucucagaucaaacaugaacaccugagacagaagacucugguuuuucugaccgcuguguuguuccaaucuguuuauuuuacuggacucuauuugaaaugauccauuuguccucuauuagacuguaaauucccuauguggagggagcauaacaaauauaucuuuauucuccugugucuagcacaaugcuucaccauauuugcaauaaaucaguguaaauguaauugggauauccaccaccuuaaauauucaucuuuuuuaugcuacaaccauuuuaauuauuaaauauuuucuucuagcuuuuuuuuuuaagagauggggucugggcuggagugcaguggcuauucacaggcgacaucauaacucacggcaaacuugaacuccuggguucaagugauccuccugccucugccucccaaguagcugagaauacaagcucaugccacugaaccuggcucucaaguagucgguuuuuaacuaaaaauauuuacagguuacuacaaggcucuucuuuuuauuuuucaaucuuacuggaaugaaaagcaauaacuucuaacauuagaguuaucauucugcucuaugauguaacuuagaaaauauaauaaaacugcaaaucuauuuccaaagcacauuuaaaaaauacccccagauagcugagcauucauaaauugauuuuauggucauuugcaaagguagcaggacauuggggaaguaaagagagagagcaaugauugauuauuugagaaguuaaccucauuuuagcagauuuuugugggguuuuuuuuuuuuuuuuagcucaaaauguuuaucuaacagauaaaucaaauggagcuuucuguacauaccucauuacaauucuaauuuauuuucccaacagaaucuucacaauuauguaaaaauuggcacgguccugcuagugacacuuccuauucuuucauaccauaaagccugagcuuauaaacaagcugcagagagaggcauuuucauuacauacaucacugcauuguggcgguaucuccagaauggcuuaaaugcaucauguacuuuuacccaaauggucucugaacaagaguguuggaagagaugucaguucuugggcccugacaauguuguuuccuagccuaaaaagucugagaaauguggaauauuccuaccuccuucugugagaagucagaaaaugaagagacguauucaucuuuaagccaaccuuccaaauuuaccugagcauagagcaccaccccuucaccaccacccucuuuucuuuccuuuggaaauucuuauuaacauucuauaggacaucauuggaagguuaaucugauuguggcacauccauaauuuggcuauuuagaacauuauguuuaaaaacagaguuaaugucaugagucugucugcuuaucucuaucucauuguauuuuccgcuuaucuuccugguuucuuuuucuuccugaaucuccaacacaugcccacacuuggauuuuaaauuauugguccaagacaaaaagagucaugaguacaaguucgggccgaucuacuucaaugaacaaacaaucgaaagcucuuuacuuccugauggcaaaaauauauaaaauuagugacaucuacuucaguaugcauuaaccucuuuuuaaaaagcugccuccuuuaucuuccauucucaauuugcuuuaggaugucuuuuauuucuuccuuaucuauggcuccuacuuucucacagacuuuuuuuuuaaaauguauuuggaggcugauaugaucaguguacuuccucugaaauuaaaguuucuuuugauauugaguucaguauauucagaguggaaaucaaaugacuuaggcugguuacaaagauuuaaguuaauagagaugaauuuaauccacuggugguguguucauaaucaaaugaaggacucauuucuguucuagagccuaccaaauaaaaaugucaaaauaauuggauuaaaaucauaugaaauuuauuuauuuauucaacaaauauuaaauguuuuuaugugccagacaauauugggugauggacauacugauguuaacacugagacccuaccuugccuucaacagccucuaguuuagcagagaaggcacacauuaauucuguauuugugugugccaugaucugauuguaauugugauaaaugucaugggagagaugauagggcugauacagcccaguccuuggguggggaggcuggguaaggauagggucagagaaggaugaccugagaaagugacguugaagcuaagauauaaagaauuugaaaauggcuugguaaaguucuagauaaaugaaacagcaucaaaugcgaagguugccacauuugagaugagagcaggucagugugguugcaguacagagagcaaggcacgauagugugagacuaggcagagaauaagcagagccaccaucauaggagcucagaggccaucuuaggacaucagaacuuucuguuaaaaacaaugggaagccaagaaagguuuuuaaagcaggaaauggacaugaucagguugaguguauaagccgucucccuagcucaguggagaaagcagacucaucuuggugguaguagggagaccagcaauuguccccaaaauguccagucacuacuggcaaaagcaccccuaaaaaacauacaauugaggaaugcaaggugcaacuucauuagaagccccucggcuuacaacgucuaucuaaccagaaugccauucuuaaaucgcuccuauuccuauuucaaacuucugguucaaacagcucuaguagccauggaagaaaagauuaaaggcagaaagacugguagcagaaaagccaauaaggagguuuuagccuaggcacuugguucuggugguucaggaaguagagaaaagucaauuaaaacaagcuacacagaaggcggaaucucuaguauguggugaaucugguuauugcaauuacuacauguaucuuuuuaaaaaaguaaugguuuugguuccucuugaaauuuacaugacacuggaauauccucauuucucugaauuauuuuucuuacauauaacacauauaugacauuugaccuugucagaugcuuaaaacagaagaauuaagccaagaaauauuucuaucaaucucaagucuuuuaggaaccuaacuaaaggagaauuaauaguuuaauuauaaacaauucuuuccugaucauuuuaaaagacccacugagaaugugugccaggcaaaauagucuaguuuuaguuacuuuuugcaaccuaaaguaagaagucucuauuuuuuuaaacaauauuugaugacuuagggugauccagaauuaauuuccuccgcugcuaaugcaauucuguaaguuuuuacucaauucuacucugcaucauuaaacaggacuaaaagcuuuacauuuagggaagcauaucacuuggaaaaaaaacacguuaaugugaauuauaacaacaaacuuuggagacuaaaggcaugacuaguaggaucuuccaccccagauuuuuuauaugcuaagaaaaugaagaaagaagcacacacacauacuagauuaccuacaacacggccucuuaggcaaagcauugacauuuauguagaaggacuucaagcguggagcuagagaauaugcauauucaaguaauaauuugauuuuaaaaccugugcagcccgaagucaagaucaaauugcauacucaauuuuuccaccaacauuuagaauauuuucucaacguugagacgugauaauaguuguguggcuguguguuuuuuaaaaagucuauuaaguagaagagacugcuaaucacugaaccagcccuugcaguuuucuuugcugcucuacagucaguuaacaggauauuacaaaauaaauuaagaauaagaaacaggccaaguuaaugcacaugauaaagaguugagucagggaagguuucugcaauauuuggagccugaaaggagagacucuaaggguagcagugguguaugauaaugagaagagggagagaaaaaugguaaaauacuuuaugcucuucaagaaucauuccuuuugcuccuuuugaaaaaaaaaaaacaaaaacaaaaaacaaaaaaaacacuuucacgguagcaauuuuuaaaugcuuuucaauaauugugagugccagauucaugauucuguauaggaacaucuuaauguaacauccuuaaguagaaacccaguagaacuugguuuuguaucauuacaucaauauugaaaguauagccugggugugguggcucacaccuguaauccuagcacuuuggaaggcugaggugggaggaucaccugaguucaggaguucgagacuacccugggcaacaaggaaaaaccccaucucuacuuuaaaaaaaaaaaaaaaaauuagccagauguggugguguacaccaguaaccccagcuauucaggaggcugaggcacaagaaucucuugaacccaagaggcagagguugcagugagcagagaucacgccacugcacuccagccugggugacacggugagugagacucugucucaaaaaauauauauugaaaguauaaauacuacuauaccauuuuaaaguacacauacauagaggaguagcaauaccauucugugaagacaacugguuaguuguaguuacuuucauauucuggagcugucuucugccuggacuauucuccccucaaucacaaauuuucacugggucagugccugcucagauaucauaucuaggcuuaaucaacuguucuguagaaagaccuucccagauccuauagaugcaaugcugucaaacagagcucucuacaacgauaaaaauguuccagauguguguugcccaauaugguagucaugagccacaugugaccacugagcaccugaaauaugguagugugccugaggaagugaacauuuaauuuuauuccuuuuuaauuaauucaaauuuaaauuaaauuuaaauagcuacacgugguuagugguuuccaugcagaagcagaagaagacagcuccuguucuucuauuucauucauauucuguguguccccuuguaggacuuggcauauuugcaguuacauaguguuuaaaauuauuuguuuaauguccaucuuucccacuaaauuauugagauuuuaaguagaguaacuaggucugucuugaucccacaaaagcccaugcuugacaccacaagcccccaugcuugacacauagugucuauucaaagagcugcugacuuaccauuuaaauaaagcuuuuaauuaucuuaaacauauaauaucagauauuaauaaguugguuaagugaauaccaaagguucauguuagaagacuggaauacuguuuacaaggugugaacuuucuggaaaaguccagaaaaugccaccagaaauuauaaaaaucagugguaaaaugugguugccacagauuuuucauaaacacaaacauacauacacacacacauucucaaaacacagcugccuucagcaaaagagucuucuauuuugcucuaaaaucuguugugguugugaaaaugaugacacuucucugcaaaagaaaaauuucaaugcaaaacaaacucacaauuuagcucaggauguaugaaaaaguugacacaaagaagcuguccuuuccugguuuaaaugacacauuuuaucuuuagauuuugguagcuaauuuuuaaaaaaauccuuuaaaacguauuaccuuuuccagggacaaaugcucuauaauguuauucucugccaucuuugaaaaugaaauaaacauuuauuaaaauaauaccauacacgacauagauauuuuuaauacccccauuggaaaugguggcauagagaaguggacaguguguauaaagcuacgaauuccagagaacacugguuauaauucagugggaaauacaguuaguuugucauuguuuggcugauuuguucauccauccauuuaucucucucuccauauguaauguuuauccuuucuuacuuuacuaaaauaauaucuuucaucaugaaacucacaguaugcuaggaaaguugaaaaaauacacaggugacugaaauauaagccccuaaagaaagcuguguucaggagaggcauagaguucauccuuggaggagccauuuauaugaaaacaguucuguuuacaugcaacagagaaagccauuaagcuuuuuuuuuuuuuuuuaauggaguuuugcucugucccaggccggagugcaguggugcgaucucggcgaugccucagccuccugaauagcugggacuacaggcacgcaccaacacgcccagcuaauuuuuguuuuaguagagacgggguuucaccauauuggccaggauggucucaaucucuugaccuugugauccucccgccucagccucccaaagugcugggauuacaggccugauccaccaugcccagccaagaauucuuuuuuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucgugauccacccgccucggccucccaaagugcugggauuacaggcgugagccaccgcgcccggcccagccaagaauucuuaagaaaauauccuagugagagccuuucuuuuuaauccugaaaugcaucugauugaggacacaggguuuagggagggggcacaaaggaaaacugaacaguacauauguguugcauaaauucauggacuaaugauuaggacaauuaaugaaugguuuaaauauguuagacgaaagcucauuuuguaauguucugaaacacaugaagcaaugugagagacuauuauuuuguuuguuuguuuguuuguuuuuugagacagagucucacccugucucccaggcuggagugcaguggcgcgaucacggcucacugcgagcuccaccuccuggguucacgccauuuucccgccucagccucccgaguagcugggacuacagacgccugccacuaugcccggcuaauuuuuuguauuuuuaguagagacgggguuucaccauucacaggaugaucucgaucuccugaccucgugauccgcccgccucagccucccgagacuauucuuaaaaacgcccauaguuuccacacaaacaggcugauuaugaagagugacagaaaagccaacaauuguaacguuugccuaaauuuucuucagguauguuccugguuuuucaggaggcacucugccuugcagauagagcuuacaaaccaagaccaucaggguacauguggcacuuucauuuuucuucucagaguagaucuagagacauuuaaauuaaucauuuggagguugaaauaccaauuccuugguauuucaaagauaaugugccaaguccuauuaucauuuagcaauaauuuaaggaaaggaaguaucuuucaaaaguacagaacaaccuacacagauuuaacaugucaaacuaauaugauaaaauuauuuugcuacuaugguaauuucaagaugggugugacauuuugcuuuuuugucuucuaaaaaaugaaaaaugucuuugaaucuuguuagcaaugccugaccuucagacacacuggccaugccagggaugcagaguucacagugauuacuccuacauguaccugggcccaaaggccaagccuaggagguucauuucauuaucauaaaguaaggugaaaaaagaucaaacguggauucaaaaaaaauaaagcacuaacaaggaggagaauauagcccguugcaagcacuacaaucaaguaggugguacacauccccaguccuugaagaauugcucaugugcccugucuaaaacugguuuuguagacucugacuuuugucuuugguugcacaaugaugaagaaucaauuuuaucccagaccagugaaaaugagagcacauuacuacuaugaggagaaccgcuaaagguuaauuggguuuuagauacuuagcccuaauuguucaagauuuuaucauaauaucaauuucugcauuaaugcaaggcacccugaggccauaugaaauagauuucauucuaaauuuaaauacauccuuccauccaaaaagagaagcauucuucccagauaauucccacaaucagaauccaacuuccuagaugaaauaggucaaauuaaccaaaccucccccaaaauauugcuuucagucagugaugacugacauaauuaucuaguuaauccuaauacuuagauacuuaauguagauaaucugaaacauuaauuaaauaugaaaauacguuacaugauuuuuccugggaacuauauuuuaguaacacuaacacuucuguuuaagaaguuagagauaguuuucuuuccauaacuggaacauugaguacuguugguucaacaggaacaaguuugguaugccauuuauuucgguauucagagcaggucauuaccaaaaugaaaauuaccuuaaguauuguuaagccauuagggcacaguuuuguauaaucagacaacaucuuaauagauacuccuauuuauugucacaauaaaccaucuguuaaguuuuagagauccauuuuugaaaaaaggagauaccuaguuuucagaacaccugguauaggaaacucuuaauuuacaaaauaaaugaaauugagggagacugaugugcguugcaaaagaauaccuagguugaagaaaaaacaaaacaccuaccuaaauauucuuugaccaguaguaucucuagggcuucuguguuucaauuuacaauuuuguuuaacauauaaccuuuaagguauucaaaaacaacagcaucaauaauaauagcuaaaauuuagacaggagguuaugugauccauucacuauucuagaaacuuuacauuuauuaucucacuuaagccucacagcaauccuaaaagguaagugcugauauaguuuggauguuugucccuuucaaauuucauauuaaaaugugauccccaaaguuggagguggggccugguaggagguuuuaggucauggggguagaucuguaaugaauagcuuggagcccuccccaugguaaugaguggguucucacuguuaguucacacaagaggcuggcuguuuaaagaagcuugucccuugucacucucacugccucuugccaugggaucucccagcuccccuuuugccuucugccaugauacuaaguuuccucuggccucugcagaagcugaacagauguuggugccaugcuuguacacccugcagaaccaugaaccaaacaaaccucuuuucauuauaaauuaccuaguuucagauauuccuuuauagcaacauaauuggucuaacacagucagugucguuauuuucauuuuacagcgaggauacugagacucacaguaacuucugaagguuguacaaccuuaugggaaaaagaggguacagauuuuaaaagcaauggauuaaaaugaguacugcugugaauaucuacaugucuccguacacguccaaguuuaguugucucacugcaugaguauuuuccaucuuuucagaccuauauuaaaaaugcaagccaaauaucgauuauuaucauuaccaguuucuaacaccccugagcauuuugacccgguaaggcaaagaugaauauuucuuagaccauuuuauccaucauagguuauucuaccagugaauagcugucugauaucuuggucucaacaugacuagaggcuuuacaagcauuuauaaaucccaguaauaguacaucuucuugaguggcugccugguuccacuaugcgaacaucauggcaaccgcguaacaaaaaagccacacagaguguuccuaguacuuacugauaugaccaagaccuuguagccuuugaaacuccaugauuuuuaacauaaccaaaaaguucaugaauaagagcuuggugcuucaugucacauauaaaugauuuuauauuacccauauauuguauucccgcgauuagccccaaagaugccuccccaauuuagcagaaguauauugcuuaggagggaacauacaaacaaaacaggcugggcacgguggcucacaccuguaaucccagcacuuugggaggcugaggugggcagaucaccugaggucaggaguuugagaccagccucgccagcauguugaaacccuaucucuacuaaaaauacaaaaguuagcugggcaugguggugggcaccuguaaucccagcuacauggggggcuaaggcaggagaauugcuugaaccugggaaguggagauugcaaugagccgagaccgugccauugcacuccagccugggcaacaagagcaaaacuccaucucaaaaaaaaaaagaaaagaaaagaaaagaaaagaucauuagacauaaaacaacaaaaaaaagcacauauaaagcuguucuauugcucagauaauauuucaaagaacaggaaagagaacauauuuaaaaguauauaucugcauugacugccaaucucucuuucgauaguagagaugacuauguuugauauuaagcuucuguaaaucaggcuuuccuacuuuaacuuucuaguaucaacugguauauacaaucauuacucuuucuuuccuuuuuuguuuuuuuucuccuauccucuacauggauagacuagaggcuuaauagugugaugauaauggcucuguaacucuguaacucuggguauggcguguucagaacacccacaguaaacaaucccaaauccaaacaugugucucagaaaaugugucucaaaggccuagugcugugcuguccaauaugguaggugguaacuacaaguagguauuuacauuaaaauuaaauaaauuaaaaauuccauuccuuagccacauuucaaguguucaguagccacauauggcuuaauagcuacuauacuagcacaaauaugguuccauuggacaguggcuagccuagaguaacauuuucuaacuuaccaccuugaccaggguuuaaaucaagaccagccaauggauugugccucacauguacaccuacuuaauuuuaauuggcauccuggaguagaaaaaaaguacaguguuuggaauagacaucucuugcggacauagaauugcggaguggugcccacauacaccaaacauggcucauaagaacuugcauuagcagcaguauaaaacuacaaaauacuaaaaaugcaacaagagugccacaucucauaaauuacacgugucuuuccacgugccauuucaaaauaagccaugagcgaaguguuuuucuucaggcauacagaguuaaauaaaguccugaauacgauccguaaucacaaucugggucuaaucugagacaauucaucuucuuauucauuaaaccagaaaacuuguaugaauugguaauacaaguaacaccgauaauuuuuuuaaauguccauuuuaccuacaugugaaccugauacucugaaaaucacuguugauucuugucaaguaaacaacuaugccacugauaaagcuccauucuugaguccauauuauucccugauagaacccaauaaucuaaucagagguuuuuuuacccccacuuaggaauuguuuuuuggauacugugacuccaauagggcuuucauuaacuaaaaagaacuguauacaacauaucaaaugcagcaucuggucuagucugaauuucuaaaugacaagcacagcaugcauuuggaauuacauagagaacgagaaaucagaccucuaucauuagcaaucuuuuuccccaaacacugcuuccacuucaugcuucaacaccuuuaccuuccacagaccucuugguaaugucacgacuagcuugucaaaucaaauucagcagcacacaagcaucuguauuaauacuuuugcauuuucauucacuaggaaaaaacaaacucuacuuaguaggcagauuagccauuaucuacuguaacucuaaaccaucugaguuacauuacuaaaaugaauuggcauugaaaacagagcgacagaaauguuuaccgauagaaaaauauguagggaaugggaguuucuuuugcgcuuacuugccagugacuuccuaaagcuguaaugaggucaaaauaagcugguuuauuucaucugugaccacugggugagaucucauuuuauaauggccuuaauaauuugccacuuaugauuacgauaauaacaauauuuuuuaaaaucacuggaaacuuuaauuagguauuuccaaaucgcuagggguuauuaaccaagggucaauuuugcucccccaacccccacccagaaauauuuggcaaugucuacugauauuuuugguucucauaauuggaggugagagugcuacuggcaucuaguggguacagaacagggauucugcuaaauauacuucaaugcacuggaaaacuuccugcaacaaagaauuaucccacccaaaaugucaacaacgccaaggugaaaaaaccaugcccuaaagcuacauaugaucacuaucauuuaaaugauuauuccaggacuucuauggacaugagcuacugaaaaaaaaaaaucauuuugucuuucacagaugucaagcuuaaccaaguccaugugaccauuuagagaguuaggagguacaucuacuauaaaaauagcauuuuucaacagaggcuauuuuguuauuuguuucauccuuauucauccugucucucuaaacaacagcaaaauuuuuaacccaucaucaaccuuuaaauacuguugggucaaguucucacugucaaaaaagacauauuaauugcaaaaaagcaaaaacaugaccaucuuuacagugcuaaaucacuucuggaaaauguuuaugucaaaaaucagcuuaaauuuuuggagauaggacaggcgcagguggcccaugccuguaaucccagcacuuugggaggccgagguggguggaucacgaggucaggagaucaagaccaucuuggccaucauggugaaaccccgucgcuacuaaaauacaaaaaauuagacgaguguggugcugcgugccuauaaucccagcuacuugggaggcugaggcaggggaaucacuugaacccgggaggcaaagguuguggugagcugagaucacaccacugcacuccagccuggugacagaccaagacuccgucuuaaaaaaaaaaaaaaaaauuggagauaauuuuuaauagagacuauuacuaaucuaauaauaacuuccauaauaucuuaaguuucacaacagagaugaugauauaaaguagaauuaaguggcagccuaauuauuaaugauguucuuugccuuugagauaauccaguuauacacuuuaaagguuugguaucuuuagccccaugcgaggagagagucguauguuuuucuuucucucacacacacuccaggaaaggaaaagcaagcacaguaguuaaccccugauaguuuauuagucauucuugcuuugucgcuuuauuaccacgaaacuggucagucauggacauaaacaaaacgugcaaggauaaggcaggcuuucacucacauaaaaacugccaagggccaaccccauugugaaucacuacagaaaaucauuacaaaaucuuaaaacaacaacaacaacaacaaaaacccagcacuuugaaucauaguaucucuucaacagauacacuacaaaacuuuaucagaaacacuaugugagagaugaacagagcuaggagguauuuucacauuaguaaaaaaaaaaaaaaaaaaaucucagaaaucauuuauauaaaaaccuauugugagaagucuaaauuuacguucaaugccuucccuuucuuucgcucuauacaguuuuaaaauauguucauuuuguucuaacugcacaguaauaggcauggccuucuaagcagaaaaaauauauuauggcaaggaaaaaugaagagauacguugcuaacacaacagacuuuuguuaaacaauuaagaggaaaaaaaugcauacaauauagcauuugcuauauaaccauaaccucucccauuccuggugucccacucugaauucuacuugauucaacaacuuaagaugcaauggaaauaauaaugucuauuccagcagauuaaaaaauacaaggcagcaguaaauguuaugaccaccagcuaaugggcuaugguggagaagcauccacuguggauuaagcucucaaguacucaauaacuuuuaaaaaugccuuaaaucacccacaaaaugcaguauacauggcuuuguguauacaacuguuaaguguacaaauauacaucaggugcaggaaaucaaaagcagccuuugugaaaacuuaguuuuauaguacuuauuacuacaaacuagacauaaaggugcugaauaaaauaauuaagaaaaaggaaauagcaacuuugaacaaucuuauaaaucauuuuauauaaguuaguuauccuuagaguauguauacuauaauucugaguuaaauauuuauauaauacaauuuuuguaacugaaacaggaucucacuuugucauccagucuagagugcaguugcacgaucauggccuacugcagccuugaucucccaggcucaaaggauccuccugccucaucuaccugaguagcugggaauaaaggcaugcaccgccauacccagugaauuuuuuuuucugguagagauggugucuuacuacauugccuagacuggucuugaacuccugaacucaauggauccuccugccucagccuccccaaaugcuggaaugacauaugugagccacugugccugguccauauaagauuuuagaguauuacucuaagagauuaacccuacccuggggaaucgaugucaaaaguugggaauaucuuuccuaggugaaauaauagaaauaacgaacucuuuagagcugacuauguagcaggugcuucugagugccauacccaggguaacugauccauggguuacauuagaggaaauugaagcauaaggcaaguaaguaacuuggccagagcugcagagcaaccauguggcagaaccaagauuucaagauuugagccccggcagugugguuccauagacgcuacucacuggucucuucugccucuggaagacucucuccuucccugccuucuugucaccccuccucccacccacugacuaccacuguacagcgagggucuuaagccagagauccuaugagccgcaaccaccaucugugagcugcacauuuuuugaggaauuaccuuuccggcagcacauuugagggauucaaggacuuagaacaacaugaaacaauucaacaauaaugacaaggcaaugacuaucgaagugcagcuucaccucacaauaucuauaaaaacauccaugguuauugcaccauccacuuguuccucuuccuguacucuugucauuguuucaauagaaaccgcugacuacccugacugcucucauauauacccagaggacaagguuugagcaucuucugguaaacagcaaucuuucuucaugcuggcaugaccucacacuccacuucuugccucuucucuaaacaauuucuucuguuguauacacuacuauaaucauagcacacaugggucaaaaucacuagucuaaucucaguacucuaccugcaaaagagcaguaccuaacaaagaaaccaaccuacacucucauuugugaagggccuacugugugugcguuccagacgauaugugguaggugcugaccacuuuacaugcaucaacugaccuuuaaacagaacuauguccacuauagcguaaacacaaugagggcucagaguggacaagcaacuggugguccacaauuccauagccuguuaggguuaaagcugggauucuaaucuggucugcucuugaaaguccccacuugguaauauuucucuuucucugccuuugccuaaggaaauucuauuuauucuuuuuuuuuuuuggagugcaacagcgcuaucucagcucacugcaaccucuacuucccagguucaagcgauucuccugccucagccuccugaguagcugggauuacaggugccugccaccacaccuagcuaauuuuuuuguauuuuuaguuagagacaggguuucacaaugucagcuaggcuggucuggaacucccgaccucaagugauccacccaccuuggccucccaaagugcugggauuacaggugugagccaccgugcccagccaacuuauucuuuaaugucucccacacuaaucugcauucucccugcaggcagggaccaugcuuuguucaccucuguuucuauuauacuuccuaaggaauggacacuuaaaacuucccgaacugaucaaaauaaaugugagaggacagugccuagcaucuaacaggcuccuuggugguugcggucuaaguggacauguacaggugggauuacucgaauucuaagaauggcuggauuuaacacaagucaaaagcauuuggaaacaauaaucaucauccugaauucccaauucucuccccccucaccuuucugccucugcucuaccccuucuucuccaacccuaugucucagucugucuguuucuccacucucuugacuucucucucugucccucucacaccauuauugucaccacaggccuuugaagcgacuauacccucaaacacaccauacuuaucuuccacaaucacaucugaaauauuuuggcuauaguuugcuuaugguuuguuuggccuugcugagucucauguugaaaucugaucccuaauguuggaguuaaggcucgaugacagguguuugggucccaggggcggaucccacagagaugguuuggugcuauucucaaaggagugagcccucccucuuaguuccuucagaacuggugguuaaaaggagccugacaccucccacccuucucugucuugccaugugaucugcacauaccaguucuccuuccccuccugccaugagcagaagcuuccugaggcccuaccagaagcagauauuguugcuaugcuucuuguacagcuugcagaacaaugagccgaauaaaccccuuucuuauaaauuaccuagucucagguauucuuuuacagcacacaaauggacuaagacaauuucuaaccacaucugagauaaaauuaacccccuaaauaagcacacaaaugguauugauaugaugaauaacucaccucaaauguacuucagauagccuucugcacaaggcacgucucuugaguuaacaaacccuagccaggcaugguggcucaugcccauaaucccagcacuuugggaagcugaggcaggcagacugcuugaguccaggaguacgagaccugucugggcaacauggaaaaaccccaucucuacagaaaaaauacaacaauuagcagggccugguggucacaugccuguagacccagcuacucaggagacugaggugacaggaucauaagcccaggagguggagguugcaaugagcagcgaucaugccacuacacuccagccugggugauagagacccaaucuccaaacaaaacgaaaccaccacacaagaccuaaaccugauauccagaucugagaagacagaaaauauuuucaaaucucucacauauauaugcauucauacauugcuacuuacuuuccucuuuguguguuacugaugucuucaaguaaucacacagcucucugcacaugccagcucuuguguuccaaguuuccaugcagcaucucauggaauugccucaacaacuccagggcuagggacuacugucaucuguaucuaacagacaaggaggcugugguacagagggcucguaaaguuagcacaguggagaaggcagguugcuacucagacauccauuccuagagcccacauucuuagaacacacagccugucugucccuccagcaccacccugccuacuuuuagucauccuggugucgucuggcuguaaguuccugagaauuacccuaguugcuaauguacuggaauggcaucuuccuuauuaaaggcacucaauuuagcaaugcauuugcauucccugauugguuuuccauauaagugguucacaaaauauggucccucugcaccacuugggagugucuuagaaauguguauucucaggcuuuaucccagacuuguuauguuagaaacucuggagcaagggccuaccugccugugauuucauaagcccuccagguaauucugaugcaugcugaagugugaggcuuacuacccugcaugauauuuauggcaaguuuuagguaacggugccuuugaacacuaacuuucagaaauagaagauagaaaaugugcaguaaggcaucuugcuucaguaacacccaagggcacauucugucuacaguuccucacucugucaucuguccucacacguaggcuuucugcuuauacacuccaaauuacaacuaccuaacagcuucuaaaaugagugucuggcuuggaagauuuuuaaaugcuaucagagaaugucuguuucaggauuuaacuuguccagugcaaagaagugaggcugggccacaagugacccaucacuucaccuguaagagcaaauuaauuaccccucaacauaaguguuauauuuaugugccaaguauggucgauaaugaggucuuuaccguguagccauauuucaagccauuguucacuuaaguaaacacauuuuaaucacugucauuuuauuauuuauucuugagucuacuauacaccugucagaacauuuuguguuugacuaacugucaucuccuuguaucuuuccugcaucauauauaaaccacuguccaccuccacauuuuucccucuuacugaagucaagcacuacacaaguucauggggacuuagaggcaagugugacggcugaccaccccaauaguuugcaaagccuuucaucugcuccucugaaaacgcuuuucacacauuccuuccauauaucucucugcugcaaucucucuguugcaaaacuguuguugaugaagugacauuuaucuaagcauugucacuuugaauaauaccaaagaaagaaaaugaaaaucaauguaauugcaagcuaucaaccucaaauuuuauucacuuguuuuaaauuugucaaaugaaaauaauuuguuuaucugaguaacaauauauggguaucaguauauggauaacaauuuuuaaagcuugauuucaaauuuggauuuuuaauauuaaaaagaugaaaaauuuuuaguccaauuuucccuagagaacucuaacaauagucauguacuguauaacauuucaauaaugacagauuacauagaugacaguggucccuuaagauuguaauggagcuaaaaaaaaaaaaaaaaaaaaaaaaaaaaaaaacccguacccucuaguauuuauuacaagguacuuuuaacgauuauuuuagagucuacuucuucuauuuauaaaagagaaauaaaaauguaaaacggccucaggcaaguccuucaggaguugcuccagaagaaggcguuguuaucacagaagaugacaguuccaugccuguuacugucccuaaagaccuuccagugggacaagauguggagguggaagacagugauauugaugauccugaccuggcgcacgccuaggcuaauguguguguuugugucuuagucuauaacaaaaaacuuuaaaaagaaaaaaaacaaaaucuaauauuuaaaaauaaaaaaauacacuaaagauauaaagauagaaaauauuuguacauagcuguacaauguguuuuaagcuaaauguuauuacaagagugucagaaagcuaaaaaaaaaauuuaaguuuauaaaguaaaaaagcuacaauaagcugggcacaguggcucaugccuguaaucccagcaauuugggaggcugaaucgggaggaucacuugaggccaggaguuugagaccagccuggccaacauggugaaaccuuguguguauguguguacuacaaauauaaaaauuagccagguguggugggacaugccuguggucccagcuucucaugaggcugaaggacgagaauugcuugaacccaggaggaagagguugcagugagcugagaucacaccacugcacuccagccugggcgacagagugagaccgucugacaaaacaaaacaaaaaacaaacaaacaaacaaacaaaaacaaaaaagaacaagcuauaauaagcugagauuauugaagaaagaaaaauauguuuaaaauuuauuuuuguuuauuuauuuucuuuuuuagagacaaggucuugcccugcaagcccaggcuggucuuaagcucccagccucaagcaauccuccuucuucaucaauguuuuuaaacaaauuuagcauagccuaaguguaucauguuuauaaagucuacagaggcauacaguaauaucuuagcccuucacaugcacucaucacuuauguacugacucauccugagcaacuuccagucuaagcuccauccaugguaagugcccuguacaggucuaccauuuuuuacuucuuauacuguauuuuaacuguaccuuuucuacguuuagauacacaaauacuuaccauuguguuacagcugcauauaauauucaguacaauaacaugcugugcagguauguauagccuacaugugcaguagguuacacccaucuagauuuguguaaguaacuaugauguucauacaaugaugaaaucaccuaaggacacacuuagcacaauauauccccuucaucaagcgauggaugacuguauucauaaaaaucuggauauugaggggcugccugauaaugcauuauuauauguauuaaaaugugucuugagccaaaugcuaauuaacucuuggcuggugccuuuccuuaauguuucuuucuucuuuuuuucuuuuuuuaauucugauuacucuuugggacaaaaagguggugcugaaacaagauaucauuuaugaucaacucaauacagagauuacuuaauauuuaucacauuaugcagaggcuucaauaaguucaucaaaauauauguuccaaaauccuaugcauagauuucaaacuuuucuuccaucaaaauaaauucauacuaacuuguuguaacaugucugaguaggaucuaguuugaggcacuaagaagauuaagacaucaguuugaaaagaucccguaucagagcaacaugaauaacaugaauucugcuaauguugaggcaagaacaugcaucaaauuuauggcgaagcuuggauggaagaaugguaaagucgcugaugcuuuacaagaagcuuaugggggcaaugcccaaaauaaaccagcaauuuacaaauggauaauucauuauaagaauaaaugacaccaugucgaauaugaagccuacaguggcagaccaucaacaucaauuuccaaggaaaaaauucaccuuguucaugcuuuaacugaagaggaagaaggacugaugauuaacagcagaaacaggcaacaucguagacaucucaacugguucaucuugcaccauucugacugaaaaacuaaagcugaacauacuuuccacucagugggugccaaaacuguugcacacagaucagcugcagacaagagcuuucuacugaaauuuuaaccaagugagauuaauguccugaagcauuccucagaagaauuauaacaggagauggaaccugguuuuacccgcaugauccugaagauaaagcauaauuauagcaguggcuaccaagagguggaaauggguggggcccaguaaaaccaaagguggacuggucacaaguaaaagucauggaaacaguuuuuugguaugcucaagacauuuugcuuguugacuuucuggagggccaaagaaugauaacaucuuauuaugagagucuuucgggaaagguggcugaagcuuuagcggagaaacagcuagggaagcuucaucagaaagcaccucuccaccaugacaaugcuccuguucauucuucucauuaaaugaggacaauuuugugagaguuuugauggaaaaucauuagauauccacuuuacagucccgauuuggccccuucugacuuuuuucauuuccuaauuuuaaaaagucuguaaagggcacucauuuuucuucaguuaauaauguaaucaagauugcauugacccccaauucuuuagggauggacuaaauggcugguauuauugcuuacaaaagcaucuuaaacuucauggaguuuauguugaggaaauaaagauuuuuuuugagaaaaaauuuaucuuucaauucuauuuuccacaaacuuuuugaaguccucuuguacuauccucaaacuuugugcacuaauugaaaaaauauauauauuuuuguaaaauuauuuauaauguuacauauauaauauauaauuuuacauauaacuuauguauauaauuauauauaaauuugcauguaauuuuuacauauauacacuucuacaaaggaaauaagugaggaccaauuuuuucuaaguggcuuaggaaaagcugaccaaauaaaagauccuuccucacacacuguggaguccuuccauugaagaauguggacaacacacuccauagcagaagucaaaacugguggcugcucuccaucauauuuuauuucuuccuacguuuuuuuuauuuaaauaaauugucaacuuuaaaaauucaagaucuuacaucuaaauaucuggauuuccauuaccucauggaaaaaaugaggccucuggcaaccaugaacucuuauccccacauggcaacgauugcaugguacuaaauaauaaugccaccuaugccaggcuuggauucucuucacuccaguaaguucucugucuggcuccugugggccucugcauuugccacccugcucugcguucaguaauaacugcaagagaguucuuuuguucccagcuuggauugauccaggaagaugucuaaagaaagcuggaccaagagcaaacucuggagaauggacgggaaagaaaaugaguaggaggggaaaagaagagucucucaggauaggcuuaugguguaagcaaagccucaggggugagggucaggguaugggggaaggauguguaagauagaguaaaacacugaauguacugguuugacugggucagagguguaggaaugggaauagcaggugaaaaacuucagaaaauucauugaagagagacugaggagagccuugagggcuaauccaaggaguuucugagacauucucuaaauuacaguucuuaacuuucuauugagaaacagaucaacccacucucuaugcaauuucagguaagcuaaaugcccacuuaaagcuuaggcagcaugcccugccucuccuuacuuuccauucuuuaaaucaaaaaacaguaccuacaaauguuauguuaaucugggagcaacaugcccaaaaucaaaaggacugaacaugcccaaaaucaagaggacugaaagcaggaagaaugcuuuggcacagaaggggaaaggaugaagcggcaguggagagccaugguuaaggacacagguaccugccuggguucacauccugaacugaguauaugcaccauggucuucugaagguuacuuauuaucucugagccucaguuuuuucaucuccaauggaggaaauacuaguaccuacauuaaaggucugcugugagaauuaagugaguugauacauauuauauauguuuagaauaguuccuggcacaaaguaaggucuccacgaacauuaacugugcugcugucagcaucacuaccacuguuaccacuaucaucaucacuuaaaaaacugcauuaaguccagaaggauaguggcugagaguucaucugcagccguggccauaaaaauagaaguaaauacaugacaaagaaguugugaaggaagacuauauaggacuugguaacugcagaaauguggggaaaagagcuauacagaaguauuuaaagaucacugcaugaaucugaagcuagaugauacaauaaaauaacauggacaaaggucaaaaagaauguggcuuuuggagaagucacauuuaagaugaaagcagaggacugcagugggacuauucagaaguaguugaaacggcagaaauagaauugaguagaaaggucaggcuagaugcagauuugacagcugguggugcuuugugaagcugauaauuucugcaaggcaaggggaugaggaacacagauaagccauaucaucaugaucauuguuuuuagauaccacugccuggacacuuucuauguucuaggagcuguccugagcauuuuauauggacugucucauuaagccaugauuaucuccccauuuuauagaugcagacacugaggauuagaaaguuuaaaauccuuguucaaaggcacccagcuuuuaggcgguaugaauuaaaaaguggaauccauagccuucacucuuaaucauuuacuauauuccuuuccacaguaaaagaaaagugagauguaaggaaagggaauaaucuaagaagucgagagacaaaagcgaaugagucaugccucugaggaagaagguaacgaguuuaugagcuagauagagagucuuccaaaggcuaauuugugcuucaugaauagagaaagguuuuuaaaaggaagaaagaaaggggccuaaaagggaaggaguuacauuugaucagucaaauacuagacaagaaaguaauucccaagaucaaauuccaauuucaguuugaaugcaggacaaguggcaggguuucauuugcuuggcaucaccaaagaaauggauaccagaauucugauuugacauucauuuacaauagaauuuugcaauuaucaauugccauuuuuccagcuuggacaggguuauuaacuuuuucuuggaaggugauuagugcuuagauuccauccuuaaaaagacacagacuacagagguaccuguccgguggugguaaauaaugucaacuccacaacaauggcuacaaacaccacaucacagaucaccacaccaacagcuaacacaccaagccuucuaccuaccaggcaccacacuagcuggggcugauaccgcacuugcuacccagaacuacccccaugugacagguauugucacucgccaguucagucuaccucuggugccuacugucuggcccucuuguugauauuuggguaagucuccuagaauuugaaacuuccauuuacucccucaaaaaauaaagaacggauuauguuuugauagcuacugcagcuuuauauaguugaugcacacucuguguauguucuccgucacucacauauagggaucuagagaaaacagcuauauaacguuaggggaaggaguaaauccccuuguuuucugauaaguuuaugagcgagugacaaaaaggaaaaucuuucuugugcuucagaaugagacagcgaugaaaaacaaaaccacuucugugcagggugaaacaaacauuauugccaaggccauuuuugauugggaaaugaacagaagauuaaaucauaguggcuaagugaaagaaaccagacacaaaaaguuaauauauuguacgauuccauuuauaugaaauaccuaaaauagauaaacccauggagauagaacacagauuaaugcuuaucaugggcuggaguggaugggagaaugaggagaaacugcuuaauagguaagagguuuuacuuugggaauguuuuggaacuauauaaaggugguagcugcacaacauuaucaguguacuaaaucuaacagaauuguucacuuaaaaugauuaauuuucuauuaugugaauuacaucucaauaacuuauuucaaaaugaaaaaauagaaaguuuaaauucaaggauacauauaaagaauuuuuuuuugcuuuuuccccagaacauuuaaagaaucacuauaaaaaggaaacuuuauccuccucauaucuaaguuuaauuugggaggaugugggaaggggcuuuauuauuacuguuacuucuuugcuuuucauuguccacaaaaucacauauaggaaugcaccaggcaaucaagcauuuucucuaccugggcuguagccacugauguaaacuacauagaaaauguauuauacagauaagcaaauucuucacugugaagguaguauucucucuacucaaaaguuuucaaagaauaaacugcaacuguagaaaagaaggguaacuuuuaaauuaauuuagaagcagagcucagcuugcccuuugcauuagcucagguucuuugaccaaaagacacaaagucagcauuagacaccuaggagauuacugggggaggaaagcaggguaggaaggaagaacuuccagaccaugaugcuaaugcuugugaagcagaggaagagauaggagguuugggaagaaggagucuuaggcuccaggguacuuccaagagaggucuggcaggccaacuaggaguccuugagcccauguuccagugagaaagucucacauguaaaaggaaggagucuaugcuaacagcucauucacugacuauaggaaguuuggacuugccaugagacagcaguggaucaaggauagcaguagcugaguucuucagccaguuaugcucccacaacaagagaccucaguggcccauuuuuauggugccacaucagccuacugauagcgacaggaggcggccaaaugccuaggcauauaaaggcagguccccagugcaaccccacuuccaagcugaaaacaguuuaaagccugaaaaccaagcuacagguuaaaugcuuggacuggauugagaacuugucuuccuguuuggcacacuuuccucugauugauccucaccuuucaccuauuuuacauauaccuacccuuuccuaauuaguugucuacacugccacgcccaccuuugaguagcgucuuugcuuuaaccuuuuuugcauacucacagaccaaucagcacacacucccuuuacugagcccauaaaagccacagccucagccauauuagagaauuuucccacuuucggguaggggaaccgcuccccacauccccucuuugcugagagcuuucuuuucacuuaaugaauucuacucuacuaacucuccaguguccacgagccuaauuccuccugguugugagacaagaacucggaccuagcugaacuaaggagcaaaaaacccugcaucacuauuuuucaaagucucuacuauagaucuggcaguacauuaacucucuuucuccuguagcuaugaggaaugggaagcugugguuaucggaaaccugaaaauaauaccuacuuuuauuuuaagcaagaguuucugcaacuucucuccugaaaaucuuugagguauaaugcuagaaagggagaggaaauaaaagacucauaaaggacaaugccaguguccaugcucuaagaaaaauuucagccagcaagaaacuaacuagaugagaaaguaauaaucguguguguaacccaaaaagggcaaaucugauccugccuaucaagugugacaguuuauuaacauugauuggaaauuuaacaaauacacagggucagucacauagguauuaaugccacacccacccuccacaaucaguuauaagccuguucuguuaaagcaguaugaauacuuuauaaucuguauucaucaguuuugcagaauuguaauguuugucugaaaucuagggugauacuuaguaaauuacacacuuaauauguuagaaaauauuaauguuaccauauuacccaauaauccaaauuuuguggaaggaauaagguaccuggaaggaaucuauuugauuucauaggaguuaagaaaauaauauauauaccacauagguggaaaaaaaaucuauguuuugggaaaaacugacaaacucuggauguguuacaagaaaauguuuuaaaaauaauaaaaaaaauuuauguaugcauauacacauguaaucuuaaaaauaaggaauaaaagguggaaagucuauacauaagaaugaaauuuuauuauauauugaaaagcaaguacugugauuaauagacuuuuuugaaagaugcuaacauaaccuauuuuugggccagauaaucagucucuuuuagaauaaaaugugcuuucuaucagcuuuuuggucacuguaacaauaauuugcuggccaagaacuaaauaaguggcuuaaaguacaucugaagguauuuauaaccuauaaaaaguuuccucuuaucaucauaucugcuuuauuaacuucaaggguuuuucugcagaaguucucucauuuucuuuuugcacugggauuuuguccuucauaguucuaaaagaaauaucccauuuucucccuuucuuaacccucaggauagaagaaguaguaucuucucacagugugugaagacucauucucccaaaagaugagcacaaaggaauagaugcugagaauaucaaugccugugacauuugcugucucccauaaugacugccaugggaggacuugggaagcggacugcaaucugaucucaagucuucugacucacacucuauuuuggacugcuuuugucuuggaucuggaguauagaaacaccuauuucguggucgguaggcaguuuaacaaucacauacacaaugaagcaaucagaaaggugagcaggugaauauucucuuucagaggauaaauuacuuuuucuaggaaaaugauuauuggcugacaaugaggugguaauuuacuucccucuagacuauaauaaacaaaaauacaaaguaggacaccauuuucaacagcugugugggugauuauaaucaccuuuuagccuugaaacuagucccuaucucauuagcuaugauacauaauuuuuuaaaaaaucaugccuucaaaaagaaaagguuuucuguggcugaguuaggcuagcuguccauagugccaccuauuaccaaacuuuacagaggaugagauuucuuuuaaguaaacccugcuucugaauucagaguauccucuugcucccagccuccaggaacuagucugaggcagucaguucuauuacaggaagaggacacaagaggugcauuauguaaguuagcaaugacuaagccgggugcucuauggggauggcaguacucuggauagugaaauaagugcucuuuuagguaggauugcuuuaguuggucuuugaguuacuuaagagccaagccuagagcagaagagguugcaacagaaugugacaugaguuggaaucuguagaacaggaauucaggaguugucccuagauacuauagcaggguaagaaauggaagcggagagcacaucauggagacauggagaacagaggaggugaaagaagcccuguaaugugaagcacgggauggaggacccuggcagcagccuggggccugcagaggaaaaagcuccaagaggagcuccauauaagaggguggccaaguucguggcaucagacuuuccacuggaaauggauuccugcuuuguccuauaauuacccucuuaucucuauaccuccaggaaaagaauguucuaacaauguugguguuagaaacaccaaccuuggguuaguagagcacuggggcuuguagggauauguaagaaacaucugcuggucaccaaggggaagagcugagcagaggugcuggcaugcacacagaagcaggaauccagagcaagagauggcagaagagcacaacagaaacucacacgugucugaaagugcugggguagacaguuggucuccccaugguaagcaggaucacaccauuugcacuuagaucauuagagaagcugaaaagacugaggaacuuagggaguacgaaaucucucuaagugaaaucucagugcgaaaucucagugagaggauuuuguuagucuaaauucaaagucucuaaaaaacaaaauugaauuagcugccaacauuuaaaagugagaucauuuuauuuuucuuaauccaaauucuuugguuaaaaaaaaaaauuagacaaccugaaaauguuaggcuuaaauuccuuagugcugcauagaaauuggugccuuuacagagaacaguucaaaacagaccuaccaccuagaucaauuuaaucauugauacggcuggccugccccuggagacacccaauucugcagccccugguagcaccugauuuaaaggaucuauccaugacuaaagacauuaucuaugcauuuguaaagguuauuuuugcuuugcuuguagugauugcucagaagauuuuuagugaauuccuuaguuauguacuuugaagugaaauccaaguuucaccuccauauacaugugaucuccaaagugguuucaugcucaugaaagacagcugugcugguuauuccucauuuuccaccagaugcauucucuuuccuuccugaucugcauccugggaaguuauuuccuguguaccugccagacucacugauccucugacuuacuguuagguucggccagugagaauuaucugcaacagaauggaggccaggagagaagagaagauggguauugacucacugucaugguucuauaacccuccacccccacaacucccauugugaccccuuggauaaggucagcucuuauguggcucugauaacacaugaucccuucuagguuuagaggugaugccagcuucccuccacuguuaguccccggugcuuccccaccccauguaguuuccuuaacccuaucuauaccuuauaaguaaucccauuacuaaaauaccucccauuaaaucugauuauacaaucuguuuccuccuggaccccugacuauaagucaaauuugaacauuccaaauucugguacaaaagcaguuggacagaaaagauaaaaggaaauagaguaaauuucaaaugagucuugaaaacaauuuggacaagcauaaucuugcagauugguccuuacaagcccuacuugccuuaaucagauaccucaacaguugaguguucugggucauuucuucucugaagccuuucauuucaugcguaauuagaaacaugccagucuguaaugauggcagccuuuaaaauggucagucugucacuuccauggcccuaacuccagacacaaaaugcaugcuugauuacuaagagucuuauuaaggggcuauuguuucccccaucccugccagcuccuccuaccuccugaucuuuaucaucuugcauucuacuuaaagaaggauuuaaagagaaaaaaagaaaaucucauagacacucacaucagauuguauuaauaagcaagguaaacuacaucugggcuugucacucacaguuuuucuuuuccucucuaaaucuaagaauaacaugcagucaguugcaaaacagggagcaaguuuuccaaagagcacgugggugggagaagccaaccaugaaguaaauuccaacaucaacagucugguuggauuccacuguggcccccacuaauuuucccaacuuuuugggccaugaaauuuauuauuaucaacuccagguauaguuauaauccuugguaaaacuccucucagaccuggcagauaguguccuuuaaagaguacacuaauucuaaaaacugcuuauuucuauauugacugagauaggaaaaaauagccuucauuuucacaagugauucacucuaaucauuuaauaccuauuacugcaacaacaugcaccagauuucugacagacaccuguuugcaaauuaucuaaguuucagagcagaaagccugguuuagaaauacaauaccaucuguaauaaaguagcacuagcacucaucuggacuauuuuggacuaaaaauaguccaaaaaugaaacacaauagaauuuuaguuucuugaggauugggaauaucagucacuguauagucauugcuucaagaacaguacccaguacauaguagaugcucaauccacauuuacugaaauaaaaagaaugccuuaauagcccacugucuuggcagacuuuaccuacucucauuccagcacuuggaacaauuaccuacuuucaaggaccaccuuuguacagucaugcucaugcccagaacaaaauucuuauuucacagagauaccaauagugcaaaacaaagguuuugacugguucucugcuuuagcauaugaauaauacacucuagucuacagagaagauaauggaagccaauaguccaagcguucaagugguacuuacuucauuuaaaaguaaaagcccgggauagacaaagacagaaaaagcagcauugaaauaaccugugugagaaagcagaauuuuaacaacagagcugggcaaaggaaaaagcaauuaguagguuugucuucaugcagcuucaagaguacugguuguuaaaauuaucuuaggagcugguggugcuuggauuuccuuucaacagacccugaacuaugcagugcuuaaccuccuuuucugagaacuauccagggacaccaaauaggaauggaugugcacaucgcugcugucagggcucagaaagauaauacccaaaaugaaggccucagaaacaaaagacucuuggaccuucuccagcccuccucucucuagccucuaauuuucuccccauaggccagccacaaaaccuaaaaauauuauucuaaucccuaccaccuuccugcauaauaacuggccaugaagaaacuaucugaccuaccuugcuuaauuauaggucauuagacccccauuccagaaagcguccugccccauacccagaagcaaggaaugcugcugagaggcaaagaugaaugcagacacaccuugcuggguuuucucagucuaccaggauuagaucacauuuuuuguccaaucauauuucuauauggcucucuguacuuuguugagcccaaguacaaaauuggacaauuuccccuguaucuuugggucaucauucugaaggcucccaugucauguaaaauuaugaucaaauaaauuuguaugccuuuucuucuauucaucugccucuugucaguguuuucagcaauccuucauagagugaagggaucguguauuaggauucucuaaaaggacagaacuuugcaaacccccagcuuuucugcguggcagauaggaaauugaaaguacaucugcuugguugcuguccacaaccaaucagacugauugugggccaagucugccuuugcacagaagugcaacuuuguaaauucacuuuagcuucugauugguugcuuuccacaaccaaugagaauacuuucguuuucaaaaaaucccuacuuuuuuugcgucauucuuuccuugcuuuguguguuuugucuaauucuuuguucaaaaugccaagaaccuggacacacuccaccaguaacaagaacaauggagaagguucaaaaugucagauuuuaaacaaaaauuucgaggcuauuuauuaccuagaaaaacaaacaaaaaugugcaguuuaaacaaacccaaaaagagacagagaaucuauuauuucaggucacugaguauguacuacucaguugucucgggaugugacaguagcuaagacccucuuucugaccuagagaaaaauccuucauucuucaaaauaagguuugaagucacuuccucuagguaggcuuccauaaaccuagucagaugcucauucacaggacuuuuacagauagcucuuugauccucucuccaccauagaacuuguauuacacugcucuuacauuugauucuaaugagacuauaggcuucaaaagaacuaggaccacaccugucuuuugaauucccagcccugcaacagggcuugguuuauaggaacacugaaagaauagccuuuggauuuguugaauguaaguuuuuaaagucagggaccaggcuuuacacagcccauaauacaagcucaguauuggagauguuuccaguauuauggguccuaacucaccaagacagaaggaaagaccucacuuuuccaaguucccauucagcaagggcaaggaaggaguaggaagcaauacaggaauucaguuucugaacgaucauuaaaagaaggauguccagguugcagcagcagcagaaauccuauaauauauuuuuguuuuucuucucaaaugagcuagaaaauugguucucaaacuggugauuuuguccuccacucccaucccacugauggccacaggaggcagccaaaugccuaggaagaugggauagggguagguaccagguggaaccccacuuccaagccaaagacaguuuaaagccugaaagccuagcuacaaguuaaauccucggacuggacugagaauuugucuucccauuuggcacacuuuccucugacugaacccacccuucaccuauuuaacauauagcuacccuuuccuaauugguuuucuaaauugucaugcccaccuuugaguggugucuucacuuuaaccuuuuuugcuuacucacacaccacucagcaugcacuccccauucugaguccauaaaaggucccagacccagauacaugggggacuuucccgccuucugguagggggaccacccgcaugaccccucuccacugaaagcuguuucaaugcucaaugaaauucuucucugaccuccucacccuucaauguucagugcauccucauucuucuugggaauaggacaagaacuugggaaccagugugcaagccagacuuggcccaggugggcugacugggcagggcgcccccuguggcagguagagugccccaagagaagccuccuacaucgcuagccagagguccccaacuggcaaagagaccaagaaaaauccugcauaccaccaaacaucuagcaaaguugggagacauuuugggcuaucacaacuaggagggugcuacaggcaucuacugaguagagggcagggauugugcuaagcauucugcaauguacacagcagcccccaacgacaucaacugugcuaugcuugagaaacccucagcuagacaacucuuuguugucugcagcuaaaaaugaccaaucuccuuucuaagcuccaauuuucccauuggaaucauggcaacaauaaucaaccacuucuuauauguuaaguggugaggcuuaagauaacaaauguaaaauucauagaguauagccuggcacauaacugcucaauuauuauuagauauuuguaguaaucauuauuauaauaaaagccgcaugucugcacauaauauggagguaucagguacuaugcuaaacaucuuuuaaaaagcugauauuauauaugcuccaccacucaaaacaugcuugguaaaagaauaaauguugacauaugcuugcuuauuaaaugauuaugugcauaaggcaaauauaaaggacauaaaaguguuuaucagggcacaauacuaaaaacaauaaauuaaauuccuuuuauuccauuaagaaugcuuuucucuaagaaguuccugauccugagaaccaggcaaucuuacaugcaaacucaaagcuguuuuaucccucucuucagacaaaauacaaucaaacaaggcguggcugaaaccuauuacugcuagccuggcagaccacuggagccaaugcugccacuaauucuguccugcuauaugcaggaaagcgaaagagacacacggcacuucagagaaaucaauuuccuuuauuagcuuccuuucuuuaucguuugcuuucacuguauguuuuguggaucaaguuaaucauuuucauguaaagaucaaucuuaauauggacuuucauuugaaaguuguugucagauuuuguggagaagccaaauucuagagaaggauggugggggguggugugggguggggugggguauacaccugacuuuuguuguuuccagcagcccaaccauuccaugaauuuuugguaauaguaucccaaaaccuucuucccuaauguuggcaacuguuuaguucagaugugucguagccaaaauugggcacauuucccaauucaggccaauuagauauuucucccuaaauucugaaucuugacuaaaauaaacagaagacugaaaagaacugaaaauuauuucuuuaaaucgugguguccuuauaagacuguucaguagcacuugcuaugcauaaaccccaaucuacucugcuuucugucaauucucaagucucauucuccuauauccuuuagucuauauagugaacuacucaaagccugccaauaauuuuuuuuuuuuuuuuuuuuuuuuuuugcuuaagcuaaauagaaucuacuuuuguuugcuuauaaucaaggcaaugcuaacuguuacugguaaaaacacuguaacacacuacugacaaucauggaucuggagccaggauaugauauuucuguuucucuuuuauuuagucauuuauuuaauccaccuugugcuucgguugcuaagucugugaaggaaaaaaugucggaaaagccuaccaauuacagaugccuaguagguccagaggguugcuauuacaguuucuuauucaucaauucaccccaaaagauaaguaauugaaucuuuuuuaauccccugagauuuaucuagcucacccacuuguuaaggaggaugcauguaacuucugaguuaagaaauauaggcaaguuuagauaauauucaaugggaauaggauaugcaaauguacauacuauauuuuuuaaauuuuauuuauuuuuauuuauuguugcccaagcuggagugcaguggcaugaucucagcucacugcaacccccgccuccacaguucaagcgauccuccuaucucggccucccaaauagcugggauuacaagugugugccaccaggccuggcuaaauuuuuuguauuuuuagucgagacaggguuucaccauguugaccaggcuggccucaaauuccugaccucaaaugaucugcccaccuugggcucccaaaguguugggauuacaaaugugagccacugcaccugacccaaauguacauauuuauguguaaauaaacacacauaaauuuuucaaauaggagccccuacauuucucuucccuuugaugaacuguugaacccuaauaaaaugaagaguaucacacaaccauuacuggaaccuguuaaagccacuaacagagaaagucauauuucaaguaucaguugcauacuaaacgaaggcucuaccaaugacagcacaugccucauuuuaaagcuaucugagaaaauuuuccucaagucuuuucaaccagcacucaccauguaacuuuugaaaacauaggucaguuuauauguguguaacacacaggcacauuaauucuauaaacauucuuuucaaggaagcugccuggacaagugcuagguuguaacggcccacuggacuaaccacccugcacgugcugcccaguuucaacacacuuccucagccgagacuugagaugcaaauugaggguaaacucagcuuccaggcauagacuugaacauuuaaugccaacaaagucccauugucagaccccuccugcaacuccuaauccacauaugucuauccggcauccacuaggacaacuaccugcguccacaacauuaacaugauguggacaccccagaaguccacuaaaacccaguggggcaaggaaugacuguacuagaaaugugugaaaacaaugagauuugagggucuuuacugaucaaugauagaggaugaggaaaaagaagaaaggaaaaagaucagugaaugucucaagaagacaaaaauaaaggagauuaggagagacaaucagggagagaaaagaaauguugacgguuaagaggagaaauaauugacaacagaaaaugaaggucagucaucugggccaaguguaucauuuacuuaucaacuugguauuuccuaagaucuaaugugauaggagauacuacagaaauuagaaugaaauaugacuuuaauauugauuaaguucuauccuggcacuugcccucaaaggaaagaucaauuaccauaaucagggaauagacuuuuuuaaaaacaaaaaacaaaagccauaauuccaguggcuuuccugagagaauuuaugaguauugccauagauuaaagaauggauauccuccagcagaugacagcaaaaaauucuguagcacagaguuuagggacucgagucuggagucagacucgggggcucaaacgccaacuuugcagcuuaagaguugggugacuccugcaaguuccuuacuauuuauuugauccucagucuccuucucagcaaaacaggagaguacagauuucauuggauucuuguaaauacugaauaugauaguguauguuacaaaaguaaaucauaagcccaaaguucuuuuacuuggccuugauuaaaauuauaauuaaagcauuggcuauuagguucagagcauuuagggguaaacuucuaagcaaagaaacuguuaacccaagcacuacugaaaacauaaauccuggaguaaucauaacccuuuguuuagagagaagaaagaaaaggucuaaagacuauuuaaaguaaagugaaauuugagaccaaucuguggaguucguguucuuguaaagcugaauauaggcaucauuugguuuaccagagcuggcaaugaucuaucgcacaaauugaaagauuuacuuuaacugugaaucuguaaccuuggacucuggauauuuauagcuguaaugagaaauuacauuuguuagaauguuuguauuaacuuuuuuccccacaggaacuugguuugccaacuaaccuuguaauaaccauagacuaagaugucagugaucuaguuacaguuuacucaagccauuugaaaagcugaacauuuucuugcugaaaguaauacaucuaaagucauacuucccugagagaauaagucauuuuggaguuaaucaagaaagggacagauuaucaucaaaauacaaugcaaaaaucucaauuuuucacaacaaugcaauucauucagcaaaucucaauacucccaugcuacacgaaccuucuuuagauuuucuccuggguguaucuuugaaggagcaugaggaauauuugcuauggcucaaaaaccagauaugcauuccaucuguuuaaaagcuuauaggguauuauagaugaagcaagcuucuaaauucaaccuuaaauaaugggaaaaucgaacaaaaacaacacccuaacagauuuauuuuaauaauucuggcaagaaguacaaaucuaaggaaacagaagcaaaauacaggauaauucagaauacuaagaaccugcuauuguuuaacugaaagcauagguaaaaguuacaaaaagugaugccacguuuugaugcugcuuacuggcugcaucuagagagaggcaaggagguaucaggcauuucugccaaagcuaggugagguauuaaccacugagaagauaauaggaauagaugagcaaguuauccagaugguacaagauggcagguaauguauggauaauugcaagccucuccggaguuaaggguacuaaagaaaagaaagucuaugucuaaagaggagaaaagaagacagacaagcugguuacauuggagauuuuuauuuauaagacugacacagguuaauuucauucccaucaagcaauuauuaauaaauucucacaagguuuuaucguggauaaaagaauuguaauacgugauuuuaaauauuuuaauugccaaaaauaaauuuccaaaguauucacagcauuuuuuuacuuugaaaaguaauuagcauaagcaaauaacaccuccugggugacuacuuaacauauauacuggcuacuauucaugaaauuguauuuaaaaugcagagucaaauuuccauauguaagauaaacaguauauucuucauuucauuuuuaaaaauauaagagauuaauuagcuaaauaauuucccuggaaaacuauuaaguaggacagaggauucaagacccuaaaauuaauuuuucaaauguuaagagguuuauacauccaagcucacuuccauucucauauugcuuauuuaaugacuuccugcaaacacagacaccacagcccaagaucuuucucuuuccuauauggaguaauaagacagagaacuuaaaguuuuggucuuugcaaaauauguguacuuucuucuugaccauuaauucuugagcccugaggcagauagaaaaauuggaguagugugccaaaugucaauguaaaggagacaaauuugacaggagauggagaagcauuaaccccuuauaccuauauaucuaaaaugguauguuauauauguuaaauacacauaaaggauuucugucugcaccaucauagaacgaucuaagauucaagcacccaaaauuacaugauacugaugccaguauucuuuacauauuagaaaaaucuugaacuaguucuuaaaucugaugacuugggucuccccagucuguucaauaagacauuuugacuccuauuaagaagaaacacucuucuuauuucaacuuggaaauuaacaaagaaaacagcauucauuguagggaaaaauggcacauuauuuuuuauaaccuccucuuacuugaguagaaaaauaauccacuuaaugugucuagaagggcaguaacccuacauuaggggagaacagacucccagggaaaaagccauuuacaaaacauugaggaacugccaaacguuguaggguucauacagccacagcuaauuacuauguauauuguauuucuggaccuacuggcaauauauuggcugaucuuucuggauugugucuucucagcugaacguuguuuauuucccacaucaugcaaaugacagggaggauguuggucuauuuugugauuggcaggguaaaaacuuaaaauuguguuuuagauuaggucacaaaaaagugugccagaugguuguuaacaaaaaagaaaaugcuuucaacaaaccucacauguuguauaaucuuggacaaaauacaaaagauguaaauguccugccacaaauauauuggagcuggauccaccugacaaugcugaaauaucuaguagaaacaauucccaaagagguaugaaucugacuuuucucucuagaaaaacugcuggaugacuucuuagaaaaguuaagucagaacccauguuuuuuuaaaaaaucauuuuucagugguaccuuuguauuuauugucuacucuaguauuuucucuugccugggguggggggaaacauuuuuucaccuguauuaucuucagagaagauaauacaccugcaguguuuuagcuuggaaaguuuuaaaaaguaaacaggacaugguggcacauaccuguagucucaacuacuuaggaagcugaagcaugaggauggcuugagccuaggaguuucagucuagcgugggcaacauagugagacucccaucucuaaagguaaguagauacauagguaaauaaaacaaaggcaguauauuuucauuuccuuaauaaaaaucuugaggaaggugggggaaaaggcauguacuagcuugcguuccucauaguccauuagcagauaauuuucucaauaguguaugaggacaaaaauaaauaaauaagaccaguuucacauuuaggucccuagagauucacaaucaucaucucccuucugucugccaggauuuaaauuuuauuuuuaauguggccucucuuacgcauuucccucucucugcagauuuccuagucucucccaagauaacuggaauuguacucaguauuagucaagugagagugccauuuauugaccaccgaagaaaagccagguacucugcagaucucacuucauuccucauagccauaccaggagguagcccauuugcagaugggcaaacuguaacucaagguuucucaccuaggaagggacugagcagagucucaaacugauaugguuuggcucuguguccccaccuaaaucucauuuugaauuguaauuuccccauguggagggagagaccuguaauccccaugugucaaaggagggaaguaauuggauuauggggguggguuucccccaugcugcucuugugaucauaaguaaguuaucaggagaucuggugguuuuauaagugguaguuuuuccuguuugcacaugcuuucucucaccugccaccauguaagaugugccugcuuccccuuccaccaugauuguaaguucccugaggccuccccagccaugcagaacugugagucaauuaagcccuuuuucuuuacagauuacacagucucgggcaguucuucauagcagugugaaaauggacuaacacacaaaccuagaucuaacucucagacauguuguugauguugacagaagguaaaagaguccauaccaaaugaacauucuuuuagcuacauacagcaauuaauuuucaccagcccuugagaaaagauuugaagcacuagucagaaggaaaauuuauuaaauagaagggaaagacaucaaagaguuaauaaauucagaaacuguacaacugagccagguguugaacagaggacuagacauggaguuagggugaguaagagggagagagagagggagagaaacacuaagaaaagaaaggcagagaaccaugcaacgacuucccugauuuuaacaaugaaaguagcucagaacauaggaguuacuuggccaauagaguuaaaggucuuacuuaagaaguaccaugcaaauuccauuucugguugccagacccugauauaccacauguucauuucucaauaagugcauguuagguaaauugaccacugucucuucugaaauggaaaugucuauagugguaaaggcauugccauuggauuugaaagcugcaaagcaaguugacugcagggaacucuguguguguguguguguguguguauguguauguggcuuguaaauuauucuuuuaaacugcuuacaaauuagcugugaaacugguaguauguaguuguccaugucaauaacaaaaaagcaaacacacaaaaaaugcagaucagaagaaacauaaccucagucacuucauauuaacagaccauucacucauccauuuguuuaaauauuuauuuaauaacuaccacaugcuacgcacugugcuacauguuaggggauauauuggugaauaaaauaguuaugguuuuagcaauuacaaagcuuacaaucuagucagaaaaacagacaaaauucaaguacaacagaaauaacuauguaacuacaaauugugauagaauaugaaggaaauaaaugaggcacaaugauaaagacuggaaugauaggcggguggaugacagagaaaugcauuuacauacagugguuaggaaacgccuuuaugaauccaaauucuaggaucuagauggagcucuaacuuaaacauauauuggaaucacauggagggcuuguuaaacuagauugcugagccccacccaccaaagugucugauucaguaguucuggagucaggcagauaacuugcauuucuaguaaguucccaggugaugcugaugucaccgaacuaggaagcacacuuugcagaauuaccggacuagagcauagugcaggagacagaaaggggccugagcugagguuggaagaguaggcagggaagcucuagauacccugacacaugcucagugacaauaucagugccaaauucagaaccugucuaggacuuggagugagucuaaugaucaagacaacuaugaccacuacuguuaucuuugccaaaggaaggaccucuauuacucccucuucuaagcuaagaaccugaaagcaaauuuaucaaggaauacaaagaaccaacucuaaaaucaaacaauauuuuuuacaaagcauugcuauauuaacacaguaucuaccauccaaagaaccugauguuaucagagcauauuuaauagagaagauaaaagagaucaaaagguggcaucugccuucaaacauagagcguucugaggauuacggcaaggaaggcauuucuguuaauaguagaagaugugagcaugcaauuauuguaagaaugaucuaaauuauaaguaaagaagauacccuugaccucaucugguuugaaacauuuaacuggcuuccaaaggaagauaaucuuuauuaguauuugaaaaguuagauagaaagcuaccagaauuuugauaguuucguagcucucaacuuuagucuucccccaaaucauuugggagcuuguuaaugguguagauuaccagagccauccucagaguuucugauggaaucagaugaagugaggcccgggaaugugcacuuuaauaggcauccucaggcauucugaugcugguagauuaaggaccacaguuugagaaauaccuaguuaaggcaugguacccuguaaauggcaaaacccagauggauaaucucuuauggauuuugauagagauaauugaaguuuuacuaugugccagguacugcugggcacuucuuaaaaguacucccuuuaguuuuuaacaauuuaaaaaaauaauacucaagugaugagaaaaugggauucagcaaagcaacuugucuguaguugaucauguaccaaauaauuuauagagccagaauguaaacugaggguuucugacuccaauaauacauuuauuucaaugauacugagcucaugauugcuaaccuuugugaagcuacgacaaucauuaaacgauuuccuggcaaccacagcuucuccuaaaagcauuaugugauuuggccuuuuaaaauaaagagaaacagaguguaaucauaucuugagacucugaaaaauccuuagaugucuaaaaauauucacaggugcuggacaaccaaguauaugaaucaauaagagaaucccuaacuuaaagucuuguccacugauauuacacuggacauaucuauccaacaucaagcucagagacagaauguuuagcagugaaggguagaaacugaagacaaacgccugaguuaaaaaaaaaaaaaaaagucucuaucauggauuagcuaugugaaaguggguaaaugauuugauuucucugagccucacuuuccucaucuauaaaauaauaauaauuacuuugggauuuuuauauaagauauuauuauauaauacuauuauauauuauuauuacauacaauauaauuauauauaacauauuaauuccauuaauuauaauuauaguguaaaauauauuauauauaauagcuuacauauuuuugaaucauuuggcauaguaccuaccacacaguuguucaauacauguuaucuuaauucuuauuaaauuauuacuuuuaagaggcaugugaugcaguuaauaaaauaguggaaaaaacauaaaggcccaauaaacauaacaagauggccaaucuaaucagaauuuugaaaaggcaaauaauuaaauaaauaaaucagcaaaauaucacaaaauuccccauaagaucauaaaaaagucaauauucauaggauaaaaauauuggugaagaagaggagaaauagguauucucucucauaaaccauaaauugauacaaccaauaaaagggcauuugacaguuuguuaaaaaaauuguuuuaaaugcugugauacagaaauccuauuuuuuccuauugauucuacacucaguagaacagauuucgguaaccuuuuccuguaaagggacaaagaguaaauauuuuagaguuugugaaacuuuuuacagucugucaugauaacucaagucuaccacaauugugugaaagcagucccagacaaugcauacaugaauuagcuuggcuguguuuuaauaaaauuuuauuuauggacacugaaaguugaauuuuaucuaauuuucuggugucaaauauucauaucgugauuuuuuuucaaccacuuaaaaauguaaaaacauuucuuagcuugcaggcuguaacaaaacagcagcaggcaugauuuggcuuagcagcuagcuguaguuauuaacugcuaccuuagagugauaccuacucaugugcacaaggaggcauggacaaagacauuuacuguagcguuaaaaaucugagaacaggccgggugcggcagcugaugccuguaaucccagcacuuugggaggccgaggcgggaggaucacgaggucaggagagcgagaccauccuggcuaacaugguaaaaccccgucucuacuaaaaaaauacaaaaaaauuagccgggcgugguggcaggcgccuguagucccagcuacucgggaggcugaggcaggagaauggcaugaaccugggaggcggagcuugcagugagccgagaucgcaccacugcacuccagccuggucgacagagggagacuccaucucagaaagaaaaaaaaaaaaaaaaauuugagaacaacuauuagaucaucaauagagaaauggcuaaaaaaguguggcuacauccauaaucuggaauauuauguuauucuaugcuaauacuauguuagcaaaaagaauaauuuaucacauacaauuguaagagauacucaagaaacuucauggugaaaaagcaaguugcaacuguucaguaaaaaugcaagcuaugcucggacuuagagguuuuaguacuugcaccauuauggcagugaaaaaauucguuagagaaugaggucggucacuuuugguucaucauucugugaucacagaacacaguggguccauuugcugagacggagccauuugcuguucauaaauguuuggauuugucuuucaacaacuagcugacaaaggcauaggcuuaaaugagaaaagaggcaaagaaaauauaauagaaaaacucaaagaacacauaauuaaaagcacuugggggacuccugaacagauuccuacuguguuuuuauacugaaugucaucauucucaaugaucaggaggcagaugacagcaucaagacaauauggugucaagucacauuucagaauguucccggggcucugaucagcauuagccugacuaaccagaucagagaagaaaguggucacagcaaauacccugucucaguucauuacucaacaccuguuaacugugauuaacggcccuggcuaauuauguguuaagagcaucucaggcuguaauggaucccagaggucugcaaacuugacuucauuuacauguuugucuccuuucagaaggucucagccaaacauggccgaaaucucccgagcauuuuaugaacucccaugucaucaacucagaguuucaaauacaccagggucuuccuagaaaggacaacgaaugucugagauguacauuuguuucacagauaaagcaggcaagguuuagauuuuauggcacauaaaugggccucuuguugcaauuaauauuauaaaaggcugcuaaucugugugcauuaaacuaauuguuacauuuugugaucucggcuaaaagacuaaacuguauuuagauggcagaaugcacuaaaaccucgcuuuaugucucaaacuaaaacugcaaaagucagaaaucaaaaaggcuucagagaagcuuuuugucuacucauuuuuaguuuuaaaaauauguauuaacauuaauuuuacauaauuaugucaugcuauauucauacauuaaauauuaauacauauacaaaccuauauauauguaucugaauguguguauauauauauauauauauauauauauauauauauauauauauauauauacguguauacacacacaccacagacgauuagacagcccuuaccaagguauuuuucuugcuuuucuuaaaugguauugaaccuaacucuuccuacaguuaacugaaagucaacuaauuaacaucccucccaacuuuuuuuuuuuuuuuuuuuuuuaguagaggagcagagcuggcagcagacauuaaauccuucuucauucuuauuugcuuagucuagcaaaguaaugagaaaaaaguaaauccacuaacaauugugugugauggaauauuaugcaacaucuaguauucaugcuacugcacuccagcauggggaacaaagugagacugucaaaaaaaaauauauugaaugucuacauguacugauauggaaagacaucuaugacauaugaaguggaaaaaaucaagcugcugaacauuagauagcauauuaugaugcaaauaaaugugcuauaauagcccaacuccacauaugugcaucuuuagauuccuguauacacaagaaaggaucugaaaacauauagaauuacaaggucuuacaagcaaucugguucugccuuuuuuagcccgaaugggaaguaccuaucccaaaugaccuucaucaucuucacaacuagaaagagauuuucauggucccuucuacccaguaacagcagagcacagugguuuggaacaugugccgugcagucaggcaagugugccucaaaucauaucuaccacuuacuggccaagucaucuuagacaaguuacuacauuuuccaguacuucugcuguuuucucauuugcacaacagugcccgucucauaaaguuucgugaggguugugauuuaauagccguauagcacaugccuuagcaagugucgucaacacucaccucucuaucauucuuagcuaguacuuucuucaucuugccucaguuauuauuugaaaugugcuuguuuccuuagucauuacauuuucuaauuugccaaauguuaaacaagggcaagaguuggcacuuucugugucucucugcuuccucccaccaccacuguaagccccaaauaaaauaauuguuuuuuacauuucugaaagcuuuucacucuguuacaaaucaaggggcuccaacaugcccuuguuucuaacaauucucaaugcaguuuaaugcuaggggugaggugggcucauugacuuuugcucuuggcugacauuuccauuagcacaugugugguguguauuuuccuccaguauucuuuuugcuaagaguuccgucuuucucuaauuucuuacuuuuaauugucuuuucuuauugaucuauaaguugcugucacuuugaugaaaccuaagggcuucaagcacaucucugcuauuuacuagcuggaaucuuuaaaaagguaucaauuagguucaguuucuuaauggguaaaaugggcauaauaucaucuauacuuuuucuucguuuugaaauaaauuuggcuuuuaccacuuagagaauucaugucaauuuuagaaaaacaaagaccaaaaaaugaaauaaacaaagauaaaaccauucauaaucccacuacagaugucaaaagucuauucuacauccuucuaguccuuauaaauguacauaacuaaagguucugggucaaggggucuagacaauucugaaucuugcuuuauuucuuauucucucuucccagaccacucaaaauguuaagucugauguguuuuaauugaauaccuuucauugugcguaaauauacaccuaaaaucacaaauauaaaggcuuuuuuacugaaggccaucaugcuuugcauauuuccuguaacuugcuuugcuaacuuuacaauauaucaugugcaaucauccauagcagauauacauucuaauucuuaaugaccuaauaaucauccauagcauguauaacacaguucauucaacuagucucaagugaucaaaauucuuuguuuucauuuuuuugccacugugaacaaugcugcaauaaauaauuuuguauauauauuuuuaucuauacagaauaauucacaaagagauuacuguguuaaaggcuauguguauuuuuuuuauuuaaaaugauacagccaaacugcuaagcaauauauauagcuccuagcauuucuccacauucuaacagcauuggaugucauauauuauuaaguugugccuacaucccaggggaaaaaaaucuaucuuauuuuacuuagcaauucucugagauuaacuuuuccuuuuuacuggcuauuucucucuggcaaacugcucauucauaaucauugcccaguuuucaugugguucacuuucaaaaaacuugcauggagugucuugguauuuaaaugguuuaaguauugguuugucauguguguuauaaaugcugcuucaccuagcucaguguuugcauuugcuuacuguccaacacacauaaugaaagucuguuuaggaaaauacaugcuuucauacaucuuuguuucuggcuugccuuccaucucuccaccccacaucguauuaccaucauuucucuuccuggccucucuugcuuucaaauucuaacuuucucgucuuuaucuccuccucaccaguuaucacaauuaccucuguaaagaacuaagauuucucccacuacuuuuuuuuuuuuuuuuucuaaagagagaauaaagcuuuggccgaagacaguuuugaugagauggcuagaaaaacugcuuuucuucauuggcauuuuggaaauauugcucagugguuugggacccauuuauuucuacugccucuauccaucuuugcuuuauggcuugacuucugcugcuuuaacuccacauucuguuuugcuccacuucaacuguuuagcugccagguuuggucugguuucacugauuuacuguaucuaaucucauucccucccuggauucugaaccccauccuagaaaaggcacuuccagcucacagacucgcauguuuaucgauugaaauuuaguucaaucgauaaacauuuuagcauacuuggguucaauuccaauagcacagauguuuucagaucauuucagauggugagacccagaaauuuuaauuauuuuuccaaacacugcuaaaaacugacauuaaauuucauccaugaacugaaaacauuuuuacuaggagaaaaucaugaugcugauauaugcaauuaugcuauaaaguauuauuuuauuuuguuagguauuccauuuaauacuauagaaguauuaugauauuuauuacauaaagcauuauuauaauaaaaucucaguaccacccagaaaaauuaaagguuugaccuuaacuuucuccaauuuuucccuauuaauaucaauuugcuuuucuuguuaagaaaauauuaagguggaaaacuugaaacaggacauucuguucuauuauuuuuauguugagaauugggaaaauacagcuuuuguuguauagaaugugguauguaugugaugaguauggaaaaugcauacuuccaacggaagcagagagacuuguucaggggccauugcaaaacuccacuggcaaggcgcuaucagccugcagcaagguuguagaggcaaagguaaaagauuagagauugauuuuuagagggugagcuaaaaggacauauuggagagcucuuaggcagugugagggcauauucugacaucuuaaaugccucugcauuuuaaaauuucugaccagcugucaauuuuguccaucaaaaucucagccugguuauccuugcuuauaagcagcagauuuuuugagugcccccauaugacuccagguuucaaauguuugcuuuaucguaugucccaaaguccaaauacuggagagucauauggaaauauuccaaagauuugcacacagaagugugacacauaaggugagaacagccaauaaagcuguuagguauaagcaguugugcaaaagaaucaguuguauagccagcccugcaaugcuuggaaucaagcagcauggacacaaagugucuauguguacccaaacagggcauagacuucaaugcuuuuuccuuucaugacuagucuaagguuuuugaagcucuucucauaccuuaucacauuuuacauaccuaaaaagaaucaauauuuucuuguucuuuacaacauucuuuuuuguuguuguuauugcuauuguugaaggacaaucaauucugauuuacauaaacucaaggguaacuuaaaaagacaguugcaguaacuaagauugaagcuggcaugccuuucccgagugagguguuagacauaaaaauggcuuucauuucguaauggagaaaaaagacuuaagucucugggacacaccacucuucuccccuaaucucuuccacaaauagcagccugggugaucuuuuuguaaugaaaauucuaucacaaacuccaaauauuaaaacuuucucauggcuuuccaucaucuuaagaaugagauccaaauucuucaaccuaguuuaaaugguucuaugccagggcucuccaacucugguagacccaacccuccuuaauacaaauauuuuguauuacccucuucacucuccugagaugaaaucuacucuuaagauacucuaccuacacuuguauuuuuaaaaauguuauaauaucuuaacuuuaauacuaaaaagaaauauuagaaugggacagaauaugguuauagaaguucucauuccccuagacauacccaacggaacaggcagccucaauugccaccagcagccucucauggcaaagcgagggaccagccucaagugaauuaagcacuauagaugguagaguagagagacagaauucagguccuugaguagaguagaguauagaugguagaguagagagacaaagagaauucagauuucacugcacuggugaaucaaccaacccugaagcccacauuacauucagacuuuuuaaugauccaaaacaaauuccuuucacaguugaacuuucuacaauggguuuucugaguaugacauaaaacauuauaaccaacauacccagucaaaaacagagcgugagaaacagugcuuucucaacagcuugucuaaagcaugcuuauauaauuaucaggagaauaugugaaaauuagugagguuuuuuucugauugauaugaaugagauaucuuagacuucauagagaugauguguuuaaagaacagccuaaacuaaauguuuaguaauguuuccccuaauaauucuuaaaguuuaagaaugacauuuucuaauuucuuauguauuaaggucuaacauacuucucaggcauuuaaggcaauggcgcaauaauauucaaaaauuguuaaagcuacucaccccaacuccuucuaccaguccuggugcagcuaaguaaugcagcugaccauuagcacaccugaaacuaccacacuaauguggcuuuucagggcaggaugaggaaauacagugccccuagcuaacuucuugcagcaaauauuuguuucaauuuuuuaaguguaguuuuccuaauaccauaacaaaaucauuucccccaccuuuucucuucauucuuucccaaaaguaauacagcuacuaaaacacugauaguauaacaauuuauguuguacuucuuucugcuuuuauccuagauuauaauuguacuacaguaacuauagugauaaagguaaacacuuacauggaaccauuuguguagcaggucuuuauuccaagcacuuugaaaacauuaacuccuuuaacccuauaauaucccuacaauggugauuacuacuuuuauuuuacugaugagaacacugauuuuacugaugagaacgcugaaguucagagagguuaaaucacuuggcccaaaguuacacagcuguaagccaagguuugaacagaaggucagugcucuuagccacuagacuacccugcgucucaauacagagagcagucuggggaaaauacuggcuaauaucggagaacauguuuugagauuauuagaaaaugaacucacauacaucucaaagcucuuagauacagggagauaaagacugcuuuucaaagagaaacaaaaguaaacaaaauguauuucuugaagagcuuacaaagcuaaagucagaaaugcaucuccacucuguccugucuggucaucuuuaaacuucuacauccuaaagcuuugguuuccaaucagucacaaucucuugugcucugaugcacuccacacacucacucacacaugcauugugcauuucacacccacacacacacaaacaugcccaaaauacauggaagaaagauaaaauuagcugucuucucuuuguuguugaucaaauguagcugaagagucagcaggggauaaauaucuugaugcuuaccucagguacaagugcuuugaagaagaacauagaagagcaacuuuuaauguagcauugugaaaagaaaaaaaaaugcuauaaaauccaacccccauuguggggugucauuucuaacaaugagguuuguuuucuuuaucuguagugcauauagaugaucaaacaaaaauaacugauccacaggcucugaaguuuuuaucaguagucaccuucugcauggauuaauaaaucaaaaagggauuuuaauccuaucuucccuuuaacauuauggcacauacuuuugcaauaagcguggggcaaauugggagccuuucugagacacagguaggcaaguaaaaaccacauuagcugaacgugccuuccuaggugguagaaacacauggaucaagggaggaugguugcaacacaucccuaucaggaacccacugcaacuaucugaagcacccuccuacaggaggggaugggaaaugucauccugcaguggaagugaauacagggcugacuauucagauggaaauggccacuuggcucaauuaugaacugugguuggcacuaauagagaagcaaugauuuuguuuaauucuuuacaaagacaaaaauuaaaaaccagaaggagauaaagccaagaccacugccaaagaugaucuuucucuccaauguucaguaaauucuacucaacuccaugauucucucccacccugggccuccaucauucaaaugugaaaucauuaccuggauggugaaguaaucuguacacuaaacccuuaugauacacaauuuaacuauauagccaaccugcacauguaccccugaaccuagcaguuaaaaaaagaaaaugaagauuuuaacacaacccaaagggccaacagggaagcaucccuuuuuuccuuauagaaaauaguucucagaacuaugauguauucauccacuuuuuaaaagugaaaaauuuuauaaagcaagaaacuccucaaaaaggucacagauuuaucaugauguuaaaagucauaaaaauuauaguuacaggcuaaguaguuaaaucagaauuacacaccacccaauuaauuuuauaaucaauagagauuaaaggaaaugaggaaguaaaguaaaugauaggaucccagcuuaaaucaaaucaauauauauuuauugauagccaucccauauaagaugccaugaagaaggaaaaguguuauggaaauauguccuugucucugagcagcucaccaccuggcuggggaauugauauguaauaugcagagaauuuaugugcacagcaauaacaauacaaggggugucacaaggccucacacaagucaugaccaacagaaccauguagaaaagagcauuuguauuaaugcaauggucaagagccugggcuccagagccagacuuccuggauuugaaucucaacucuaccacuuauaagcucauugaccuuggacuaguuaugagucuuucagcaggaauaaaauagaaccugacucacaugaugauuguaaaaauuaagugagugaauacuugccaagugcuugcaaauaaggccuggcauacaauaauugccauggaaguauuaaaugggcaaaauacaauugaaagaagagaaagaucuccauugcucuaaagucucccaaaguccuaggacgguuuaagcagugacggaugauaucauguucauuuuccccuucccacgaauucccucccuacugcuacaaacauucuuaggucuagaccauacuaaagauuaaaaaugauaaauagucucuacuuuguaaacucccuguaaaaaauguuagacucuucuacauaugcaucuauuuaucacugcucacauucauucauucccuuauagcucaaaaccugacuccaaccccuaccauucuacagaaagcacuacaaaaacccuaaaaucuaaauccaacucccauuucuccuuagucaacacccucucuagaacauuacaaauuauucaccguuugaucaucacaauuuucuacuuccuaggcucugucauugccaucagaauuuuggcuucgagaaguaaggacugcucuuccucauaccuacaucucuuggcaugcaguagcauguucaauuaaauugcuuuacuagacagugcucucuacgacuuuuggucagcagacuucugagaugucccucaagauucuugccucugguauauguaacccauauaauuccucccucuuaaguaugggcaacacuuggguaagacggaguacacuucugugacuagguuauguuauacaacaaagguaaggggauuucucggauguaauuaggaugccaaaaucaauugacuuugaguuaaucaaaagggaaauuaucuugggugggccugaccuauucaggugagccauuuuaaggggcugaggcuuuuuuuucuuccuaaaggaagaaauaauucaaagccuaaaagaaauucuacugcuggccaugaaggagaaagcucucaaguugugagagggcuucaagagauagccauguggcggagaccugagagcagcuucuaggagcugagaaugaacgcugcgcaguagccgaaagauaaugggugccccaguccuacaaucacaaggaaacagauucugccaacaggagacagcucggaacuggguauuucccuagucaagcaagccuccagauaagagcacagucaacugacaccuugauuucagccuuccaggaccuuuagcugaggaccccagcuaaaauaugccauguuccagccuaaauauuccagcccaugaaaauggugagacaauaaauuucuguggcuuuaagccacuacauuugugguaauguauuacacagcaauagcaaucucccguacccucugccuucccucugucuuuuccucuggcuguuuuuucuugauccaacaccuaaauguggguuaauuuuuccuggaauuucuucuuucucaacacucuccaaagugauuaugccuaauugaguuacuuuaauaaccaucuauaugugauuauugcuagauuuuuagacugcucuucucucuuaagucauguccuauuuuuccuacugccugcuggucaauuccaugugggcacuaccaaacuccucauuugauaucucccaaaucuaccuuauuauugccccaucuaccucuugcucaauaucucucccuccuagcugggccaguccuguuaaugucuucuccauccucccaaucauuuaguuuguaaacaucacuaggacauucuuccucuccuguuuccauuagaaccaauaauuggccaacuccuguuuuaacaaguuuauauucaaggcuucuuuucuauucccaauagguacuagguuggccuuuuucuuccuaauuuauuaaaaccuuaguucaaaaucucuaaguauuuacaaguaggucuuccaaaguuaaugaaauuggcacaaccccaagagggcucucaaaguccaauacauguaaguuuccaaucucagcucugccacuuaauugcaaugaccuaaucauauuuuuaauaucuuugggucucaguuuccucauucaauuauuggagaagguaacaucuaucucacagggcuauuguauuacauguaaaggaauccaaucaaugauaacuguucgaauuauuaccuggaaucguggcaauaggacccauuucccugucaaucggacuugaaagcuuaacaaggccuucaauucuucuuccuauaucccuuuacugaaccaucaggguaaacugaaucaauguccuacuugguagcuucaucagagcacguuuugagucugcauccagauuguuaacucuuggaaaacauuagcaauauugcuuguuuauccuucuuucugugaacacugacuaccacauucagcaauaaacauugauaaagaaacugaagaguuguuaaaauggaaacuugacagcauaaaggaaaaaggacaaagaagcaagugacagggguaaaugcaauugguaggcugcaucuuagcuaaacucaaagugaagcaaugaugccccagcaggcuaagguuacucuuaaugagaaagucccuugggacauaaaugucaucacugagaucugaucuucuucuaggacaguuagaauuuucuuacgggagagaggcagauacuaguguuguucaccucaucacaugcaacccaaagaaaauacccaauaugaaugggauucuuuugaacaaagggaaagaauaaaaauaauuggauaugcuugacaacuuucaguuacucugcuuggccuuaagguguuaagaguugaaaaucuagcuuuuaccuagugcagcugaaaaucucucuauauaaugcaaaacuucaaaccaccuuaccaaagagaggacagcacugagaccuaguuaucucuuaggaaacuucgcaggcuauuacuuugaguacaaaacaaugacacaacuuuauuuccugccaaacacugaggguacgacauucauaaaaauuuuggucuaguuuaugaaaaauaaaccaggaggcaucaguuaaaacucuuauaaauaccuucuuuaagugauuuuaaaagauuucacugauuucuuccacuuaucaauaguaaugaaauaaaaaaaaguccuagaaaugguuacgcuuuggacaagauuugaguaagacauuaaaaaauucuauuggaagacugucccagaaaggagcaagagcuaaauauggagacaaaauucaaagaaacccaagcaaaaagaaggaaggaagucaggaggaauuuccugaacaggcacaacaacuucagacccaugagggaugggaaaacaaaagaaguucuagauggccuuaccagcuagagaacaagcaaacccuggcaagagccuccccaggcagcagguuuaacauggcccggcccuguuuaaggguaucuaucacacagugauagaugaugcucuaauaaggcucugcagggugauggagggaacccauaaacccaaugugguugggaugaggauggaacaauaaagaagagagaauaaaagguuacuaguuguugagaacccuacauguaauuuuauguauaauaguugacuuuauccccacaacaacuuucuaaaauaucaauauacucacuguauagguguggaagcauagguacuaagaggcuaagugaggagguggaagaagucauuggugagcaagcauuuccauucuuuccuaaacaccuauggaagaagcauaccucccugccuucacuguuggacuuggucaugugacucgcaugaaaaggcaacagaagaccauguaccagcuuaagcccgugccuuaagaaguuucugcuuguaccucugggagauacugacugacuggagaagaacauacacuuuccaggcaaacacaaagccaugaucauggcaccaaaaugagacauauggggcagagccgucuucugaccugcagauuugcaguauuaaaaagaugcccucagcugcucuguggagcugugaggauacaaugagacuguugcauuccacuggagaauagagcgaguaaccaguuuacucaagugucuaaaagugauuuuuucacuaaguaccucuuacuagcacuuaacacugugucuaaaacacaguagccauuuucugaacaaacauuaccuuuuuucuuccacagagaggaagaaccacagaaguauaauacagaaacccacuucugacuuccaccucaaaauucuaaauauaguaccuuuaugaggugucuuacuucugagccaacuugauucuuacacagccuaucccauuuuguucugguucauugugggucuaagggcaauauuuuuuuuucugccauaaacugcuuucuugcacuguuacuuuuacaaaucacauuagcuaaaaauacugcauuuuauucucuuauaucauucucucucuaaggcaggauacuucacucuucacuguauuuuuauaacucucaucugguauuuuuuuaugucuguuuucugcacuuaucuccaucaaguuuagauaacagucaccaacuucuugaugacucuaagcuuuuacugaacuuugggagauuacaucuauguaagguucgauguacucuacuaauuaaagaucucuuucuauugcuuccagcaguuuucauuccuugagauuaagccaauaguugcaaggguggugagauucagggcagugauaauucucaacuacucuaaagcaagauugcuccuuuuucucaguccugguuuugggccaggugcgguggcucacaccugcaaccccagcacuuugggaggccaaagugggcagauuacuugaggucaacaguucaagaccagccuggacaacauggugaaacccugucucuacuaaaaauacaaaaauuagccagccauuguggugcgcaccuauggucuaaacuacuugggagcugagacagaagaauagcuugaacucuggaggcagaggcugcagugagcugagaucgcaccacugcacucuagccuggaugacaaagcaagauuccaucucaaaagaaaaaaaaaaaaaagaaugaccauuaacuucauucuaucccuuacaugcaacauucuugcuccaucauuucuuuuuaugauguuggccuaaugauuuaguauuuaaguuuucuuuacaaacuggauaacaauuaacaauuuuauagcaaagcaggggcucucccaacucagaaccacugcucgcucacucuuauccguagaaucaauucaggaugcuuaguguagcugucgcuggcuguuucacugaccuaucucuugccgacagcucccucaaaacuaucuccccaccucccacacauacuugaaagggaacuaauguuuaugcuuucaauauuauuuaaguauauauuuuaauuauuucaaaucauuuaguauuuuacuggugaaggacgaaggcucaaguucuaucuuguccucggcuacacaugcaguaaaugacaaagccaucuuaccaaagucgggagucugcauuuccuaagcaccucacugacauccugcaacuuggcuuacaaacuucccucagcucaaaacgccucucaaacacccccuucuggugagcacuuacagacucucucauguccagcucagagucuucucuuaguagcuuuuuauggccacccugagacaaaauuaacuguugccccauguguguauccguggucuccugcauaguuuuauuagaggaaacaugcaaauacacuauuccucugcucaccccacugaccuacagcuccuuggcaguagggcuuuuauuuuuguuugcuuggguuuuuguucugagacagggucuuacucugucacccaggcuagagugcaguagcgcaaucuuggcucacugcaaccuccgccucccagacucaaguaauccucccaccucagccuccugaguagcugggacuacagguacaugccaccaugcccagcuaauuuuuguauuuuuuguagagauaagguuucaucauguugcccaggcuggucuugaacuccugagcucaagcgaugcaccugccuuggccucccaaaguacugggauuagaggcaugagccaccaugccuagucugggccuuuauuuuuaauucucaggacugacuauaguuuuugacacauuguaggcacucaacauucaacauccaauaaaugaguguuggaccuaaucuagauagcuacuacaauuauuaaugaaaaggaaagagcucugagggaacaugcuuccauccauaugcgucaucuauaauauacugauagugauaaaaacugaguguauagugaaaccgugguaaauauaucacuauauagcauuuuuaucuuaacacagagguucuuuuaaaagcuucugaggauggcuuaucaguacuucauaagcaagagacuacuagcaugcaggcaauuuacaaauaaacauaauucuaauuuucacagcuaaacaauugagaagggucauaggauccuuaaaaacuguuuaugaaaaauagcuccugccucaaauagcucacauggaucuacugggggaagcauuggugacaggaguaaaauuaacauguugccaaccuaccaaugugcuuuucuuggauguugucaccuauuaacaucaaaucaccuauacuuguuuauauuugauuaugguuuuugaaaacacauuuuuguguuuguuuuuuacuuauaagauuaaaacacaucaaaacauuugcuagaagaauugucuuuuuuuuuuuuacugugauaacacuuaagauacauacucuuaagaaaauuuuaagugcacuagauaauauuguuaacuguacacacauuacacagaucaucucuagaacuaauaguucaucuuccauaacaaacuuuauaucugucagacagaaacucucuauucaucccugcccccaucacuauccccugguaaugaccauucuacuuuuuugaauuugacuguuuuagauuucucauauaaguggaaucaugcacuucugugacugguuaauaucaucugacaugaugaccuucagguucaucuacauuaucuccuaugacaaggugaauaauguucauauauauauaugugggggguguacuauacauguauaucacauuuucuuuauauauccaucuguggaaggacauuuagguuguuuauguauuuuaacuauuaugaauaaugcugcaaugaacaugagagugcuaauauccuuugagauacugauuuuaauucuuuaaaauacucagaagugguauugcuagaucaugggguaaaucuauuuucaaaauuuuagaaaucuccauacaguuuucuauaaucauugcaucguuuuauuuucccaccaacuguuuagaaggauuccaauuucuucauacacuuaccagcacuuggguuuuggguuugcuuuugugacaacagcccauccuaacaggugugagguguccucucacugcgguucugauucacaguucccugaugauuaguaauggugaacaucauuucauauaccuguuggcuauuagcauguuucuuuggagaaauuucuauuuaaguccuuuugcucauuuuguaaccaaguugaguggauuuuuuuggcuauugaguuauaggaauuccuuacauauuuugcauauuagaugcaucagauguaugguucauuuuuucuccuauuccauagguggcuuuuccacucuguugacuguuuccuuugcugugcagaagcauuucagugugagguaguuucaauugucuauuuuuggugccugugauuucgguguccuauccaagaaauuauugccuagacaaauguuaaggagauuuccccauuuccuucuacagacguuauagauucagguuuuacuucuaaaucuuuguuucacuuugagcuuauuuuuauguaccacagaauacauuaaaauuggacccuuuuauuauaccauauucaaccaauuacuuuaaugacagugggugguuacuguauaccuugucuguaccguuucucucaaaauuugcauuucccuuugggaaucuuuugcaguuacaucccacuaucuaccucucagcauuuagaaaauaaauauuuucucuuccaaaucacuauugacagcaaaaucucaaaguaaauccauaugugaauagucacuuuuaaagaauaggcaaguuaaauacucagcaggaauaaaaaguacaacucugucuuucucuuucugacacauuuucuucccugcuuuccuccuucauccugugagaugagggauggcaggguugcauaggggauacauuugagguuuacaucaaucucacacagcagggugagaaugaucacacuauccuagucccccaccaggaccucuggaguaaugucacauuuccuugccacugaaaaugcuaccugauguacauuaccuugucucuauuucagguuuuaauaacaaauucaaacugucuuuucaaaccauuuucuuaaaugucuugacagacugguacuaguguuaccguagauaaaugccugcuuuauaccaaagagauaucagaauaauuucucuucaauuuccuccugcauuuugccuaauuauuuugaaacauuuuacaguauauuccuuggucccauuaaauuaaaauaucucuuucauucuuuacccauugcugcccacccaccaaaucauaguuucuacucuuuggguugucauuuuggaaauaacaucuuacuaacuacaacauucauaguuaaaccaaagaaaacagguaucauuuguaacaguguuuuuucuccacuguggcauguaucaaagaucuucuuuuuugguuuauuuuacauugucuccaaacaaauaaaucuaaaguuaaaauacaaaguauccuuaucagaccaccccuuaucagccacuucacagcaaagaugacugugugcugggccagcagcaggccauuagcaugcacagccuuuucucuuugauuugugcugaaauguaggcuauccaguucauacuagccuucagccaaagcccugugggaaguaacugcaaaccauaaacuuccaguccuuuacagacauuuguaauagaaaaaguaugcaaauagagccaccaacauuacuagggagucuaacuuuuaaaugacuuaguguuauuggacuugauuuguaaaugaaaaauucagauaugauggcaaggcuguuuuuaacaacucuccugaugugauugaggaguugauguacuauuggggaauuauauacuuuauaacguaauaaaaaugauuuuuuuuuuuaccagcaacuugauuuaugaagaauggugcacacgucugcugaaauaucaaaguaaacuuugguuacauuggcgaggaagcuaaaaggcuaauaccuccagggcacauaaaagcuuaggccuucuuuugguuucuuuucagggugaagauaaaugccagauugaguuacuuuguuuuuuaauacuuaaaucuaagacuuuaauaacuuuuauauuguaaguuaagggguacaugugcagguuucuuacacagguaaacaugugucauggggguuuguuguacagauuauuucaucacccagguauuaagccuaguacucauuaguuacuuuuccugaucgucucccuccucucacacuccguguucugacaacaggccccaguguguguuguuccccucuauguguccauguguucucaucauuuagcucccacuuacaggugaaaacguauaguauuugguuuucuguuccugcauucguuugcuaaggauaauggccuccagcuccauccuuaucccugcaaaggacaugaucuuguucucuuuuauggcugcauaguauuccauguguauauguaccacauuuuuucuuuuuucuuuucuuuuugagauggaguuucgcucugucauccagacuggaaugcaguagcacgaucuuggcucagcucacugcaaccucugccuccugggcucaagcaauucuucugccucagcuucccaaguagcuggaauuacagguaugcgccaccacauccagcuaauuuuuguaauuuuaguagagaugggagauuucaccauguuggccaggauggucucagacuccugaccucaagugauccacccaccucggccucccaaagcacuagaauuacaggugugagccaccacacccagccaguaccacauuuucuuuauccaguuuaucaaugauaggcauucagauugaguaacuuuuauucaacaauuuuucacaaguauaugcagugugcccaucaugccagccacuguccuaggugcugaggacacagcagugaauaaaacagaccaacagaagcucuaggcuuuuauauguccuagacauauuagccuuuuaguuucuucaccaauguaaaggaaauguuuacuuugauauuucagcagauguguacaccauucuucauaaaucaaguuguugguuuaaaaaaucauuuuuuauuaaaucaugaauguaaugucuguggccauacagacaaaaaacgcugccuucauggagucuauauucuaagcaacauacgcugcucaucuucacagaucugagccaaaagagguuucuuuuuauuucuaaggcauuaauauuaacucaggucaaauuuuauucauuuuuuacaaaguauggauuuuuaaaaugaaucaucauuagaaaauguuuaccuaaugucuaggaaaaacauuauuggucugagguucuuuuaacuacccaucuacuucacaaaauguuuugcugugaauuaaacuacacagccuacaggaaaagauaaaauccaaguauaaauaaaguaaagaacagcaccuaacaagcaccucguauuuuguacuuuccuauuugauuugauuauguuuucaaucucuucccccuguucacaggagaggccaacuaaaaccuaaaguuuaguacaacuuucuggaaauucugcaaaguggcaaacaaacugagaaaaucguaugccuuaaaaacccaucacugauguucuugaucaauaguuggcauaaauaaaucguagacaugugggcaagacugcuggagccaggcaaggauuuuucuuaauguggacagugaugucacugaggcagagagaaggaaggcauauuuacaauaaaagggagugauuauacaauacauuaaaaccauaaauaaauacuccauuaaguuauaaaauucucucuauauguucuuaggaggccuuccugucaggcacuuaacuuagagaaaagcaaguaaagcuccauuuaucauucauuuagccaaaacuugcugaauccugcucuaugcccgccaugacacaucaucaucacuacuguguauuaagaguuuacuacauccuaugcacugugcucagagauuacaugcaucaucucauuccagcaaugaucaacccuauaagcuggguguucuuuuuaauaaucauuauauagauuagguaaacgauacucagguuguguuauuuaucuguggucacauggcaauuaaauaaucagaugucauaugaggguauguaguucuaagauauaaauucauauuuauguuacuaaauaaaggccuucucaugcaaaacaaucaacaucuaaauucaggggaaauccagaccuauauucuaaaaauauggaguuaauagguguuuggcugacauacuuuaagauauucucuaccccaugcaccaaaaucaugacuagucacuugaauuaauagauaucuacacacuucaacaacagcuaccuagaauaauguaucaugguaauuuacauuuuuuaaaauuaagauacaguaugauuguauaaacauauguaaacuuucauauagucauauuauauaaaaagauucuauauaauuacaugaggcaggauaaguagucaaggaaguaaucauguccuugggauauggcaacuguggcaaccguacagucaaaacaauaagccccagcauuugcaccguaguccagcucacucaagcaaagcuaucuccaguagggaacuuccccuggagggagcaugcacaugugauuucaccuguccucagacugacccugugcugaugauaauagugaaaaacacaccgauggguggagauuuaagaugcuaaugagacauguggcacauggacaagcauguacagcuacugcacaugugcguccagacgaccacccagaacaugcuuacuaguaacacugcuuuccaccuccuuaugaauaaucauguaaaacuccccaaaacucccuauugccagucuuugcugucucauccuuacaagcagcccacccugaauucucugucucucaggguguacugucuauuccgcacuuaacuuucaaaauaugcuuuucuuuugcaguaaaugacucugugcugcauauccuuugcugugucuuguuuaauuucuuuuaaacuaagaagaacugaggucucacaacagccuucaaaaauuacacacuguuaacuuaaauaacaacuugacaguucaaauuuaaagagaacuauuccuguuuaauaaucaauccccuuuuuacuaagacaaugggaaaauaacauucaugcugaucaccaacuaaccacauuguuggguuaaaucaaaccucugcaauuccuuugagaacauaaugauguccgugguacccagaacaccaaaauugccuagacuaccuucuagaacacuguacaaucuaguuccaucaccucaguuguauguuuaccaggaaaauaucaauucccaaacccaucauacuuuuaguguauuuacaugauuuaagaauauaagagacugaugaaauaugcggaagaaaauagagccauugcuuccauuacuuuuuucgaaagaugagauaaaucgaauuggugagagugauuggcuuuauauuagauggagaaaucuuuacaaggugagaaagaugauuacaaaagcccagaagaacugugccuuagacugcuuugcaggcauccaaguuuuuacuccacuuugaaggaaucaucacuggugcacaguggguaacauuuauuugagaaaguagaggugagacuccaaccagucaauucauauuuaaggaggucuagaaccaagaauuaccaaacagaugcacauuauaauguccuaaaaacauuuaaauagcauuuuuauuucuugguaaagcaacauuuguugcucuagccaagaguuucaaucaacugacaaacuagaaguccuaacugauuugaauaaagggcuucuacugugcucugugcaaagccuuggguagcuagaggcaagauucucuagcaacacaagcucuacccaccccgguuacccacuucagaacccugcuuuuaguuuuggguacggccucgaaggauuacaggugaucagauggaugacauccugagucaucagucagugauuccuggucucagucagugauuccuccaggcacaucucccuucugauacuccuaaauaccagaacagcagccugggaaaagagcaaguaacacucacuucucucugggcaucaugugucucccaacccuugagugucaagaaucacucuuuucuaaacucccaggcuccucaaagagcagaagugcaggcauauaucauuuuagaacggaaggaauauuccagacuugcugcucaagaaacaaaagaugcaagugucuuugggcuuguucaaaaguacaccccuucuuucuuugugcugugggcaagagaugcacaugccagucuaaaugaaccacugcuguguuuauguucaugcugcguuccaucauguuuccaauccuuuacucuuucucaccauuuacugagguacucucaccccuacuucacaucgacagccccacagcuggucauccucagucacagucuugccaguucuaagccaaccuagcccccagagucucauuuuauaugcacaacagagguaggcgcauuguccauuagcaagucaaagacuucuuaaaucacugaaugguuccuaggcuucuuggaaugauuucaggaacaacuugcugcccuugguccacuucucuucccuauccaaauuucaaacaaguaacugguaucuucccagucaucaguucccaagacuagacuuuucucccaaucagggaaauugggcuuguuacauuuccaugacaugucauucugagugcccuguuacccgucucuaucuggaagaugguauauaaaugaaaucauuuacacagugccauucuaauuuugaaaggaauuguaggcaugucaaauagggcucauaccaaauaauaacauucuaaauaauaagagaggccaccaauugagguauaauauguaccagguccuacgccuguaacuuuaccugcacuaucauuuaauucgcucagcaauccuauaaaguacuauugauaucuuaccaugaggaaccucagcguuaaaaacuugcccaaagucacaggucauguaaacucauuuaugucaaauuuccaauccaaacuauauaacccaaagacuccccaaagguaaccaaacagauaaaauuuauauaaauccaaaguuuuuuucuugccugucuuucugcaauauucaguggggcaauaaaucucuggaaucugucauuucaguauauuuuuaauaaaguagacucuuucacacacucuccuggaaccucucuccaguugcucagcuuggaggaacucaaccaaaguacaaauaacauagggcaauaagugauacuuagaauuuaagaugcuuuggguuuuauguuggcauacgauucugauacucuaccaaauuacaacccagcaagagaaauguauuaugaacuugugugauauaauaacaaguuaaaaagagucauccuuucuuggaaaucagcauguucaccccuuuuguuuuugcuuuuguucuuagaacuugcugcuguaccucuugcaaagucccauaagguagaaccaggugauaucacuaucuuuaccugauacaggagacagaaaagaauuuaaaaaaaaggccauuuuacacagaagggaccuaauucugaaugauucaccaauauucgaugaaucacugaugagcuauaccuuugcccucuucagauuccuucuuggcuguacuaccaguaaguuugaccaugucaaugcagggaguuuacucacauaacuguacaaguuucuaaaaaugucuagcaauaaauauauuauucuuggaaguuauguucucgggaaaaagaggugucuccacuuacuuaacaaugaaguagcucacugaaucauuuaaauagugggcugaagaaaacaacaaaaucuuuaaaaaacaauuuaucaucucaaacuucuccuugaacaacuguuucuuuuuuauuuaccuuagagaauaggcaaaggaaaauaaaaucacuuaacacauagagaacucaagauagagacacaccuuuagaaagagucacauacaaacugguuaguaaauuaggcuauugucuuauaaaaguuguuguaaaucuuaggccaauacauucuugaagaauugauauuugaugcaucuguagguauuuauauauauauauauauauauuuguauuuauauauauauauuuauauauauaaaaauauauauauauuuauauguauaaaaauauauauauauauauauauauauauauauaucaggucauuuuuccucccgcucauucuuuuuuuaguuguguuuuuuuuuuuuuaauuuuaagagacaaggacucgcucugucacccaggcuggaguacaguggcaugaucauggcucacugcagccucaaacuccugggcucaaguaauccuccugccuuagucuuucauauaccugggacuacaggugcaugcuaccaugccugacuaauuuuuuuaacuuauuguagaaaugggaucucacuguguucccugugauggucuugaacuucugggcucaagcgauccuccugccucagccucccaaagcacugggauugcaggcauaagccaccaugcccagcccuggucacucugaaaggaaugucauucucuuuuuugaaaagagaugugauuucauuauaaugccuaauuguuuugccacauaccuaagguuccugauucauccuccuaagugacaaagacuuuuuacauagaaucaaaagaacuucugguggugggaagauggucuauagaaaagaaaaacuccccccaugccuauguccugaaugguauugccuagguuuucuucuaggguuuuuaugguuuaagaucuaacauuuaagucuuuaauccaucuugaauuaauuuuuguauaagguguaaggaagggauccaguuucagcuuucuacauauggcuagccaguuuucccagcaccauuuguuaaauagggaauccuuuccccauuucuuguuuaugucagguuugccuaagaucagauaguuguagaugugugguauuauuucugagggcucuguccugucccauuggucuauaucucuguuuugguaacaguaccaugcuguuuugguuacuguagccuuguaguauaguuugaagucagguagugugaugccucuagcuuuguucuuuuggcucaggauugacuuggcaaugcgggcucuuuuuuggucccauaagaacuuuaaaguaauuuuuuccaauucugugaagaaagucauugguagcuugauggggauggcauugaaucuguaaauuaccuugggcaguauggccauuuucaugauauugauucuuccuacccaugagcauggaauguucuuccauuuguuuguauccucuuuuauuucauugagcagugguguguaguucuccuugaagagguccuucacaucccuuguaaguuggauuccuagguauuuuauucucuuugaagcaauugugaaugggaguucacucaugauuuggcucucuguuuaucuguuacugguguauaagaaugcuugugauuuuuguacauugauuuuguauccugagacuuugcugaaguugccuaucagcuuaaggagauuuugggcugagacgaugggguuuucuagauauacaaucaugucaucugcaaacagugacaauuugacuuccucuuuuccuaacugaauacccuuuacuucuuucuccugcugauugcccuggccagaacuuccaacacuauguugaauaggaguggugagagaggacaucucugucuugugccaguuuucaaagggaaugcuuccaguuuuugcccauucaguaugauauuggcuguggguuugucauaaacagcuuuuauuauuuugagauacaucccaucaauaccuaauuuauugagaguuuuuagcaugaagggcuguugaauuuuaucaaaggccuuuucugcauguauugagauaauuaugugguuuuugucuuugguucucuucauaugauggauuacauuuauugauuugcauauguugaaccagccuugcaucccagggaugaagcccacuugaucaugguggauaagcuuuuugaugugcugcuggauucaguuugccaguauuuuauugaggauuuuugcaucgauguucaucagggauacuggucuaaaauucucuuuuuuuguugugucucugccaggcuuugguaucaggaugaugccggccucauacuucaugucuaaaacaccaaaagcaauggcaacaaaagccaaaauugacaaaugggauccaauuaaacuaaagagcuucugcacagcaaaagaaacuaccaucagagugaacaggcaaccuacagaaugggagaaaauuuuugcaaucuacucaucugacaaagggcuaauauccagaaucuacaaugaacucaaacaaauuuacaagaaaaaaacaaagaaucccaucaaaaacugggugaaggauaugaacagacacuucucaaaagaagacauuuaugcagccaaaagacacaugaaaaaaaugcuuaucaucacuugccaucagagaaaugcaaaucaaaaccacagugagauaccaucucacaccaguuagaauggugaucauuaaaaagucaggaaacaacaggugcuggagaggauguggagaaauaggaacacuuuuacauuguuggugggaauguaaacuacuucaaccacuguggaagucaguguggcgguuccucagggaucuagaacuagaaauaccauuugacccagccaucccauuacuggguauauauccaaaggauuauaaaucaugcugcuauaaagacacgugcacacguauguuuauugcggcacuacucacaauagcaaagacuuggaaccaacccaaauguccaucaaugauagacuggauuaagaaaauguggcauauauauaccauggaauacuaugcagccauaaaaaaaugaugaguucauguccuuuguagggauguggaugaaacuagaaaccaucauucucagcaaacuaucacaaggacaaaaaaccaaacaccgcauguucucacucauagcugggaauugaacaaugagaacaccuggacacaggaaagggaacaucacacaccggggucuguuguuggguggggggagugggagagauagcauuaggagauauaccuaaugcugaaugacgaguuaaugggugcagcacaccaacauggcacauguauacauauguaacaaacccgcacauugugcacauguacccuagaacuuaaaguauaauaaaaaaaaauuuuaaaaaaaaagaaagaaaagaaaaacucugacuccauugucuugaaacuuuguuuuugccaucuaauuccuuaggcacaauuuucuggcugaggagaaacugcccaaagacccuaguuccguuagauugaaaagcgaugaaaggaacagugcaauguuuucuugauggggcacuauggccucaccacagauguggcuuaguuaccugagcccuaccugguaacuccauguggauuaccauaaguacucuaaaauaugguaaucaaauacuaaugcacguaaguauugcuuggaaaacagaguaagacaguuuccccggcccuaucuccagagauucugauucacuaggucuggguggggcucaugaauuugcauuucaaauaaacucacagaugaugccaaaugcuagccugaggaccacauuuugagaaucacucuagaggacugggauuccaaagcacucaggguaaccuguaucacagacuguaucuaaaauguuguucuuggauuacaguggucuguagcuuuaagaagcaauuaugauacguuucuuaccaaaggucaucaaagaaagcacacugcugugauggcaagcuauccacuuuuauaaaaagaagaagaagaagaaaaaaaaaagaaacaaaguaauggcucuucucuuggaacugagagaaagcugacucugguuuacgaaggccuaucucauuccugaucguuuaucauuugagagaggugugaacagucuaugucaaaaaugcucauucaacauucccaggaagccacucacagggcugaauguaauuuuacuuaagccugucugaacuugcuuuucuuauuuuucccccuguagacacacgauuuucuuucuuuguaagaaagaauucaaagacaaagacacagaugugauuucaccaaacuagcaaacuuuaaagcaaaaaaaaaaaaaucauccauuucuguuuauagcaagacucccuguuaucccucuacucaucuuccuaugcagagagaaaaugugaaacuguaauagccacucuucaagacugauuaaauaaaaaucauucaaaagccuguguugauaacauauuccuaucuuuugugugcaaauccauauuguguuucuuggaagaccuaauauccuagaaaaaauagaccugcuucuuacugaaaagcagcaguuggaaacugaaaugccuacaguacaaguaguaacaaaauuaauggaccaagccaggagugaagcaagggaggguaggagggacaauggaguucuugagaguccuggcauuacugggagaacugcaacuaauuagcuucagaaaaaaauccaauucugauaaugccaauuggggcaucauugagauucuuuccauuuuuuguuuguuucucuugguccucuuucuugaugugucugaggauuuuaaguagaauuacagaagcugugaaugcagaauuauagagacucugcaugaugguaucucccaccaaagaagguucauccuacucucuggcagccagucugaaauggggcguuacuuucauccaauuuggaauugaguugacucaaagcugguuaguguuuugaaagaugugguccaccucugguuuacacacacuccauaggugugguuuaaggccugugggguacacuaguacaccugucauucguggaugugcaacucuacuuauuuuaaccucagcccuaggagacuaucaaaaacacacacaguggcucacaccugugaucccaacacuuugcaccaagguaggaaaauggcuugaagccaggaguucaagaccagucuggucaacauagcaagacccugucuccacaaaauacuuaaaauauuagccagguaugcucaugcacacuuauaguacaagcuauucaggaggcugaggugggaggacugcuugagcccaggaguuugagguugcagugagcuaugaucauucuacugcaauccagccugggcagcagagcaagacccuaucucauuaaaauaauaauaauaauaauaauaauaauaauaauaauaauaauaaaaagccuucagguauaaaucuacccaaggcacccaucuucucucuuaggucuugguuccucugaauccuggcugcuuuggcagacccaaacuucuaugcuugucucuucagccuuaugagaucaccaaaaauuauguugcccacaagguaugauuuucuagcugccuguuuucucaacugcuccuugagccaaaacccagcaaauucccugaagggaaaagcagccuguggacucccggcucagcacucuauaguucccugauuucugggucucuugguugucuuggcaguucuuuguuaucuucaaauuagguuuacauguggcuuuucuauuguuuucaaagaaacaucaguuugucacaagccacucuaauuuagccaaaagcagaaguccucagguuaauuuaauagaguaauaauauaauuacuuccccaagaaauaauguuuuuauucugaauaugagguuaaauucaaauuuaaacuuaauccauauguuacauaggaauuauuuuguuaagaauuagcuucaaauaugauaauacacauauucuauuccaaacaacaugacaacucauucuuaguucaaugaucucuuuuaagacagauauaucaagcaauuuuuguaaucugucagcaggccucaaagaaacuucaaauaaccauaaaucaguguuaucauuuggaguacuugagaugcucuagauaaauauuugaugguagauggacacuaggcagaggaauaguuucaucuaauacaauaauaaaaaaaaucacaagacacccacuaguaaguuuaucagggagcaagauggagaauguugcugacagaauaccacuccugcagcugccaguaauaauucacccuugaagcaaagagauggagauuuaaauggggacacuauccaacuuaagccuuucuguagaauauaguguccuagaugaagacguauguaguaaagaugggggaaaugaccaaauuauucgauuaccauguguuaccuccaacugggacuuccaauauuccugaaaauucaccugcagaagaaaguaaaagagaaacaacaaauucucaccaugaaaugauuuugaaugcuauuucagaauauuacccuguuagaucaucucaucaaugaauucaggggcccucuauuauguagguagcucaagaacguagcagaagccuuggaagggacuguccaugguggauacugaccucaauugcucucggauuauaacggacuauagcaguggaucucuugagagggcuuuagucucuuccuuaacaugcuuuuaucccagggugggauuacuaagaucaaaugcccaggcauucaaaugauggagauguagaaugguaucaaguuuggcacacauccuaaccaauuaauugguuuucauaauuaucaaguguuaagauggagucaaaaaaaaucacacaaaaaaacuuaggucuaaaagcaaacaaaaaauaauuuuagcuaugugugcaguaucaagugguaucaacugauguccaaaaaauaaaaagaagagcauuuucuguaugugguaggcacugugccaaggauauuacauaaaaucugcucaucuucacaguaacucugaauuaaauaccgucauaauccucauucuuacggauaaggaaaaugaagcagagaguggguaaguaauuuagucaagguaguaagcagagagagacaaccugaacuagcucucuggaugcaacauugaaagcucuuaaccgcauugcuuuacuggccuccuggacagcauugaucauuuucccugcacuuuaagaauguaacuacggauuauggacacgugccuuuccuagcuauucuuaaauucugagcuuaauauaaaauuaaugacauccugggagccaugauucuucccuacuacaucucacuaagaacaugguuuaugaaaucuuuauagcuaguugaaauguguuuacuaagucuugccaggaagcucauuuuauagggauaucacacacaggcaauauaaauuccuauggggcuaagaagccuucauuccaaccagugcuuuuccuccaaguaauucgguagguuuggaaaaugaagcaucuggucugcucuuuuccacaaguuucuaagcuugaauaaagaucacucacuugauacagaaaggguuggaaaaauuccagaucuggccucugaagguuacuucccagaaugcggcuguuaacuaccuauuacuguuuagaccaaguaucuuugagagggaaaaacucgcuuugauugccuagguacuucaagcugcaaaucugcauuucagugaacaacuacuaaguaagcagacaggaaagagaaccagugccccggucuguaugcaacaucuuguucuagccuuuugugccgaaaagcuaugcaacugugagaaagucacacuguaagccucagcuuccuucucaauaaacugaagaugaugaugauguucuuauaaagguagcguaagugaaagcacuuagaaguuauucaaauaugacaucauaugcgcauacacacacacacacacacacauaugcaguaauguggcacuuaauaauggagcuauguucugggaaaugcauuguuaggcuauuuuauugugccaacaucacaaacuguacuuacacaaaccuagauggugcagccuacuacauacccaggcuauaugguauagccuauugcuccuccuagauacaaacauguauagcauguuauuguacugaauacuguagguaauuguaacacacuggcaaguauuuguguaucaaaacauaaaaaagauacuauaaaaauauggcacaaaagguagcuggcguggugacucaggccuguaaucccagcacuuugggaggccgaggugggugcaucacaaggucaagagaucaagaccauccuggccaauauggugaaaccccaucucuacuaaaaauacgaaaauuagcuaggucugguggcacacgccuguagucccagcuacucaggaggcugaggcaggagaaucacuugaaacugggaggcagagguugcaauaaaccgagaucggggcacugcacuccagccuggcgacagagcuagacucugucaaaaaaaaaaaaaaaaaaaaaaaggcauaaaagguagaaaaugaaaaugguagaccuauauagagcacuuaacaugaaugaagcuuacgggacuagaaauuguucugggugagccagugagggaguggugagugaaugugaagaucuaggauauuauuguaaacuacuguagacuuuaauaagcacuguacccuuaagguuacacuaaauuuauuaaaaaauaaaguauuaauaauugcacuaugacauuacaaugucuacgucaacacugggcaauaggaauuuuucaacuccauuauaaucuuauggggccacugucauauaugugguucacuguugacugaaauguuuuaugguacauaaauauauauauauguguauauauccccaagauauaaauauguauauauaucucuaagagcugagcugugcauauuauccagguccuguauagaacuguauagaacuaugcaagugacaaagcagaaaagaauaaacagaaaaaguccauuaagccacuccagaggaagugaguuugagaggggaugcuggauuuucauaaugagagaaagauaaugcagagcaggaagagagauuuuaaaaaaugaggagcugcaggucagcuacagaaguggguuccagagaguuccaguaaugccagcacuggguuaaguggggaauuuggggaugaaauaacagcagacaaugccucacuuauuaauggaaaaucauuugauauagaaaaguugugugcaaggagccauaaaccaaaaacaccaacaaaaaccauguuuucaagaaggaaccugcuuguaacgagccagugaagguauauaccaauuuaagaauuagguacuagugacuucgaauuauuuaacagccagguccauauagagaauaaauaguagacuauuuuucucauaugggcuauuuaagugagagauauaagcagauaaaacuucuuaauuaauugcuuucaauaguuuagaguuagaauagguauuuucaauuuguauaaugaaaacuuguuuuuaggaguucuugggccaacgaagaaggcaaucgcaacauuaacauaguuugaauuaaacaucgguaaaacaacaacuaaugaaaagcccaauauguuuuucuuacuacuugaaaaaauauuuuuacuuuauuuuuuuuaaccauuuuaucaaaugguuaucaggggcccagugcuccugaagucaauaaccaagguucagaaaucuuuacccuuuugcuuuuugggaaacguccuaagccacgaaaaccaacuugccguugcauaucauaaggcccaccuccagccuuccugguucccuguguuauaaaucuucaccuuuucucccucuucuuucagaccuucuucauuucugaacauccccccacuucaauaacccgaauaaacucaucuccuuaauggacugguacaucuugucuuugacauauuuaacuguuacaagaauuccagaaaacugauacuagaaaaaaaugaaaccauauaguacauacacuuuuggugcuauuuuccagaaguuguaugaaugcaaaaucucagguaaacaaaauuucauaaaggauauuaaauaucaguugauuauacuagugccacaaucccaagaaagaauauaaguaucuacggaaaaucucauuuugcacaaagauaacuuaguacaacuaaaacuaguucaacuuuuuuagaaaaaacauuaagcaaguaaaccugacucuccaacuaugagaagcauuccaaacugagcaugaccccauagguagcacugggagauugcauaaggaccagaagguuucuagcaauaugggaaaaaaagaaaaucacagcuuuagcaaaggaacaaaguccuaacuaugaagaugacuuaaagauacaauccuuaggcccacaugggacccugaggccacccacuuccaaauuugagacucccuuaaucucaaauccgagccacaauucagugggccuaacuccaauugaugucucaagacuuguaauuuucuacaaguuuauugcuuucccucugagcaaauaaacauaccacacuuuauuucuauacuucugugagauuucucauauaaauaaaugcccaaaucuugggaggagaaauacuguaaccacauaucuucauuucaggcccugcauaaaucaauuuacagugcaacucuaagguaaaaaaaugcagcaauagcagccacacucaauaauaaaaucacacuaauuuggacuaauaauuaguaaccuacuuccugagcacugcaccaagcgauucauaugcuuuaucucauuucaguaucaggaaaacccuaugaagugguuuaaaguggccccauuugacagaugugaaagguuaggaccagagaggcuuuacuguguacccaagaugacuaaauuauuggaaaguaagugguaacauaguaauuauuaagaaaggauucaacaugcaucaccguuauagucaaaagacauuggaauuuacaugagaccaauagaaugugaccaaauaaagauauuuaaaugaccaguuuaaugaauucaaaacaaugauuaguaauuaacacaucaaucuuugaaugucaauggauaauucuaaagugcugcagcuugcuugaaaagugccuucucucaagcugauuaaauauucucuccaaaaaucuuguuuacauuauuaauuugcucaauaaccccugucuucagagaaguguaaaccucuagcuggucccugaagaguuagcacauauuuuuaauuaaaauggucuugaaucaauugaguuauuauuuuuccagguuauauuacuaacaauauuaacuccaaauaagauagauuaaaaaacaagguacauugaaaguaugcaaauguaagugucuucaacaaugaaauaucuaaaguucauauaaagaccugacuccaaauuaugaaaaauggaaaauuagucauuucuguaguguacacgaaugauuugcaacagcaaagaauguaaggaugugucaaaaguuuacaaguucaaaguacaaaaugaacacuuccuuuaggaaaugcuaaaacaaaauuaaauaccauuagaaagauuuugacacuuugcucuuuuaugagccaaauuacaguaacagaguugggaauauaaugaugcaauuauacgcugucaugaacaguuuaauuauuuuaugccugagcagauuuuuuuuuuuuuuaacucaagugcccuauacaacuuccacaccugaaugcuucuaacuuggcuuugccauuuucugacucuauuuaauuuucuggggacacagaaggaugguccuuacuuuaaaaaaugguucuaucaaaauucauucucuucacuuuuaagcucuuaaaggcgagguaacaguuuuucagcauacacucuccagagggcuaaacucauucauucauucuuuccaaugcuccaaugccuccgccaggccaggcaccaggcuaggaugcaacauagauagaugugggaagucaagggagaugacugacaaacgaggaaaaugaaaaucaacaggaaguuguaaaacauaaaggcagcuaugggucaugucuaugccuucagguuucaccaucaguccuguuuuaaauccuagcccugacucuauguaaguauuucagcucuaaguuaaucucuucaccaccuggaaaaugggggccaugaagaucucucccucacaaguugugagguucaaaugagaugacgaugcaaaucuggcacauaguauaugcccagugaauaucagcagcuaccgaaugauaauaauuguauuuuuauuacuuuuuguauuaucauaagugucacaauaagcuauauaaagcaugcuaauaagaacacugaggaaaagcaauaaaucuuccuggaguagcucauuccgaacagacaaaaguuucaggggagagagggagauaaugcugaguaaugggucuucaaucucuaugagaaaaaaaaauaaccuaagcauuguucaagagaagaugccauguucauuuaaaugacuauuucaucuuaagaaagcagucugagcuacuaaucaaaccagaacccuagccaugcugaugaugaucauuaaugucaucauccauaaauucauuugcugugucacaucuugguguaggaauacucauuuguuacaguuaugucuucaguuugaugugaagagaaagcaaccauaaagcaacuucaaggaagcuccuccaaauaauuaaaauucugaagcauuccucaagccaaaagcagaucagacccucacugagggcacuuucuauuaaauaagcaggcugcuauuuguuguucuugcagcacaaguccuugagcucacaaaucccacagcaccaaaagucauuauuuuuuaaccaaacuuuuuuuuuuuuuuucuugagacagagccucacucugucacccaggcuggagugcacucgcaugaucucggcucacugcaaccuccaccuccuggguucaagcaauucuccugccucagccucucgaguagcugggacuacaggcaccugccaccacacccggcuaauuuuugguauuuuuaguagagaugggguuucaccguguuagccaggauggucucaaucuccugaccucgugauccacuugccuuagccucucaaagugcugggauuauaggugugagccaccacgcucagccuuaaccuaacuuuuaaaguccuaaauauaucuucuuaauaaaagggccaccauuucuugugcacaucuggagcccuuucugggcacuagucacugugcaaaaguuguuacacacauaaccucauuucccacaauccuucccaggagacacuacuuauccaggguuguaaagauaaggaaacugaggcacagagauuuuuaagucacuuacgcaaguuuuaccauaacaaacuuggguauuacccaaguuuaauauuaccauaauaaacccaaguuuacuaucaaacagcagagcucugauaugaacccaacuuugaacucaaugucuuuagugacuauauuauaguaugaguaccuugagaauauauauauuuuaaauuuccuuauuuuuaaaaaacaauacucaaauucaaaauacaaauuaagauggggugggugagguagggugaggggagugaauggaugaaagaagggaaaggaaggcaaauuauccagccacuacagucagauguuaaaguagaauucagauaucaaccccaaucggguuggguuuucauuaugaucagacaagacucuucuugaccaaagacugaacucaauuucuagucaaugucuuagauaacaagggcccucauccauuauuagacuuugaggucuuuucccuccaucauugagcuucagcucagcaaucuuacggccauuuacaaggugacugaugagccuucaucauaaaacaagaugaaagcaacuugccuacaugcacgucuucaaaaccaaccaaaugaaccaauuacagaacaaaaccaguuuagugugaggaucaaaaugugauaauguuuuguugagcacagagauaggcacauaguggguugcuuguuuauuugcuuuaguaugaauaauaauuauuauggauauuaucaggauuccuaaaaagagucauuuaacuauuaugggaacaauauaauauacuagaugcccuuuccucaagguuaugcaaccuacaugggaaaauaacuaaaacaaaugaguagcuucugcaauuaaggauccugagaaugacuucccugcuugauuugugguaguagcugcaugcccaaauggaggaaaauuauuugaauaaacauuggucaguggggagaagugaguuuuaggacuaggcugcuuucagagaaauucaucaagaggaaaaaaauacauaauuuuaagaagucaaagccuauuauuagaaaaauauguucaccaaaugcagcucuaauaccuuuagcaaugagauaaacugagucuagcaagugguuggacucauaaugauucgauuucuuuaacuagcccauuaauccaaaagauggccaauccacguucaugaagacacugccagugagcuagaauaucugaaagaguuggcauaaaaagcuccaccacaugcaauuaauccacaucugaucacaugccccugaauaaugucagcccacagauggguuuguacacacaagauacaguguugccuuuaaauauucacaaauauuuuuaaaguauaacuuuuuaaaaaacauauaugacucagaaagaacagaaggguugcacaacucccagauaucugaaaugaugguuaccgacaaaucuucacugaugcuaaagaacauuuauuucacaccuacucugccacauucacucccacacacuuccccaaaccagaauugaauuguuacuucacuuucaugcugacuucagacauaauugucacuucugcaaggucacacuuuggggaacacuauguaccuucuuaaauacaacauuaauuauggaacuaaccuauuuagucucuugcccuaaagacuucagcauuuaacucgacuuccccauaguuuacuguaucauagcaauuaaguuaauggcagcagcagcagcagagaaucuuuuaaccccuaaugggcuuguuccucugauuagacuagaucaaagaagcugcagcuauuuggaggcagauuagagaggcuucuuuuuuacugauaucagcacugaagaguggaagaucauguguguguugacaucuuacccaaauccauccaugacaguuuacacugaaguuauucuuaaugaagacuuuuaauacaucaagacuauauggaucaggaggcaugaaagcacccuuacauucaaagagaauaaaauaccuaggaauccaauuuacaagagaggugaaggaccucuucaaggagaacuacaaaccacugcucaaugaaauaaaagaggauacaaacaaauggaagaacauuccaugcucauggguaggaagaaucaauaucaugaaaauggccauacugcccaagguaauuuauagauucaaugccauccccaucaagauacuaaggacuuucuucacagaauuggaaaaaacuacuuuaaaguucauauggaaccaaaacagagcccguauugccaagucaauccuaagccaaaagaacaaagcuggaggcaucacacuaccugacuucaaacaauacuacaaggcuacaguaaccaaaacagcaugguacugguaccaaaacagagauauagaccaauggaacagaacagagcccucagaaauaaugucacauaucuacaaccaccugaucuuugacaaaccugacaaaaacaagaaauggggaaaggauucccuauuuaauaaauggugcugggaaaaccggcuagccauguguagaaagcugaaacuggaucccuuccuuacaccuuauacaaaaaugaauucaagauggauuaaagacuuaaauguuagaccuaaaaccauaaaaacccuagaagaaaaccuaggcaauaccauucaggacauaggcaugggcaaggacuucaugucuaaagcaccaaaagcaauggcaacaaaagccaaaauugacaaaugggauccaauuaaacuaaagagcuucugcacagcaaaagaaucuaccaucagagugaacaggcaaccuacagaaugggagaaaauuuuugcaaucuacucaucugacaaagggcuaauauccagaaucuacaaugaacucaaacaaauuuacaagaaaaaaaacaaagaaucccaucaaaaacugggcgaaggauaugaacagacacuucucaaaagaagacauuuaugcagccaaaagacacgugaaaaaacgcucaucaucacuggccaucagagaaaugcaaaucaaaaccacaaugagauaccaucucacaccaguuagaauggugaucauuaaaaagucaggaaacaacaggugcuggagaggauguggagaaauaggaacacuuuuacacuguugguaggaauguaaacuacuucaaccauuguggaagucaguguggcgguuccucagggauccagaacuagaaauaccauuugacccagccaucccauuacuggguauauacccaaaggauuauaaaucaugcugcuauaaagacacaugcacacguauguuuauugcggcacuacucacacuagcaaagacuuggaaccaacccaaauguccaucaaugauagacuggauuaagaaaauguggcacauauacaccauggaauacuaugcagccauaaaaaugaugaguucauguccuuuguagggacauggaugaagguggaaacaucauucucagcaaacuauggcaaggacaaaaaaccaaacaccgcauguucucacucauaggugggaauugaacuaugagaacacauugacacaggaaagggaacaucacacaccacacacaggggcuuguugugggguggggggaggggggagggauagcauuaggagauauaccuaauguuaaaugaugaguuaaugggugcagcacaccaacauggcacauguauacauauguaacuaaccugcauguugugcacauguacccuaaaacuuaaaguguaauaauaauaauaauaauaaaagaaaucaccguuauauauuucaggcaaagguacccaguagcuuuagguuuuuaugcccaucugcuuucucaacacaccuugaccgccaacucuagaugucaaaagcugauacaggagucauacaucauucaauuacguucuucaugauaugggggcuaugugcauucuacuauauauauuuuuaaagacauggucucacucugucgcccaggcuggagugcaguggcacaaaucacggcucacugcagccuugaacuccuaggcucaagggauccucccaccuuagccucccaagcaagcugggacuacaaauguacaccaccacaccuggcuaauuugucuuauuuuuuuuuuuuuagaaacaaagucucacuaugcugcuagggcugguuucgagcuccugggcucaagcgauccuccuaccuuguucucccaaagugcugggauuacaagcaugagccacagugcccagcccauuuuuaucguugguggaaagaaaagcauuuuuuauaauguguuuagaugucauacucaauucuagcuucaucaaaaucacuuggagcuuuuacauuaauguuuaaaauacaagcuacaucccagagcuagugaauuaguauauuuuaaggguugagccagaaauuuauaguuuaccaaaguuuccaaggugauucuaauaaugaccuaguuccagaaaucacugguauaugccauaaugcaaagguauaaagauaguauacaccaaguaaauaaaugucaaagaucaauuaacuaaaacaaagaguggguugggaaaaaugagacugccugagacuaaaaucucauucuccaucagcuauuaagguagauaaauuacagcaccucuuugaguuucaaugcccucacuuucaaaauggggcaguaauagcuaccacagauacauagguacaacgcgcuuagcagugguuugaaaccacaauaagcugccaaaaagcauggcucauuuugcuuuuuaaccagauucuagaucuucuaaacaauaaagcugauuauaaagacauuuuccacaaaauagccuuuuuccucuccuucaaugcuuuucacuuaauacuguacuucuugcaaagucaguaggcugagcaugaacaaauuaaaauuaaaagcugaauuacuuaauuaauuuuaaggcacucucaguucauuaacagcauuccugcaaguuaaaaaacaagaaaacacauggaaugauuguaaaccgcaucccaauuucagaaauguucaaauauauugggguuggggaggugagcagggcaaucuacugccauaucaaacccaaaagcuucucuuaaaaaggcuauguacauguauaugcccaccagacaagauguccuucucucauguugcaaucagcaacccaaaaguccuguaaaauagccaaaggucaaaauaguucagaaaacacuacuucuuauaguccuccucuccacaacccucuuuucagaaguucguaacuggcauauucacauaucaaaaaaucugaaauuaagaaaugucuucaacaaauaugucuaucaaacuugucuugaacuuuccucacuuaccuuucggggggcaaaucugaugaggacuuauuuugggaaacauuaaaauuagggaaagucuuuugguuauacuuauuaggaaaaucauuguccaaguguccugucuugccagaaugagagguuuauaaggaaagaaguuccacggcuuuggacuaauaaccaaccaugggaaucacagcuuccuuccaagggaaauaacaccuuuuuuuaaaauuugcuuuuauauugguuaaaaaaaaaagaaccaugaggaaacaucaagaaccaauauuacuucuuuggaaaaacuuuuuggggauauugcuaaggauuuauauugcauaauucaacuaaacgaauuuuuuaguuuuaaaaaaucccaauaauauuauaaaccuagaaacuguuuauucagauccaccuugguaaaauaaauacauucaauaaacacagaauacagacagcuuuaauuuuuuacaugugggucaggaggauccaucucucccaaaacauguaucaccccacaugugcugugauuuacaauccucaaagcauuaaaguuuaauuugugaaucuacuguuucagauucauuggaauucugauccaauagucacucuaaaauagaugcaggcuggaagacaauucucuacauuuuaaagccagauggcccauaacagcuaaauauuuuuucuuuccuuguucagaauauaauucauguuggaaguagugaaucaacuuaaguacguacaaauuuaagggaaccuuagucaucagucccaaacuuaggaaucuauuuaaaggaaauauauuuuaagguuaaguuuaaaaaauaacaaaagagaauaccauauguaacaacccuggcacagaacacuuucuuuaagaaaacucccuuaacguuaacggcaaaaaaauacucuucccauuucacuaugguaacuaauaaaaauuuuuucuucacacugaaaaauaaaaucuuuauuuaaucuaauucuguaagugccaaaaacucugauuauuuuaucaaguuauuaaauauguuauucaguagugagccuuauugauuuuccuuuugauuagaaaaauuaccaaaaaaauccagcucuacaguucauaaccugagaaugguagaaacccaagacguagagcacauuaugcaacacucuuaaacaaaucugccucuugggaucucucuccuuuuauagaaagagacucuccagcagccccuagagacauucccauacuaagugagucagcuaaauaaaauuaagcaacuaauaaaacaauaugucaucuuguucucauugucauaauuaaaauccuuuuucuuuaagaugaaagguggcagcuauagaguagccuucaaaaucauaggcuaugccgaagcaggaucuucucuccaacgcuguacagacaacgcagcugucccugacaucaccacuugaaauuauucccuauuugauauuuuugacauuaaaaggcugaagucuuuuuucuucugcaaguuacuuccaugcuugcuuauuaagcauuccaaguuggucucucacccaauagccuuagaaagcagaccaucauuauuuagggcaaagguuuccagaggcagucagaggcaggauaaggaugggggaucccaaacaagccaugcucuuuccuaagcaaagcaccucuauuuugaauguguuugauacacugagcuuccaaauaagauugaaauugauuuuaaaaaaagggaacccccgccccccuuuaagccagguaaaaacuauaaccaucccugucaagagcguuacaugaaucuguaaauccuaugacagacuaccgguugaaaccgagguugaagucuucaguucgccugacucagugcugguacacaguaaaaacuaacacugaaugggugccccacagugagugaggcauuucagcaggaccggggggauguuaugcaacaaaaacaguuauagcccuugucugccuggaguucacaaucuaauggaaggaugaucauuacaucaaauauuaaagagagcuaccaugcaguaagcccauucuagacaucagcugccguucuaauaucaacucauuuacucuccaccacaccuuuaagaaugagguacagugaucacuccccuuuuacagaggagccacugaggcacagaguuggcaagguugcuaaguggccaaguuugguuugaagccaacgguauggcuugagugcccauggcucaaccacucaacccuaccuccucucccaaacacuguaagaacccaaaugucaaaugcaccuagggcaaguccucgacagaaaggcauggggugugaaaagaauguauaauuagaggaucugaccaaggcagggagaacaccacugaggaauuaaugcaggagcugagagcggaaagcaggguagugaagagaggagggaagagcaucgagguaggagcaaaagcaagagauccgccaggauaaagggcuuggagagcaggaggacuagaauucagcccaucaggacagagaacauaggaggguggcaaacaggagguuauggccccaggcggacaaggaaagacaggaaggugccaaccaugcuggaccgggcuaagacagcuggggagccacugagggcaugcugcagggagaucacugggcuaauacuugugaguccaaaagacuuuucuggcuguaucuacacagucauggcacaguccucccaauaggcaggccgacacaaaaccaacccugcucuguaucacuccauguauuccuggucauauugucacagccugaugugcacugaccaccucugugcugugccacacugagggagcagcugcuccagcuaauuucuacccaacauucaccaccuggaggcaaugcauuggcuccucaggcuuuagcauggcaagggaacuucacaaauaagaaaguuuaaaaaugauguuacucucuucaaaaucuuuucuucauuuguagguggcagaaggcaacagauauaucacaucauugaguaccaugggacauguguucacacuuuaaaguacuuagguguuauuucauguaaauguugagaaggaaaaaaaaauccuguuuuucuugucucuugggaaucagcuuugguuuucugaagaaauaguucacaaaucuaaggaaaaugauauaucuauacuuauuucccuaaagagaacauaauuuuucuucuuuugguugauaaggauuuaauugcauuuagaaggauuuaaucacauaaggcuaaccaaugaaacacuaacugugggcagaacucuguuucaguuggcccuauuggcccuaaaaugucauugauagugacuaaauauacacauuacuccucucccccgccauccuuucuccuccuuccauuucuccuucucagaacagagaaauaaaacgucuaggaaacccaucauuuacuggggaaaggaaggggacguguaacauuucaaacuguaauaaggcaugaacuugccaagcuguccaugugggagguuauagcaugcccagagaaguugcccagaaaauagacaugguuuccaaucaaaaaaacuuagaccaguugaaacucuggcuuugggcaauuuacuuaacuucucugggcaucaguguuaacuuauguaaaauggagacaaucacaauauguaccuuacccuguugugguaagauuaaauaauuggcacagggccugacacaauaaagguuaaugauagcagcuguuaauuauuauccacgaaucaguuuaacuuuaagaaaauaacaacuacuuuggccauucuagcaaguguguggcaaagagggauaacagaagcuccuuuuguggaagaacauguaauuugcccuuuauuugcacaguuuggaaucaucaucauaacauccuaauaugccuugaaauccugugaaaaaacagaaguaaacaaguaaaaccaccauagcaacacuauggcagaacugaguucacuaaaagaucuugucucuugcucaaaaggcuugacucaaggaaaagaacuagguauuucuagguuccccugcauucauuuuuuuaaaaaauuguuguggguacauauaagauauguuguagguacauuuaugggguacaagggauauuuugaugcaggaauacaauacauaauaaucacguaggguaaaugggauauacaucaucucaagcauuuauccuuuguguuacaaacaauccuaucauauuuuuaagcuauuuuaaaauguacaacaaauuacuguugacuguagucacccuguuaugcuaucaaauacuagaucuuauacaucauauguaacaacaucuguguaugcauuaaccaucucccccuccccaacuacccuucccagcuucugguaacaauccuucuacucucucuuuccgugagcucaguuguuuuaaauuuuuaguucucacaaagaagugagaacaugugauguuugucuuucugugccuggcuuauuucacuuaacacaaugaccuccaguuccauccagguuguugcaaaugacaagauaucauucuuuuuuauagcugaauaguacuccauuguguauauguaucauauuuucuuuauccauuccucuguuagggacacuuagguugcuuccaaaucuuggcuagugugaacaaugcugcaauaaacacggggguacagauagcucuucaauacacugauuuccuuucuuuuggguauauaccuagcagcgaguuugcuggaucauaugguagcucuuuagucuuuugaguaaccuccaaacuguccuccacagugguuguacuaauuuacauucccaccaacaauguaugagaguucacuuuucucaacguccucuccagcacuuguuauugccugucuuuugcauaucuuuucauuauuuuguguccucuucaauaagccauuuuaacugggauauuacuguaguuuugauuugcauuucucugaugaucaguuauguugagaaccuuuucauauauuugccauuuguauguuucuuuugagaaaugucuauccagaucucugcucauuuuuuaaucagauuauuagauuuuuuuuccuauggaauuguuugagcuccuuauauauuuugguuauuaaccccuugucagaugaauaguuugcaaauauuuucucccauucugugaguugucucuucaaauugcuuucaaauuugcucuucaaauuuguuuacuuugcuaugcagaagcuuuuuaacuuaagcuaucccauuuguccauuuuugcuuugguuaacuguguuuguaggguauuacucaagaaaucuuugccaagaccaauguccuggagaguucccccagugucuucuuguagaaguuucauaguuugaggucuuauauuuaagucuuuaauccauuuugauuugauuuuuguauauggcaagagauaggggucuaguuuuauucuucugcauauagauauucaguuuucccagcaccacuuacugaagagauuguguuuuccucaaugcauauucuuggcaacuuuguugaaaaugaguuugcuguagauguauggauuuauuucuggguccucuauaguguuccauuggucuaugugucuguuuuuaugccaguaccaugcuguuuugguuacuauaucucuguaguauaauuugaagucagauaaugugauuccuccaguacuuuuugcucaggauagcuuuagcuauucugggucuuuugugguauuauguaaaugcuaagauuauuuuuuucuauuuucaugaagaaugucauugguauuuuuauauggauugcauugaaucugcagauugcuuuggauagaaugggcauuuuaacaguauugauucuuccaaaccaugaacauggaauaucuuuccauuuaucuuguguccucuucaauuuuuuacaucaauguuuuauagauuucacuguggacaucuuucacuucucugguuaaguuuauuccuagguaguugauuuguaguuauuguaaauggaauuacuuucuugaauuauuuuucagauuguccacuguuggcauauaaaaaugcuacugauuuuuguauguugauuuuuauaucuugcaacuguacucaauuuguuuaucaguucuaauaguuuuuugguagagucuuuagauuuuuccaaauauaagaucguaucaucugcaaacaaggauaauuugacauccaacuuggauacccuuuauaucuuucucuugucugauuucucuagcuaugacuuccaguacuauguugaauaacaguggugaaagugagcauguuugucucauuucagauuguagggagaaaaccuucagguguuuccccuucacuauauuagcugugggucugucauauauggcuuuuauugugucaagguauguuccuucuauacacaguuucuguggguuuuuaaucaugaaaggauguugaauuuuaugaaaugcuuuuucagcaaaaauugaaauaaucauaucguuuuuguccuuguguucauaugauguaucauugauugauuugcauauguugaaccauccuugcguaacuggaauaaaucccgcuuggucaugauaaaugcuuuuuuuaauguguugcugaauucaguuuguuaguauuuuguugaggauuuuugcaucuauauucaucaggguuacuugccugcaguuuuuuuuuuuuuuuuuuaaugugccuuugucugguuuuuguaucagggugauacuagccuccuagaaugaaucugcaaguauuccuuccucaucaguuuuaugaaacaguuugaguagcauugguauuagugguucuuuacgcauuugcuaaaauucagcaguuaagccaucaaaucuagcgcuuuucuuugcugagcgacuucauuauggcauugaucucauuacuucgucuguucagguuuugcauuucuuagugguucaaucuugguagguugugugugucuagaaacauauccauuucuucuagguuuuccaauuuauugguauauaguagcucacaguaucuucuaaugaucuuugaauuucuaugauaucaauuguaaugucuccuuuuucaucucuaauuuuauuugggucuucucuuuuuuucugaagauuugucaauuugauuucuuuuuucaaaaaaacaacuuuuuguuucauuuaccuuuuguauuuuuucauuucaauuucauuuauuucugcucugaucuuuauuuuuccuucuacuaauuuugggucugguuuucacuugcuuuucuaguuguuuaaaauguaucauuaguuuuucuacuuuuugauguaggcaauuacuacuauaaacuuuccucugaauacugcuuucaccauaucucauagguuuugauacauugcguuuccauuuucauuuguuucaauauauuuuuaaaauuuucuuaauuuuuucauugacccacuggucauucagaagcauauuguuuaauuuccauguguuuguauaauuuccaaaauuucagcuguuauugauuucuaauuuuauuccaugguggucagagaagauauuugacauaauuuuuaaaaaaauguuuuaagauuuguuuuguggccugaaauauggucuuuccucgagaaugauccaugagcugaagaauguguacucugcagccauuggauaaaauguucuguaaaugucuauuagguccauuuggucuguacugcagauuaaguaagauguuugcugacuuucugucuggaugauauuuccaaugcugacagugggugaagucuccagcuauuauuguauuggggucuuaucuaauaauaacuuuacauaacauauaugagugcuccaguguugggugcauauauauuuacaauuguuauaucucuugcugaauugaccccuuugucauauaaugaccuucuuugucucuuaccauaguuuuugucuugaaggcuauuuugucugauauaagcauagcuccuccugcucuuuuugguuucuauuuucaugcaacaucuucuuccauaucucuuuauuuuuagucuaugugugucuuuauauuauaggcgaaguguguucuugcaggcaacagaucauugcagcuaguuuuauuuauccauucagccacucuacaucuuucgauuagaguuuaguccauuuacauucaauguuauuauugaugaauaggauuuacuccugcuauuuuguuauuuguuuucugguuguuuuguagucuucucuuucuucuuucauuccuuccugucuuccuuuuaaugaaggugauuuucucaagugauauguuuuuauugcuugcuuuuuuauuuuuucuagaucuguuuuaaguuuuugcuuugaguguacugugaggcuugcaaauaacaucuuguaacccauuauauuaaacagaugacaacacugauugcauaaacaauuaaacuaauaaaaacacuauacuuuucauaccccugcuuuuuaacuuuuuguuguuucuguuuauaucauacuaucuaugucuugaaaaguugugguuauuauuuuugauagauucauuguuuagucuuuccacucaagauaugaguaguuuacauacuacaauaguguuaugauauucuuuauuuuucuguguacuuacuauuaccaguaaguuuucuacuuucagauaguuuuuuauuacucauuaacauccuuuucuuucagauugaagaaagaauccuuuagcauuucuugcaggauaguucugguguuuuguuugucugggaaagucuuuauuucuccuaaauauacauguuugaaggauauuuucacuggauauacuauuguagguuagaagauuuuuuuuccuugaguacuuuaaauauguaauaucacucucuccuggcuuguaagauuuccacugaaacaucugcugccauacauuuuggagaucuuuguuauuucuuuucucuugcugcuuuuaggauccuuucuuuaucuuugaccuuugggaguucauuaaaugccaugagauagucuuauuuggguuaaaucugcuuaguguucuauuaccuuccuguacuuaaauauugauaucuuucucuagguuuuggaaguuuucuguuaucccuuugaauuaacuuuucucucucucucucugccuccucuuuaaggccaauaacucuuagauugcccuuuugaggcuauuuuguagauucugcaggcaugcuucauuguuuuguauucuuuucucuuuugucuccucugacuguguauuuucaaacagcuugucuucaagcucacuaauucuuuguuuugcuuauuucugcuauuaacagacucugaugcauucuucaguaggccagcugcauuuuucagcuccagaaucucugcuugauucuuuauaucucccucucuucauuagauuugucuaauacaacucugaacuccuucucuguguuaucuuggauuccacugagcuucuucaaaacagcuauuuugaauucccuuucugaaagcucacauaucucucucucucuccaggauuggcuacaggugacuuaguuuggugaggucauguuuuucuggaaggucuugaugcuuuggguguuugucagugucuggguuuugaagaguuagguauucacuguagucuuuucagucugggcuuguuucugccuauccuugggaaggcuuuccagguauuugaagggacauggguguagucaucuaaguuuuuggucacuuuacccguuucuacuuuaggggugccccaagcccaauaacacuguggcuauugcaggcuuguacagauaccaccgugguggucuuggguaacuuccagaagaauucccuggauuaccaggcagagacucuuguucucaucccuuacuucccuccaaacagaugaaaucugucucugucucucugucucucuccccucuccucucucuuucuuucucucucucucucucucucuccagagcugccugaagcugugggaggggugacacaagcacuccuguggccaccgccacugggacuauauugggucagaaaugaagccagccuaacacugggucucacccaaggccuacaacaauuacugccuggcuaccaccuauguuaacucaagucccaaggguucugcaauaaguauaugggaaauccugccaggcuuguguccuucccuucagggcaguaaguucucucuggcucuggucagguccagagauguuuucugggagucacggccuggaguugggaaauuuagaaaucuacuuggugcucuauucuaccgcagcuaagcuggcacccaaaccauaagacaaaguccuuucugcccuucccucuccuuuccucaagcagaggaaucucucugaccaccacugcuccgggcacauggagaguauugccuggcuaccaaugacauucacucgagguccaagggcucuucagugagcuuguggugaaugcugccaguccugagucucucuccucagggaaguugucuuuccucuggcccaggacagguccaggaaugucauucaggagccaaauccugaaaucagagauccuaggagcccacuugauccucugccauacuguggccaaacugguacccaagcggcaagauaaaguccucuuuacuuuucccucucuuuuccucaagcagaagggaucucucccuguagccaccacagcugggaaugugcuguucacaacugaagccagcagggcucugagucucacucaaggccugcagcaaguacugcuuggcuaucacugcugauuauucagggcccagugcucuucgguuagcaggugaugcacucugcaagaacugagucccucccuucauucaaggcagcagguucucuuccagcucaggguauguuuagaaacgcugucuggaagccaaggccuagaacagaggccucaggacucugccuggugcccuaugcuacuauggcugaacuaguauccaaguugcaaaacaauauccucuuuacucucuccucuccucuucugaaacaaagggaagaaggagcugccuggagcugugagcuguguugccuagaguuaguggggagcagcucaagcacucccuucaccagcugauaucuucuuaggucauguguaccccagguccacugguucugagcucaguacaggaccaggacuuuccuugcaguccuuguggccuagacugccuuucaaguuuauuuagaacuucagagcacuuuagccuguggugguggagcuugccggaacucagguucugaccauuggcauggacaauuugccucuggcuagggcuggucuaaaugcucccuccuugggaaccugcugaguucuuccugguguugcuuucuacugugacagggcaacacugaguuacaauacaaagucccacaaucacugcacucuccuucccccaagcacaaagauucuuucuccacgucucauggacugugcaggagaauggcggaauggugacaucaaccauucaagacugucuuuucuacccucuucagugccucuuuccuuaauauacuguuaaaaccagauacugcaaucacccaccuggucuuuuguucuuaugaagguacuuuuuuguauguacaguuguucaauuugguguuucugccggggaacaaccacugcaggcuucaauuuggccaucuugcucugucuucccccugccaccccaccccucucacauucuugaaaugaguaaaaagccuucacgcuaagcauggccauggaaucuucccauguugaacuguaagaugaacagagucauauuucaaauaaagagauuaggcugacaugaaugaucauauuuuuaauaacuuauuaaccuaauugcaugccacaauuacauagugaguuuucaucuuuuaaaucaauuuuggggugagggaugaaauacuaccuauuggguacaauguucacuauucaagugauggguacacuuaaagcccagacaucaccacuacacaauauauccacguaacguaacugcacuaguagcucucagucuacuuuuuuguuaaaaaaaaaaaagagcaaaaacaacagcaagaggaaagauauauauuuaagaaaaaagcauuucaaugaggcaaaaacaacugguucauccuuagguccuuaggcccauuuauuacuucgaacuguaugcccacuuuuuuauuuuauaaagguuugcaugucuucaaacuacaugcccaccuucauuuugcaaaguauuguacaaugcuguauuuuuuuuuuuuuuuuugagacgaagucuugcuuuguugcccaggcuggagugcaguggcgugaucucggcucacugcaagcuccacuucccagguucacgccauucuccugccucagccuaccgaguagcugggacuacaggcaccugccaccucgccgggcuaauuuuuuuguguuuguaguagagacaggguuucaucauguuagccaggauggucucgaucuccugaccucaugauccgcccgucucggccucccaaagggcugggauuacaggcaugagccauguacaaugcuguuuuaaaagcagcgcucgucuuugcugccuuucaacuuuacaugcuuugguuucucauagagaaaauaaaaauuguuuuuaauccuuaaagaacuucugacaggagagaaaaaugacuugugugucccaaagcccccaaucccaaagacaucuaagcaaaaccaaguuggggguggggguggagaauuuaaauagcaguaauuaucguaucucaauuugcaagaaaaacaaaugccucaaauaccauuauucauuuaaguuuucugacaaccugacauuuaucuccuuuagugcuauauuauagaaauguuucuuauuauauucauuuuccagagacugagaacuuuuaaaaccaaugaaaugcaugucccagaguugauccuuugcuuuaaaaaaaaguuugaaaaaggaaaagcuauuauguugauuacaaaccgaagugaguuacaguaaaugaugcaaagaaauuuugacaaauagguauaugcacuugaaagugguacuacucugcucucaagguguugcuguuaagauaugaaccaacgcugaaaacuccauauccacagauagcuggcuucuucgauaaaauucaauucaaaucaaagaguaauuaaagcacuuaauuugcaugagcacuguuccaagauuaacuaaagggcugaggggagcuggagguggggagcucaauuaagaaccuauucaacauauuucaagagagagggacaaucugaauuuaggauauggauguggaaauagaaaggggaaugugagagacauuaucaagagagaauaaauacaaugugaagagacaaccugggagaagggagaaaaauauugccaggcuuaaaauacaugacaaugaaaaggccauuaaccaauagggcuaacuacaaagguggugcuuugguggcaaaaaauuuucuuuggaaauacugauuugagguacuugcacaugaaaacuuaaccucagcugggcgcaguggcucacgccuguaauccuagcacuuugggaggcaaagguugguagauugccucagcucaggaguucgagaccagccugggcaacacagugaaaccccgucucuacuaaaauacaauaaaaauuagccaggcguggcagcaugcaccuguauagucccagcuacucaggaggccgaggcaggagaauuacuugaacccgggaggaggagguugcagugagcugagaucacgccauugcacucuggccugggugacagagcgagacuccauuuccaaaaaaaaaagaaaaaaagaaaaccuaaccucacagagaauuguaccuggagauguaugggggaaagacacauuauuuuggaaacauuuaaagaaccucauacucagaacuagaaaaaaagacaucuucauaaauucugaugcauuuuucauccuaauaccagcagugacacaaucaggacagggaaugugucugcuuacccagcaaucaaggaagaugaaggagaugaagcagacagagggcagggagggucaacccugacugcaccagcaccaaaggcuagaguuucuucugguauagcaaagccuaaauaauuuucuucauuaagcuuauuuuuucauccaugggaaaaggaacauguguucauauuacauuaacuugaaaaauucagaauuaaugaaaaaauaagccucagaaucuuaaaucaacugaauauagcaacagagaauagaugaagccccaaagggcuucugucacacucauauauaauaaaaacaccagucauguuuacaguucaauuuuauagagcuaaauugaugaguaguuuuggaguguucuagaaauucuacaauauucauuuuuuauugcaguuuuugaauuuauuaauaauuaggcaagaaaucauuaacuacauuuucaaaacaguagaaguaaagcuuaggaggcucauuuucacaaauguauuauuuucaacacaauacaauuuuuuuuuuuuuugagauggaguuucgcucuuaucacccaggcuggagugcaguggcacaaucucggcucaccacaaccucugccucccggguucaagagauucuccugccucagccucccgaguagcugggauuacaggcgccugccaccacacccagcuacuuuuguauuuuuaguagagacgagguuucuccauguugcucaggcuguucucaaacuccugaccuaaccugaucugcccaccucagccucucagagugcugggauuacaggcgugagccaccgcaccuggccaacacaauacaauuccaauuuuuaaauaguacuacuuaaaucacaaauacaacugacuguuauuaauacaaugaaccagguugaguuaucugccauuacuuacuuuagaacuuagcucaugucagaaauauacaaaauacuccuuugauauaaacagauagcuugggggaaaacgaaaaacucuuauuagaauuacuacuaguugcuguagcaacugucgaaguguuuuacuaugugccaggcacugggccagagacucuuuguucaucucuuuaaucuucacuacauuucuauaaaguagguaucuugagauguccauuguacugaaaaggagacaaagcaaagguuaggggaguuaaguaacucaguaacuuaaauguuuuucucccuuagcugaaaugaugcaugccacagguuugaaaaacauucuuucccuauucaaucauuuauuuaagugauaaacauuaaucucaacauaaacagaaaauagauugaauacugugauuauuacuuugaaaccaaagcuccaucuuuagagaaacucauacuggcaaagcaaacaaggacugaugaauuggaggugcacuugugcgcuuaaaacugcagcagcugauguaggcacuggaggggcuacaacccagggacccagguaguuugcagaaauucacaaggugcaggguaucaguuuugucaucacuuugauaccugucaacuucaugggccugggccaaucagccaacuugcucaaaccucacguuucuuucauguaaauacagguuaagcaccccuacaccaaauacccaauaucugaaaugcucccaaaucugacacuucuugagugcugagcugacgccacaaguggaaaauuccaccccugaccucaugugaugggucauaaucaaaaugcaguugcauaacacaguuuauuaagagucuccaaggggaaaaaggcccuuccaguccccuucagcguaucuuuuccacucaugcccagauuucccuacacaagcaugccacaaaguauuguguauuaugugggaaauaacacacagggaacuuggcacaagaacuggcauacaauucccgaaauaguagagcugucaucaucauuacugguuuuuauaguaacugugaccccaaagaguuaauagaagugagauaguagaaaaacugauggcugugcagucacagaaaucuuccaagucuacaucucucauugaggagauaugcaccauuugcaaaguuauuuaacguaccugagccucagugucccugaguguaaaauauaaauaaaaauauuucccugguaugagacagaaaaauagagcuaaugugucaaaaguaccacauggagagacuggaacacaggaaguuccuauuacuguuaguaugaaggcgcuuuaagaacucaaacuaggcaacagguacaggccacagggggaauaaacgcaaacguccaguuaaaaccaaauccagacauaagagaaacuuuauuugaaaaaguaacugcuauaaggggagugagacuacugcaauagggagagcucuggucaugagaugugcaaguagcucaacgauugggcagaaaggaauuuucuuuuauagggagggguaagcaaggcuagaaagaucagcugggagcacugacuagggaaagcuucuccugaaggucagcugguucucaggagggguauucaaggagaggcugcucugcaucccaaugcugaaggcauggucaaaguucaagggccuagggagcgagacacaccugacugaaguuugguugauuauuugggcacuggguauaaacaaaucagcugaccauuuauaaggcgcagaacgggaaugugaaaacucagcuucuggccuugucggagguacuuaagugagcaucauuuggucucguccuggacacccggggaaggauuuuuuuuuuuuuuaagaagccuuuuccagaagacaaagggugggggauuucuucaccuagugcuauuuuccaaaauacuuggcucagguaaagcucaacauuaccauaaacagaacaaacuauauauauauauauguaugguuuguauauguuuaaguacguauauacaguuucguuuacaugcauaugcugaauauaguucaguacuuuuaagcaaaguauuauaauaucauauucaaacaaucaccaccuuuuuuuccuacaaaaauaagcaaugaauuaaaagcaagucugucauuaacccacggugaggaaggaggaacaauuuuaacuaccugaggucuucaaaauggauuuuuuuuuuucaguucuuauucuaaugcaauuuccuggucagaaucuuuuuauacauaaccuugaauauaacaaaaaccaggaaaauggcuuguacacaaaaugaaggcuacuaagagcaugagaaaauauuucauucuuuuccuuugaucaucuacuuuucuuuugagagagaugcagagagaggauuugaguguuuaugccugccuuuggauuucuuuugcuggguuuucuauuaagucuucucugacaucauuacuagcuuaugcauacugaauguguacucucuugccaggcaucacacuaaccacacuauguaauaauuucuauagaucuccacacagcucagugagaacagugcuacuguuaaaaaguuucauauuaaugucugcauuuuagaucuacugcaaauaaucacauauuauuuuucugguagaugaauuucaugccaaaagauuaacuuaaccuuuuauauacauauguaaacaaucgguauaggcauguagauauaaacauguauagaacacaaacuugcauuugucucaggaaucagguagagaccauaguaaacauuuuuaucuuggaaggagggcagagagcucaucaucaucaauucagaaccuauaaugauuuuacccaaacuucucuaauaugauagggagcaacacuuuuucacccuguucauaguacgaaugaaaggugaauuaucuuggucuaguuugaguucugcuugcucaccccuggaaggagaaagugcauaccauagagaagcguggagauucuuugcuggguaauaggaaauuggucuucacagcagaaaauaauaauugcaacaaaaguacuaacaaaaauaauaacaacaauuagagcaacaauaaaaacuacagcauugacauacugauugcucauaauaugccaggcacuggauaagcgcccuauuucacuaccaaacauaauucuuccaauaaucagcaguaaccuuaugcaucccacuuacagaugaagaaaugagacaaaggaaguucacacagcuaccaaaauugggaaccaggaauuaaccucaggcagugugacugcacagccagggcccuuccaaacaauugguuaacuaaccugggucuuuugcuggccaauguaucggggaauaauccuagccaacaaauucaagggaaacggaaucaagcaaauaugaaugaacuucauuuacugaaaacaaaguaggcuuugauaggacuguguuaccaucucuagaccuaacuaugauuaugucauuucuuagugccucuugcggcaaagaaagugcacuuuacauaaaaaaacaauagaaugcaucuggcagaaguaugagaagaguaacgaucauggugaugguggugaugaugaugaugaugacagcuucaagagcagcaggguaaggaugccacuaaaaucaccaccauuuaugugccaggcauuaugauacagucauuacauauaaccuuuuucucccacuauauugcaugcugcuucacuuaccuuguaaaacauuuuagacauaaaaggugcuccauuuuuuugcacaaaugaacaaauacaugaaauaaaaguauguugaaggcacagaaaaaguauucauaaaagacaaacucaaaauucccaaugacacagagaguauaaucacaccacauaucaaauccaagccacauagcacagagugugcuauugaaaugaaacgcaauauaacuauugcucugggaauuacagaugggauccaguaaaagacacuguauuaauuauauuguuuuccauggaacuuuucuaagguugcccaggacagcaacacuguagaacauucaugaugaaacugucaaagaggacuagacuugaggggccuuagggagaaaagagauuugaaaauaauguacugcuugcccaugguucagacgugccuuucucugcaaguaugaucacauuauugauucucaaaggaagaaagaaaauaugacuuugucccuuaacugacaucaaaguuacaguguuaugcagugaugcccaaaagcauuugcaaauauucagaaacaaaguuuugaguguccuaggagaugacuaucauaccaauugauccaaaacacaauggucaagaggcauggaaaaccuaugguuggggagggagaggaagggucauaaauauauacagucaugcaccacguaaugacauuuuagucaauuuacuggauauaugauggugguccuauaagauuauaauguaucuggaaaauuccuauugcuuagugacauccuagcugucuuaaugacauagcacaagacauuacuuauguguuugcagugaugcugguauaaaugaaccugugcugccagucauauaaaaguauugcauauuagguacagcagggguccccaacccccuggcugcagaucagugcccaucuguggccuguuaguacagugggaggugagcagugggugagugagcauuacugccugagcucuaccuccugucagaucagagucgguauuagauucugauagaagcaugaacccuauugugaauugcacaugcgagggaucuagguugcaugcuccuuaugagaaucuaacuaaugccugaauaucugagguaaaacaguuucauuccaaaacuguccaucccccaugaccccugucuguugaauaauugucuuccaugaaaccagucccuggugccaaaaagguugggggcuacugacguaaaguacauaauacuugauaaugauaauacguggcuauacugguugauguuguauuaguccauuuucacaaugcaauaaagauauuaccagagacuggguacuuuaugaagagaagaggcuuaauugacucacaguuccacaugguuggggaggccucaggaaacuuacaaucacggcagaaggcaaagagaaagcaagguaugucucccacaguggcaggagagaaagagagagaaaaccagcaggggagaguccggagacuuaucaaauaaccacaucucaugagaacucccucacuaucaugagaacagcaugggggaaacugauccaaucaccucucuccaggucucucccucaacaucuggggauuacaauucaagaggagauuugaauggcaagacagccaaaccaaaucauuccagugcuggucccucucaaaucucauguccuuugcacauuucaaaaggcaaucaugccuucccaacaguuccccaaagucuuaacucauucuagcauuaacacaaaaguucacauccaaaaucucaucuaagacaaggcaagucccuuccacuuaggaaccuguaaacucaaaaacaaguuaguuacuuacaagauacaauggggauauacaggcauuggguaaauguucccauuacaaaugagagaaauuggccaaaacuaaggggacacaggucccaugcaaauccgaaacccagugaggcagucauuaaaucuuaaagcuccaaaaugaucuccucugacuccauggaucaaauccagggcaugcucaugcaggaagagggaucccagggccuugggcagcucuaccucucugacucugcaggguacaccccucucccccaacuccccaacggcugcuuucacagcugucguugagugucuuuggcuuuuccaggugcacagugcaagcuguugguggaucuaccauucuggggucuagaggaugguggcccucuucucacagcuccacuaggcagugccccaguggggacucuguguggggacucuguuugggggugccaaccccacauuuccccuuuguacugcccuagcagagguuuuccaugagggcucugccccugcaguagaauuccgccuggacauccaggcauuuccauacauccuuuuauaucuagguggaaauucccaaagaguuccacaagacuagagaaaaaagaaugaagaggagugaacaaaaccuccaagaaauaugggacuucauaaaaagacugaaucuacaacugauuggaguaccugaaggggaugggaagaacggaaacaagcuggaaaacacacuucaggauauuauccaggagagcuuccccaaccuagcaagacagaccaacaugcaaauucagaaaauucagagaacaccacuaagauacuccagaagaagagcaaccccaagacacauaaucaucagauucuccaagguugaaaugaaggaaagaauguuaagggcagccagagagaaaggccaggucaccaacaaagggaaucccaugagacuaacaguggaccucucagcagaaacucuacaugccagaagagacugggggccaauauucagcauucuuaaagagaagaauuuucaacccagaauuucauauccagccaaacuaaacuucauaagcauaagagaaauaaaauccuuuccagacaagcaaaugcugagggauuucaucaccaccaggccugccuugcaugagauucugaaagaagcacuaaauaaggaaaggagaaacaaguaccagcugcugcaaaaacacaccaaaauauaaagaacaauggcacuaugaagaaauugcaucaaauaguaugcaaaauaacuagauagcaucaucaugacaggaucaaauucacacauaacaauacgaaccuuaaauguaaauggguuaaaugcgccaauuaaaagacacagacuggcaaauuggauaaagagucaagacccaucagugugcuguguucaggagacccaucucacacacaaagacacaaauagacucaaaauaaaggaauggaggaaaauuuaccaagcaaauagaaagcaaaagaaagcagagcuugcaguccuagucucugacaaaacaaacuuuaaaccaacaaagaucaaaaaagacaaagaagguuauuacauaaugguaaagggaacaauugaacaaggagagcuaaguauucuaaauauguaugcaaccaauacagaagcacugagauucauaaaacaaguucuuacagaccuacaaagagacuuagacucccacacaauaauagugggagacuuuaacaccauacuguuaauauuagaucaacaagacagaaaauuaaugaggauauucaggacauaaacucagcucuggagggcucuggaucaagcggaccuaauagacagcuacagaacucccuaccccaacgcaacagaauacacauucuucucaguuccacguggcauuauucuaaaaucgaccacauaauuugaaguaaaacacuccucagcaaaugcaaaagaacugaaaucauaacagucucuaggaccacagugcaaucaaauuagaacucaugauuaagaaacucacucaaaaccacacaauuacauggaaauugaacaacaugauccugagugaauccuggguaaauaauggaauuaaggcggaaaucaagaaguucuuugaaaccaaugagaacaaagagacaacauaucagaaucuccgggacacagagugucccaguguuaagaggaaaauuuguagcacuaaaugcucacaucagaaagcuagaaagaucucaaaucaacacccuaacaucacaauuaaaagagcuagagaggcaagagaaaaaaauccaaaagccagcagaagacaagaaauaacuaagaucagagcagaacugaaggagauagagacacaaaaaacccuccaaaaauaaaauaaaugaagacaagagcugguuuucuugaaaaaaauaaaaaauagacagcaagcuagauuaauaaagaagaaaagagagaagaaucaaauacacacaauaaaaaaaugauaauagggauaucaccacugacaccacagaaauacaaacuaccauaagugaauacuauaaacaccucuaugcaaacaaacuagaaaaucuagaagaaauggauaaauucugggacacauacccccucccaagacuaaaccaggaaggaguugaauccuugaacagaccaauaauaaguucugaaauugaggcaguaauuaacagucuacugaccaaaaaaagcccaaggccacauggauucacagccaaauucuaccagagguacaaagaggaacuggugucauuccuucugaaacuauuccaaacaguugaaaagcagggacuccucccuaagucauuuuaugaagccagcaucacccugaugccaaaaccaggaggagacacagugaaaaaagaaacuguaggccaauaucccugaugagcaucaaugcgaaaauccucuguaaaauacuggcaaaccaaaucuagcagcacaucaaaaaacuuauccaccacgaucaagucagcuucauuccugggauucaauggugguucaacauacgcaacucaauaaacguaaucuaucacauaaacagaaccaaagacaaaaaccacaugauuaucucaauagaugcagaaaaagccuuugauaauauucaacaucccuucguguuaaaaacugucaauaaaguagguuuugaugggacauaucucaaaauaauaagagcuacuuaugaaaaacccauagcuaauaucauauugaauggguaaaaccuggaagcauucucuuuaaaaacugauacaaacaaggacacccucucucaccacuccuauucaacauaguauugaaaguucuggccagggcaaucaggcaagagaaagaaauaaagaguauucgcauaggaagagaggaaguuaaauugucucuguuuagagauuacaugauuuuauuuuuagaaaaccccaucaucucagcccccaaacuccuuaaacugauaagcaauuucaguaaagucucaggauacaaaaucaaugugcaaaaaucacaagcauuccuuuacaccaacaauagacaagcagagagccaaaucaugaaugaacucccauucacaauugcuacaaagagaauaaauaccuaggaaaacagcuaacaggggaugugaaggaccucuucaaggagaacuacaaaccacugcucaaggaaauaagagaaaacaaauuggacaaccuuccauccucauggauagaaggaaucaguaucaugaaaauggccauacugcccaaaguaauuuacagauucaauguuauucucaaacuacuauugacaucccucacaaaauuagaaaacacuacuuuaaauuucauauggaaucuaugaagaccucuguauagccaagacaauccuaagcaaaaagaauaaagcuggagguaucaggcuaccuggcuucaaacuauacuacaaggcuacaguaaccaaaacagcaugguacugguaucaaaacagagauauagaccaauggaacagaacagaggccucagaaauaaaaccacucaucuauaaccaucugaucuucaacaaaccugacaaaaacaagcaauggggaaaggauuucuuauucaauaaaugguucugggaaaacuggcuagccauaugcagaaaacugaaacuggaccccuuccuuacaccuuauacaaaaauuaacucaagauggauuaaagacuuaaauguaaaacccaaaacuauaaaaaccguagaacaaaaccuaggcaauaccauugggcaaagacuucaugacgaaaaugccaaaagcaauugcaacaaaggucaaaauugacaaaugggaucuaacuaaacuaaagagcuucuguacagcuaaagaaacuaucaucagagugaacaggcaaucuacagaaugggagaaaauuuuugcaaucuacgcaucugacaaaugucuaauauccagaacuuacaaggaacuuaaacaaauuuacaagaaaaaaacaaccccaucaaaaagugggcaaaggauaugaacagacauuucuuaaaaggagacauuuacauaaccaacaaacauaugaaaaaaagcucaacaucacugaucaucagagaaaugcaaaucaaaaccauaaugagauaccaucugaagucagucagaauggugaguacugaaaaaccaagaaacaacagaugcuggugaggcuguggagaaauuagaaugcuuuuacacuguuggugggaauguaaauuaauucaaccucugugggaagacaguauagugauuccucaaggaucuagaacagaaauaccacuugacccagcaaucccauuaccagguauaugcccaaaagaauauaaaucauucuacuauaaagacacaugcacacuuauguuuagugcagcgucauuuacaauagcaaagacucagaaccaacucaaaugcccaucaaugauagacuggauaaagaaaacguggugcauauacaccauggaauacuaugcagacauauaaaggaaugagaucauguccuuugcagggacauggaagaagcuggaagccaucauccucagcaaacuaacaaagaacagaaaaccaaacaccacauguucucacucauaagugggagcugaacaaugagaauacauggacacagggaggggaacaacacacaccaaggccuguuggggguggggggcaaggggagggaacuuagacaacaggucaauaggugcagcaaaccaccauggcacacguauaccuauguaacaaaccugcauguucugcacguguauccuggaaucuaaaguaaaauuuuuuuuaaauaaagaaauggacaacucucuagaaucaaacaccuugaaauuccuugaauaauuaaggacccacggauuguucaucuuuucauauacagaccccaaccuauaauuacuaauuacuaauugcagugagaucagagaaaaaauaaaugaaaagucuacuuuggagucaaagauaugguuauuucaaagaacaguuucccuaucaauagucauuugucuaagacuauauugaucagcaugaaguggcacauuauagaagacacuucugcacaccuguuacagaaaagccuccucacaaugccuauuucuacuaacuaaucuaugcuguccacucuaauaggaacugaaaaagacaccauuuccucaauuugauagaggauacaguaaauauuuacacaacacuuaaaaugagagaguauauaaacaauaauagaaaacagguaauucagggcuagaauuuccaauaaaaaauuuuauuuuguuuuuguuuuuuaauuagaggaagagaaagaucaagccauaugucagauguacuucauucuuuuuucacaaaagcauuaucuagucauaaaauagaggaucacaaaaagagcugaacugaucauaaaaagucuguauuuccugugcacuacaaacaaccauaaucccuugaacaauuccccaaagcuccuaacaucaaacauuaaucagucaguuuaggauccaucagcaaauuuaggauaccuccaaaggggccugacagguuaggcaaagaaagcauugcauaccaucaguucuuucacugauagcuaaagaucuauaggucagagaagggcaggcucugaugucuccuccauuaauuauugaagguaauauuccagaugcuaguaaaucuuaauaacuucaaauaucagcuucaaagauguacuuuugaugaacaaagccaaaacacuucuccuuaucaaaaagacauguuauaaugcauauuuuaucuuucaacggauauccucucaccaauaaacgugaucuuugauccaaaaauucuuaguaaugccacuaaaauuucucaaaacaaagucaguuuaaacgugcuucaguuaaaaccacugcccuauugcucuaaaagaaacauuacaaaaugcaacuacagacugucaauuuuucaacaacuuugggagugacuguuuagacacugucaaaugauuucuaagcaacccugccacaagcagacuggcuugcuauaaacacaagguguaggauacauaagaacuaauauuuguuaaggaauuucugugugccagacucuuggcugaucucuuuggguuugauugaaucgaauagucaucacaaucugcagaaagguuuggugacuugaucgcaagaaccuggcuaguaagggacugaguaagagacuucacuaggcaaguuaaagugcugcucuacacucccauugcugucucuguacccagcacgugggcacaaauguaagagccucgugaaggaaagcauaagcaagaacacacugagcagcucuaggaagcuccuuaagguagaaugagaaacuuacucaggcaggcuccugcaguugcacaauuaucauucuucuuaagugugauuacugcucaaagucagaaacaucaaauguggaaauauuauccaaguaggggauccauccaugaaagcaacaauugagagacuucuacauucugcucuacgacaccuggaaggcucaucuccgaagucacauucuuucaagaugguuugaacaaaaugcagaucuuuggugcagcaauuaauagguacaguuauguauacuucaacaggcugaauguaaucuaucuugaacuugccuuucaauuacuccgugcuuggagcuuccugcagugccugacuaucucaaaguugcuaacgcagggaaauaagccuaucagaaauucaaaacacuucaucaucacauuuuaaucauacaaaauaguaaguccugaguuuagcucauuccuugacaagucagagaugaugaagucuuuaaugcucaccuauuuauacagcaaucuuuccuccuaauuccgucuauccuauucuguuaucucaaagauauaaccaggugacagaguucaaguucauuaccaagagaauguauuucuccagccaaagcaaauagaauuucgaugaaacuucuaaguaccuguuauaaaugccaaguauuaaagguucuuuauucagcuauuuacaagaccaucugugaagccaacauucugugauccaaaugcagauguucuaugaaggaaggcaaggcuaaaaaagaaaauccugacaaggcccgugcagcuacuuaaagcauaaagggaagugcaauggucuuacgauuuaaauauaaaccuuuguuaaaugaugaggaaaccacagcagcagggaccugcuaaacaaucacucgacuccugugauugagcuaaaagauuauauuugagaugcucgguccaucgacauauuuacugagccccuguuauguuccuaguguguuccaggcaccauagcauuauuguaggccuggcucauguaugcugugauuugguguuuaccuucgauucugaaguuuagaaaaccucuuaacagggcuucaagauacuuuucucuuguaucugauuccaaguaacccuguauuuacucaaccaacagucacuguaggacuauucagaagucauguuaaguaaaagguggguuaccuagaagcugacagugucacuggagcggggucuugaggaucuagacauugguucugugguugcuuagaaaggucugggggccaugagggagggccuaugacagcaggguaggggauauucucagagcaauagcuauguacaauagaaauauuucaaucuuuuaauuaccagugugacuaaacagaaccucagcaguccuauguugccuaguauacauaaauauuuaaguccaagcccuauauucaggcagcucuccagcuaaauaauaugcuauagaauuaucuaacuuucucuaucaaguucaauagauugagagaaagaccaguuaucuaacagccagaaggaaaaucaagauaaaaacuugguguuaaguuuuuauguaaaacaugaaacuauaauauuuugcugaauaauuucaaugacugcaaaugaacaaaaucuauuccaccuuuuggaaucccuuuucaguuuuaauucauauauuccacacuuucugcuacagagauuuccaucaugggucaaggauugaaccagaugauguccaaugaguugggauuuccaagagagaccaugagcagugcuaaaaaguagacauuuugucacaauauuuaauaaauagcauucauuagaaaaauauuaucccccuuuaagcaaauacuauuauuauuucucucuauaauagaaacagaguucuaacauaauaguaccuauucguuuuacucagaggcaucaauccuaauuggaaauuuuuaaaaauccagcucaaguugcaauucacagagguggcaaaucuccuuuagagggcacagaaauguacauaugaucucauuuuaaaauguguguguauacuuuuuauuucugagaaagcaacaaaauccuggcuuccaauaauguccaacuuaauggagcauaacuuaaacuccuuuuaacaaaguuuaaauuuuuaaaagcccacugaauuaaagacaucaugacuaagaccaagcuggagugcucuagaaucuagcuuacaacuguuuggccuaaggagccuauagcauugacccugcauacauuaaagccaccugugcucaaguccacuuaucacucacaccugcuuacaccaugcuacugcucacuacaauaccaauaagaacaucugccugcuuuagauaaagauucucugcacaucuaaauuagaauaacaaguuuuugaacuauuauugcaaaagaaacagcagucaaugugguaauuuuuggggaucucugccuagguuucauuaggcucacccuaaugucuuuuucaguuuuggcaggagggccugugccuguuuucauagccaaaagacugccauacucacaaauggccaaaaaguaugaagaaauccuucaaguuucccaggcacugaacaggaggcuccaaaccaagucaucugcuuggaguuuuuauuacuccaaguucuguuauaaacuguaccucagugcucuucauguacgacaugacaggcaggaaaucauccuuacagcuuucacauuuaacaaggcuacuuuugaccaaaaugagcaaugaauuucaaaauacagggacauggcaaagugcuguaacucggaauuaaacaaaucaacaccaagaaacaauauucuacuagcaauucgguaaucacaggcaaagaugauaaauauccauaauguuuuuauaagccacaaacaugguuuaaucuaaucuuacacuguuuguguuuauaaagccaagacaagggugaucaucuaauauuuucauaacaucuaguagaagguaguuaaaaagauguuacauuagacaucguuacugcuucaaaauaaacucucaccuuaguuaacaaaauguguuauggguucugugcacaucuguuauagguaccacagagacacuauagcuacugaacucguaugugugcuagacauuccauuuugcuuuuuaaaaaauauauaacaaccuauuauuuauuuaccauaauuaucuccauuuuacaaaagugagaaggcuuaaauuuauuuuccccaauccaaaacuguaacuacuccagcccaggugucucuuuuaaaccucuugcuccgucuccacagacuucaacauggaggaaauucaggggauaaacuauauccaaagcagccucaaagauucaggcaguaauuucauuaucaugucuuacuugauuuguaccaaaaaaaaaaaaaaaagauuagauuucaguuucacgucuucugucucuuacuaauucagguacuaaaaacaguugguauuuacugagugcuuauuuugcucuaagcccuucacaugauuuaacaaauucccaaaacaacccuacaggguagauaguagcaucaugcuacuuugcaggugaggauacagguauaaagauguuaaguaacuugcacagguagccaauuugggccccuaacuaaggcagucuggucgaugcuuugaccuuugugcuaccuuuccucuaccucugaagacaaaagguaauugcaaaauaaaaguaugauaugcugagaagcaaauaaacuagaucugguaacccaaaaaguauauguugcacucaagcccuccuugcaguaccaaacccacaaaaccaaauggugcugaguugugcauuagaaacagguuaaaagaccuauuaaauaagcucagaucugaaagguaaacaauaagcuacugaaauaugauuuuuauuaagcaauagcaaacaagucuauuuacauuucaagaaagaaauggcaauaauucauuagcaagacaaaauagagucaaccaaaccgauguaguuucucucuccacacacccacucccuuacacacauacuagcagcccuaugaaaaacaggguuauaauagaaaugcugacacaaccaaccuuauaauguuucauacgaaaagcuacaauuauauuuucuaauuguaaacugggugaaaaaaaaaaggccaaccagaacaaaaacauaauaacuaccuagaaacaguccaucagaauucuuggauuaugaaaaaugcauauaaaacacuauuaucuucagccacagccagaagaugucagacaaucaauucauauaacaugccagcuuaauaaaaucugcauacaaaauuuaugaaugcaguaauauuccuuuauaucacaaguuauuaauggucaauuuaaugaacaucuacagcuggagugcuuucguucuguaugauauuuuaaucauuuuuagccauggauuuaaacgcauuucauuuuauaaccaucagcuagugaagauaagaaaaccuuuacacaaauaacugaaauauuugggguaggccaccaauuuugucuuuauguuguuauuuauuuccuuaaauuuuuuuuuacaacagaaacacaaugaaauguuccauuauaacaauauuugauuuaauauuuguauuuagaauaugaaaaguuugcuuaaaguagcauuacauguuuggcuagcauaaaaucuuccauuucauuucaaauaaagaacuuucuaaccucguuuaugugaaacaaucucgcucagagcuauuauccuccaaaaacuauccugguggaauguugacaucucggacauaaauauucuugaaaauuaauguguuguauuucuuaaguauccuauuuccacucacuuguucacauaaucuuuaaaaauccuauuguguucaagucuacuuuucccacagauucuuuacuaaaacuaaauuuuacuauaugaugcuuauguggaaggaacaggcaacauaacugcaagacaacaguagcuaucugaaaauacaaacauucagcauuuaaaauauugaugucuuucuguggucacaaagucaaauaauuguuucucacauuugagcauuagaauuugguauuuaaaauuacacucauccuucagaguuaauugaaagauuuggauauauaggaaaaagguuaagaaaucuaggucauaaauacuucuuaaggugcaagaauuggcuucauaaacuaguaaaugugcaauaaucacuauuaaagaaugaaagauggcauuuuuuuuuuuuuuuugagauggagucucacucuguugcccaggcuggagugcaauggugugaucucggcucacugcaaccgccaccucccagguucaagcgauucgccugccucagucucccaaguaauugagauuacaggcgcccaccaucaugccuggcuaauuuuuguauuuuuaguagagacgggguuucuccauguuggucaggcuggucuugaacuccugaccucaggugauccacccgccucucucccaaugacagcaauuuuuuaguuugacugucuauagccuuauaggacauuacaggugaaaaucaguaaaagccaugugcacaaaagauuuagugcauucaugugucuuuauucauucacucuaucuucuguugcuucacugguuccuuuugggcuuccuacuaugugccaguuaaucuuuauuugcucugggcgaguaacucccauucuuaaagaccuaauaaaacaggacacaguacauguauacccacuaauuauaaaacagcguagaauugauggauaagugccaaggagaaauacaaaucaagaauucagagaaaaugguucuuacuugucgagaaaagggcaagggaagacuuuauaaaggucaacuggaauuuagaggaguaaaagaaauaaggguauuuuuggguaaagggcacaacaugaaauugacuuaaggacaauacacacaaggacaaaaagugccuaugacgugaguuuuaaguuuaaaauacagacuuucaacaaugcuuaaaucuguagaugguaggcauuuuccaaauuccucuaauaaguagaaucagccuauauccaaggaagaucauaacucauuaaauuucauuuuaaccuuccugaaucugccuaaauuuucucaucuuaucaggcaagccaauauaugcuuacacugugagguuaaagaaaugaaccugugaagagaaccugucaaaucaaauuaucaacaagcaauagucccacuauuggggaauauauaagcugcaaugucaauuuuaaagaagugugcuuacauuugcauuuuaauuaggucacaccuucaacaucaugauauuaauuucaguuuaaugcucuauuuuauugccauuuccaaaaugacauuuuuagacauggacauaaagaaaaaaaucucuacuuuuguuuugacaacccauaaauauugcaaauugaaacaauguugaacaaaguucaauauuuggaauauucaaacgagagauacgacugugucuaaaauucuaaauacuuagaauuggauuucaaaaauauuccaagggaaaauuauuagauucucauuuaagagcauaauggaguguugaauggaacauaaaauucagguuccugugagucaccagaagcuaaauaugaauagcucagaaaaaaucauuuugguuaagacuuugcauuagaauugagacaugcuuuguaguuuuuucagaucaagagggagguagacaaauuacagaauguaucuuuguccauuaauaaaugacauauacucaaauacauaaaguuguaauaacauucacauaacaaaauucaucaaucauuuuaaaguguaaaauucaguggcauuuuguacauucacaaugucaugcaacuuucaccauaucuguuuccagaauguuuucaucaucccaaaagaaaacucuguggccauuacagccauucuacauuccccacuacccacuccuaaccccugguaccacuaaucugcuaccucuaugacuuugccaauucuggauauuucacauaaauuguaucacauaauaugcgacuuuuaguguauaguuuuaauuuuuauuuuuguagguacauaguuguauauauuuaugggguacaugacauguuuugauacagacaugcaauguguaauaaucacaucauguaaaaugggguauccauccccucaagcauuuauccuuuguguuacaaacaaucaaauuauacucuuaguuauuucaaaauguacaauuaaaucauuauugacuacagucacuccguugcgcuaucaaauacuaggucuuauucauguuuucuauuuuuuuguacucauuaaccauacccacaccucccugcccaccaccugucaacuauccuucccagcuucugguaauacuccuucuacuuacuaccucuauuaguugaauuguuucgauuuuuagauccuacaaauaagugagaacauacaguauuugucuuucuaggccugacuuauuucacuucgcagaaugaccuccaguuccauucauguuguugcaaaugacaugaucucauucuuuuuuguggauaaauaguacuccauugugauuaaguaccacauuuuuuaaauccauuccucugccgauggacacuuagguugcuuccaaaucuugacuauugugaacagugcugcaacaaacacgggagcgcagaucgcucugugauauacugacuuccuuuggguauauauccaacagugggaugucuggacuguguguuagcucuacuuuuaguuuucugaguaaccuccaaacuguucuccuuaguggcuguacuaauuuacauucccaccaacaggguacaaggguucccuuuucucuacauccccgccagcauuuguuacugucugucuuuuggauauaagccauuuuaacuggagugagaugauaucucguuguaguucugauuugcauuucuuugaugaugaaggauguugagcaccuuuucauaugccuguuagcuauuuuuaguguaugguuucuuucauaagcaaaugcuucaaguacauucuaacaaauacauucucuaauucuucuuuaagggaauacucuuaaagaagaaauggucaaguacuucauuucccaacuguuuucuauuuuucuuuucccaaaacuauuccaaaaaguuuauggggcuuuguguuuauuguuuaugagguaaacaaauaugaguuuuuacucccagauuuuuccaaauuaaaaaggcagugacaaauauccauuuaaauuaaaaauccaagccauuauugacauuggaacuugauucuacauaugcauuaaaaaaaagaccuaacagggggaaaccuacauuguguucauaacuggggauauccaacagcaucaguaugucaaauuuccauaaaugaauccauguauucaaugccauuccuuuaaaaaauuucacggccuuuucccacagaauuugacaagacggaaaaaaaucauuugaaagagucaagguaaagaacagccaaaaugugauuaaaagaaaggaaugcuugucuuucuagacauaaagauacucuuuaaucauaguaaucaaaggacuguaucauuaaagcucaaagagaccaacugaacucaguggacaggcaagaaacagauucacacauuuaugucaagaccauggggaaagaauagaauggaacacuguuuuuccauaggaagaaaaguagauucauaauuuauaucacauauaaaagauauccagaugauaucaaggcacauauggaaaagaaaacauuaauacauuagaaaaauaugaaaguacuguuaugauauuaacacugggaauauauucuuaagguacagccaaaaugcauagaccaaaaggaaauuauuaaauuucauuauacuaaacauuuuaguaucaaaggcacuauccccugucccgaccccaucacacauauggaaacccacuaagauuccaagcgagaaauaaaaaaaaguccugugauggauaugaucacaaaggauuuaaaucuagaauauauaaaaauacuaauuauugcaaaagaaaacaaugacccaauggaaaaaauuggcaaagaauacacacaagcaauugacaaaaagggacaccuguuugcauccaggagcaaacguuuuacuccacuggauaauuggagaaaugagaauuaauccaauaaugugguaccaucuuuuacccaccagaguggcaaacacuuaaaaagugugccaaugcaaacaucaugggaaacagauguuuucacccaaugcuauggaguaucaacugacacaagcacuuaauuaggacuauagaacugcucuccaauguuggagaaauguguaccuuacaacauggugauuccacugcuagguaaauauucuacagagagacucaccaguacacuaggaaacacauacaaagauauugguuuuacaucgucuuaacugagaaaaauuagaaacaaccuuuaaaaaggaauaggaaauuaauuugucuuccacucagggacuagaauacaauacaggagguaaaaaugaaagaaugagggcuucauuuauucauguagcuguaucucaaaaacaaugccgaguaaaagaaacugauuauguacagcaggacacagucaagaaaauauuaaauacaucaaacaacaugauuuccuuuuuagggauacagaugcacauuaaaaacaaauaaaaacaaaaaacaaaaaaaaacaugcaaaccuaagcagguagaaaaccuaccaacuucaggucaguaaacgccucuaaagcaguucucaaaaggggguaacuuugccucccacauguggcaauauguggagauauucuuuguuauucacaacuaggagggggcaugguauuguaucuggucgguacagguagaguugcugcuaaacacuuacagugcacaggacagcccccacaagaaaguaguuaucugguccaaaauggcaaugguuacaagguugagaaaggcagcccuaaaaacagaggaaggagaauaagaugacagguggggaagaugaaguguaucuauaacuuuucauucuaagaaaagaucugaagcauguaugaaaauauguuaaauuuuuuaagaaggacugccacauuauucuuuguacauucuuauauuugaaauaucucuuuaaucaguucaaaaauauaaaaaucauucugcaaacaaacacaguuaauuucuaaauuugaugaaaauuacauaauucuuuuauuagccuauuucuauaaauauaucuuuggaaaaacaauauucucacacucacgaucaaacguauuugcacuuuuuuucaguguuuguucuacacagagcuauaaaaggaagacuguggaagaacccaggauucauccaggaucacaggaucauuucauuauuacaguuucaggcaagaacauucuaaaaccagcucagagaaagcuaauuccguccuuuccugguuauauagcagaucauaauaauuccaggcaauucucugaagaagcugaugaucuagaacagugggcuugcaucacacaccccaucaugcuuccuuaaguacauggcuuaggaugcugauuucucccaaccucauggguuucaguaguuccuacaaacaacuuugagaucaaccagugcauaauuuuauuuuuuccuuuaguuccuuagugcagaggauggcaaacuuuuucuguaaagggcaagauaguaaauauuuugggcuuugcaggccauauggucucugucacagcuacucaucugugucacuguaacacaaaaacagccauagaggauacauaaaggaacaaauguggcuguguuccaauaaaccuuuaguuacagaaacaggcagggagcuagacuuggcuccaagccauaguuucgccaacaccaagauggacagcaaaaaugcaaccaguuuaaauacuauuuuaaauuuaaggcauuuccuccaaucuuugaaaguaaaguuuuauguauguuuuaaucaguguaaaaauuuuguacuaccaaaaaugaauuuauauaaaugaaacaauucaauaaaugaugaaaauguucauuuguuacauuuauagcauacuaacuucuuucuggaaguauguuauacccccugauuuacuaaauuauuaauuauaauuuuacuaguuuaaauuaugcuauuaaugauuccuuauaagaaaauaaacacacauauuguaucuucaacuaaggguugggaacgacaaggacagugaaauuauacucccaacacaaauaauagcuuucuauuagguuugcuauuucaccugaauaauuccuuauaaucaugaauaaugauguuauucgacaaccuaaugauaucaugguguguagcuucaauccaucugucuuugucaagaaggucaaauauuuguacuccacugcacuaggcaaaguugaacaaacaguuaaacaacaucacacaccuuaauuacuccuucaaaugaaaccagcaacuaccauuuuaccugauucuaggaccugugaaauaaaaaccuacuucaaagauauuuaaucuguauacacuuuuacaccaaauuuaagcucaacuuaaaaaaaaaauaaaagugguuaaacucaagaaaaagccccaagauuuucuaaggguauuguuaauugguuguugcuguaaaauguuuugugaauaacaaaauauuccaggaacuuuuaacaaagaucuggaauacuucauguguuaucuugacauuggcuuaaagguaagaauaaagcaauagcgugauagaugugaacuauaguuccuauaaaugcuucauaguguuugcuuugcuucgagauuccaugagugaccaaggaguugaaggggauaaaaacuccccauucacuguuucuacagagccucuacaagaccuggacccuuggggcugggggauggugaauauagcaagguaugaugugggcauacuuaaaugauuugcagcaaaauaauguuuauauuaaaaauccuguuuuccuuccuuccacccuucugcuuuuucuuaaaucucaccaaagcuuuauugcugcacaaaaaugaaguccuuagaaggccuuauuaaucugguuccagacuccuagcaucuucccacuuccucaccaugcuucacccccacaggucuucguguuuuugaaacggagucucgcucugucgcccaggcuggagggcaguggcgagaucucggcucacuuuaagcuccuccucccggguucacgcgacucuccugccucagccucccgaguagcugggacuauaagugcccgccaccgcacccggcuaauauuuuguaucuuuaguagagacgggguuucaccguggccuugaucuccugaccucgugauccgcccgccucggccucccaaaguccugggauuacaggcaugagccaccgcgcccggccucucuguguuuuuuuaaacauuauugagcaugcaaacuuguuucugccccugagccuuuguucuuguuuccuucuaccuggacuuggcugcccauugucccacaaugggcuggucccuccucguuaguucuuacagcacgugucaccggcaaagagaagacuucccuaccacucugucucaagcagucccucacucucaaucauacucuucuuuuuauuuuauucagaauagaaaaucauguuguuugugauuuauggguuuacauuuauggguuucaucuuuuaugguaaaccucugcacacaagaauaaaaguaggaucguuaucugacuauucauuauuguauaccuggggucuggcacauagcagaaacuaauuaaaugauaaauuuacauauucauucauuuacaauagacaacucugugucuaauuugaggucagcaaaugacggcccuagagccaaaccugccugauaccuauuuuuguaaauaaaguuuuauuggaacacagcccuguuugcccguuuaccaauugaugauguugcuuucacacuagaauggccuagugguguaguuacaacagagaccacauggcccagaaaagauuuacagaaaaaguuugcuagcuccuggucuacuacacaguauauguucucaaauaaauaaaauaaaguacagucauugcuuuuaaaggaguucugguccauuguguguuuuuauucaaacacuuuuagauuaaaauucuauggcccaaaagaaagcuccuuuaaaacuguaagcaucaccuagcaagaguuguauuggugcuguggcugggcacgguggcucacgccuguaaucccagcacuuuaggaggccaagguggguggaucauuugaggucaggaguuugagaccagccuggucaacaugguaaaaccccaucucuacuaaaaauacaaaaaaaauuaguagggugugguggugcaccccuguaauccuagcuacuagggaggcugaggcaggagaauugcuugaacccgggaggcagagguugcagugagccaagaucaccccacugcacuccagccugggugacagagugagcauccaucuaaaaaaaaaaaaaaaaaaaaaaaaaauuguauuggugcucuauucauuaggucagcuggcugaaaucauaaagaacuaacacagugccuggccccugguaaguacuauacaagccuugauuggcuucuuuuuggaagaaaacauuauauccgguggcuaacacagggcuuggcacauauucgguuggugcaaaaguaacugcaguuuucacaauaaaaguaauggcaaaaaccucaauugcuuuuccaucccaaccuaauagcaaguaacagucaagaucuguugaacugaauugaagugaacuugacucuuucagccagagggacuaacaggcuaaucugugaaauuagugggcaaaaaacugauucacucaccugagaacaagccauucuguaaaauaggcugagaaaccauuucucaccaacauuuuucagggaugacuugaaguaauaugauccaaggagccagauuucaauauacguuuaauguuuuuugauaacucguuguagguagccacuauuuaucuuauuugaguuacaaagauacauaaacacaaaauuuaaacaguaauuugagucacagacucccagaguugcaauacuauccccuguaauacucaguucuauagauauuuuuucuuuuaaaagauccaaacuaacccacauuuacgccagcucuuccaauuaugacuaaccgaugcauauuauuucuccaaaucuugacggucuaagcuaaugccucucacaguugacucacagauggaagucacaauuauuugggaguggcuggcuuuuuguuuugaguuccacuuccuggcuccuacgcucaacuuuugaauucagaauccuuagagugagaaaucauggcagaguccggaaucuccauuuuaacaaacacccuaggugaugcucgguccuuuagaaaucuguuauuuuagaucaagagaucauauauccacauuaagaaauaccaaguagcuaucaacuuuuggaaccacuacuuuccucuauuggaaauguaacgaagugauacuguguguuuuacuuggaguuauucauauuacuguauauuacgugcauacacaugcauauuacgcacucaguacuuguaggagugaaguacucaaagaaaagcuaaaauguggcaucuuugccauccaggcgguucuuugauaagcagcauacgcauaaaugauguaaacaaaugauacaaugacccaugacugagagaccgacgaguagacaugcaacaagauuucagagaaagaagcaaucaagggggucuagguugucagugaugugaaaaauugccuucuuuggauccaguagaggaggcaggaaguacaaaaagugauaguaguuaucacacucuagaggugucccaggaccuuguucuucucucaguuaagaccuaagaucuuagaacacaggaagaguaaagcaagaacuauggccuucuaaguuauuaaucccagcagccugggaaagauuacuaaggcuuugaaagcuggccaaaagucauugcaucucaguggucauagaggaagaccugggccaccaugaacugaaccaguaagaagccccugucuccaaggagcuguccugaaugaccuugcacggcacagcauucucuuuaucuuccuguggcaucaguaauaaaaaucauuggcuggucuccucauuugacaucuaaucaaacacuucacucggaaguuacuuuucuugcggguuuaggucuuaacccuccaaggauccugcaaaguucuagaggacagagugucagcaacucccccagugcuuagcacaauaaugucaggcaucauaaaaagaucuuguuuaaucauuugauaauuuuuuauuuauugccuaccauguaccagacauuguguuaagcacucaauagaacagacagcuagauccuaaacccaauggcagugacaaaaccgucuguagucaugagggcugacgacaacacuaugacuauaguaaaagccauuaaaaucacuuuaaauuggugaauugcacggugugugaaguauauaucaaaaaugcuauuauaaaaaaaucaaaauggcagaaaggaagauggucaagccuuagaaauucacuuggugaaagguuagaaaaaacacauccagaacuuaguuacuccuauuuagauggugacugugacacauuaguaauacuugaugguacuguagcugaauacugaauauuaagaaaauuggaaugcuucucagaagcaacaaaacaacgaaacuacauuuaugcuguauugguuaagaacauaggugucagaaucagaaaaacaugugaucaguucuagguucucuuccuuaguugugugacuuuggucaaacugcuuaccuaucugagccucaauuucuucaucaguaaaauaacuuuaaaauauaguaaugcucaauaauucuuagcuaguaaucaaauaaugcaaauuagcauaauacauucucacuuauaaaauuagcauauauuaggaaaauuauuacuauucaaugaguaguagcaaaauguuuuuccacuuugcuuuuggguacaugugaaauuuuauuguauguccacucauugagaucucaaacauuuauuaucauaacauuuacauaauuuauguguauguaccuuauccaagaaggccuaugauagcaaagaugcuaugucucaguuuucuuugaauacuucacuccuacaauuacugaguguguaugcauguaauauacaguaauauaaauaacugauaaauguaugggcacauacauuuuauauugguuguggcaugacuucuaauagugaaaguuaugaaacaaacuaaauauucaaaaccaggugaaauaauuauaguuaaucauauugaugaaauauuaugaaaccacugaaaaugaaguuaaugaauaagaaacauuaacuuuaaacaauaagaaaaaacuuacgguauuaggaucaaaagaaagggauaucauacuauauguagaguaguguuguguucuaguuuuaucuaaaacuguuuuggagaagauggaagaaaacaaaacauuuuaaaagauuaacagggauuaucucugggcaguaggauuaugagucuuuuuacuucauacuuuugugcaugaaaaaaauuaacaguauuaaauucuugcucauuuuauuuauaauaaauacaugcaguauugauuuuaagaaagagcaaauaagccuuauuuuacguaucaccagauuauaucacaaagugacguuaauuuuacuacacagauaaaugaccacauagcucaaaugaccagaaaaaaagaauugugaaguauauucucuaaauauaagcauccaaccauauugauagccaccaaugucagucacacuuaaaaagauuuuuuggccgggcagcgugccucacgccuguaaucccagcacuuugggcggccgaggcgggcagaucaugaggucaggagaucgagaccauccuggccaacauggugaaaccccgucucuacuaaaaauacaaaaauuagcugggcaugguggcacgcgccuguaaucccagcuacucgggaggcugaggcaggagaaucacuugaaccugggaguuggagguugcagugagccaagaucuccacugcacuccagccuggcgacagaacgagaccccgucucaaaaaaaaaaaaauuuuuuuuuugguucaacaaagcugcuuaguaaguaguuuaaaguuauuuauuauucuaacccaaauguuucacaucacaguaauuuguuaaauauaauuguauaacauaguaaaacgugaacugccaaauacaauauauugauugaaggagucucaugaagcuuugagagcuucagcgauaguggacaggcuguauucaaccgcagcuccaaaggagaaagugauuaacaaaauaagaaaauaauuaauucaaaagaaaauaugcuuuagaaauaugugauuuuuuaauugugagaaggauaaaauguuuccuuaaggucauguaacuguuagcuacacagguagccuuucugcccgguaguaagcccaauguggaaaugaaauuuaguagugauuuaauuuauaauuauuuuucaaaguuugaggaauaggaacaacuacauuauguucaauagucugaaagcacaaauucugaccuuuaaguucaaaguggaagucaaacugcuauacgucagcaugacaacaucaagaaaaaccaacaggucccaggggacaaggggaauaccugcuucccugcccacuaucaccccaaaaguuuugucagaacuauuuuggacauuugucaaagauguauuuuuuuuccuauuuagaucaugagcuguaaaaacagaaaaaaacaaaauaaugggcagaaaucuaucugaaacccacuacuuuuuuuccuuccuuuauuuuaauagauaaaaggcuaaaccaggucaucuaccuaaacaagacugguuccaggccucugcuauggcuaaguaguuaaggaaaugauuuuugcaauuaggauggucucauuuauauugggacuucacuacuuacuaggugggugaguguggacagcuuacuuccauaccccuaggcuucuuucagcaucuguguaaagggccauuaagucagaauuaaauaagugguagcuguuauuacuaaauauaaaagccucauagaaaagauauguuaguuauuagaaagaaaauuuucccuaaaacuucuuuuaaaacaucuuaugacaaaguuacagaaauauuuuuaagccguuuguaacuaauacagacgcacauucucucucauauuuacacuuuucaccuuugcuucccaucuggaggagaucauccuccaagguuucuuccagcauauuuuaugauaaucagacuaugaauugggaauacauauuauuugggcucuguuuuugauugcuauuuuucaugugguaaaucccagaaagcugcccaaauccccugcugauuaucuuggccaagauguugacaaacucuuagauuucugcuaucccauuggcauccauugguauugcaauggcauucuuucauccaacggacaaaaccucuuuccaaauucugacaacuucuauauuaucaucauucuucuaauguuaauaagcuugaauuugguaacauuaaccccacaguuaccaaauauggccuccucaugccaacccaccucugcuuuuuguagaagaaacuauuaggccauuuguaaaagucugguuugaugacuccucauuuuguggcaauuucauaaauaugaccaacuuuaucauuagucuuauuuucuuucaauuaaucaacaaagccaugaguaaaaugugaaaauuuaauagucuuuucccaugauuucucacagacaauauaauugagcuuuccauguuauuuuacaguucuuuuuauaugguaggcacuaaugaaggaguccacaaacacugguuacauagcacacaugguugaugucuauuuuucacaugguacuuugaggguggaggguaggugggaagggauggauguauuccauaggaucuguagcaacaaguauaaagcuaauuuuguaaacugcaacuccugaacacuggugccuuuggagaaauuauuuaucauauauuaucuauauuacagagauuguguuuggcaaauccacgguuuuagagucaguacacaaggcagauaaucauuugucugaaaaucucggacaaguguguuuacuaucuauaguagauggcaccauuuucuucacaaauauuuauucuccucuucuccuacaucgugggaggaguauacuacuuugcuuuacugauuucaagauggucaugugaugugcuuuggccaauggaucacaaguggauauaacacacggcccucccaaaggaagcuuuaaacguauguguguggucuggguuggccuucuaaccuccugcccucuaccauaggagcaaaauguuccagauaggggcugcuucuucagccugcguaaauggaaugagaagacaauggagcagacccaaagccagcugagcccagccaagaccagcagagccacagcugaccugcagauuugugaacaagaaugaaugauguuguuguaaacuaccaagauuccagguuguugccccauaaaaacugacggauauacuaucccuaagucuuaauuacuucauuuaauaaauugugauuuaguguguguaaaacauagugcugaaguuacuauagugaaaaaaaagcauauacugccccugcucucauagucuagaggaagaaaauggaaauugcaccaucauucuagcacaugugaauuacaaacaaguaaaugcuaucaaggaaagaaaugugguuccauuagaacauauaauaaaggaaaguggccaagacugagguuucaaaagagcccuucuagaagaagggauacgugaguuggcauugguagaaugaacaggaguuagcaagguaaaaagacaaugcaaaaacauuccagucaagagagaaacaacaugcaaaggccuauggcuaaaggaaacacgauuugguggaggaaugaaagaggcuaguauggcugggcaugaaagaaagagggaggccuggcauguggugagauuagagagaaagacugaagcaagaccagaggccuuuaaaggccauguuuuaaaagcuagggucuuuauccuauguacgaaaggaagcuagcaaagguuuuuuguuuuguuuuguuucauuuuguuuuuuuacaacaacaacagcagcaacaacaaaacuuguauuuuaagcucagggguacgaggguagguuaguuacauagguaaacucgugucauggcgguuuguuguacagauuauuucaucacccagguauuaagucuaguacccguuaguuauuuuuccugauccucucccuccuuccaucuuccacccucugauaagccccaguauacauuguuuccucggcccauauguccuuguguucucaucauuuaacucccacuuauaagugagaacaugugguauuugcuuuccuguuccugcauuaguuugcuaaagacaauggccuccagcuccauccauguccuuguaaaggacaugauuucauucuuuuuauggcugcauaguauuccaugguguauauguacaacauuuucuuuauccagucuaccacugaugagcauuuagguugauucuauaucuuugcuauugugaauagugcuucggugaacauaugcaugcaugugucuuuauagcagaaugacaaagguuuuucaauggggauaaaguaaggaguucuucaucaguuuguguuugauaaagcucugacugcuagcuacauggagaauguauugcagggaauguagagugaagacaauaaauaagcugagugaggaaugcugguggcuuggauuagggcacuggcauuagaaauuagagaaauagauagauuugugaaauuuaggaaguaaaaccagcaagaucagcacugugaauacaguauugcauguuagaaaaagaaggauguucuauaguacuacuauccaugaagcgauagaucuuacaauaaagaaggaaucuaagaaauaaugucucuggauuaugaauuugacuuaauuuaucaauuagguuugacuacuugaaaauaacccauaaugguagguaauuucaacucccugccaccacaguuacagguggaaacuguuauuacugaauaauggugugagcauaaaugauguuugucaaacuugugaaucuuaggaaaacucuuuggacaagugagugaauauuaauuuagacuucauuggagaguucaaguuuuuucucuuuccauauaaucuaugucaucuuuuuggaaaaggugaaaacaaaaaaauagauaauacaaaguacuucaaaaugccaaagacuacccucugagcuagcuugaauucuauuccuucuauuuauuuggaucaauucuuauccaaaucugugagauuuguauauuaugaggguguuuucuuugacaucuuaaaguucaaagauguguuucaacaaucuuuagaguagguacuuauggcaucacagcuuagcuucucaaaaagccaauuauaagacacagcuguuaccaugccaaauuccuauauauuugguuuuaaaaaaaacuaauucuacaccuggcugaugaaguaaagacgaacgugauaguauaaauguacagacacaaaucacugcuuuaagauucccucucuagacccacauaguacauaucuguggugucuaccagcuaagcuucucuuccuauauucccacccaaauucuuuugggguaccugcaacucccccauugcaagcaguccugguaggcuaucaaauaaaacaccuuaucuaccaagcaagagauccaggacaggccaaacagauggcgugcuccaggaaugugacucuuggcgauuccaaaugauaccaggacauguaugguuggagcuacaucacuucaauggcagcauccugaggagacugucauuaccgcaaccaggauacccagagcugccccaacuucuauuauuucugaggccuguuugugcuuagcuuucaaauuucagucuaugaccugcuucccauagcuuuccaaucuuguguacuauuacauaaguagaagcugauucucagauaagacaaguuguccaaaaucacacagauaauaaauagaugaauuaggauucacaucucuguuagacugaauccacauucauaaucuuaauaaauucauuauacuguuccuaugaucacaucucaaauggaauuuguaaaaagcccaguaacauuuguuuauugccuuagccuaccacuuagaaauuacaaugaaauguuaacuauaucugcuauuuugcuauucgcaagugacagaugacuuggaaagcauguccacuuuaguccucuaagcacauuuacauuuucauauugccuucacaugacauuucuguggcuacacuugcaauccagacuagucuuucauccucuguugacaaugaucuguuucauuuucagagaaaacuacccaauaagucucuuuaacguuauggauauagucuuucuaaggaauaggaagaaaauauuuuuucauugucuuacaguuuuuuuguuucaaugaauacaucacguaccugguaaagaaaccuugcuaccgucucaaccuuugccaacauuaucauucacagagauuccaaugagugauacaaacccuagcagcuucagccuacagcuuggugagguugacuacaaagagcgcccaucccagaguuacuaguacucuuauuuugccaucuuuauuuuugucucuggaaaaugaauaaaaugucagcuucaguagcaacauacuguggaauucauaaaacaaaggucagguaugaagaacacaggaaaccaaugguagcaaaaggaaacccaaugccugagcuggccaucuuggcgaguggggaaaacuagaacagcacugaaaaccaagcauaguuaagccaggauugauggguaacagcugcacuuugcaauucaccugcaauucagauccaauuucacauauucugcaagcccaaaaaaggccaauuauuguuaaguuucuauaagaguuuaaacggccaugauucauuuuuguuuuccuuuaggaauuuuaggacccccuaagaaguauucucucuucuacauaucauuucuaggccuugaauuugaauggagcaucugcugaguauaauggaccuauuuggccuuuuaucucauuuuuugugaagcuagucaaauauguauccuuccacuagggucagcaucgacuagauggacuaggaagaauuucauuagaaaaugagaucucaugggagacgauaaagaccaggcuuccaagacagagaugugaguucaagucucugguauuuacuagcugaagggcugugggcaaucauguuaccuucuugaaccugcucccccaccuccccccacacacacaauauagaaauaccuaauuuguacaauuacgaauccaaaauauuaaauuuaaauuuaagguuuuagcacaauggcacauaggaaugacuauagugccauuauuaaaaauccaguaagugcauuuaugcaccauauaauguaguauauguuguaaauucaauaguacauaauagaaucauagucucuaaccucggaggucuuacaucuaauguuaaugacaaaccaagaauaaauuccaguaagggggugaaaaguguucugaugaugggggaaaugcagguaauaaugaguagcuauuuuauuauuaaaaacguaaaacacauguacagcagaguggucaagaaucuaaacucuaucaucagaaugccuaggugugagucucaugucugcccauuacuuucagugagacuuugcauaagguuauccaucagugaaauuaaaaugauaauauuaacuaucuuaaaggguuuucacaaggauuaacagagaaaauauguaucguacugagaauggugcuggagauauacuaauccuucaauaaauauuaccuauaauuaccaccauuaugccaauuccaucaguacugagcuauacagaaauggucgacacccuucagaaugucuccuucuacacagacaaacaucgcuuuauguguuuuaagacaaucaagcuauaacuagagaaaaaucuaagguaucucuaaagacacuuucaacucagaccauuuaucuuuaaucaaaaauuuggaaauuuugauguuaaaauucugaaauuauuuugaggguacuauagggucuuagaauaaauagaagagaaaaauaaacauaaaaugagaggaagcacccccauagugcuggauuuuaauggagguaucagcaucaauccaugauuuaaaauauauguauacauauuuuccaguccuuucuaacagaagggccuagaaacaaugucaccugaguagccaugagcacacuuaaugcccagaucuugguuucuaauuaucuucuauuuaaaugaaccauauagcuaauuccagaucugaagcagggaaaguauguuaugccaggaaaugaggacagcuuauagauaaauaggguuaucucaaaagggcagagacaucugaauaaagggacuucugcugucaaauugggcaaauuuaaucaaaaugauauaauaaauggauucuaacaccuugaauuaaaagugaucucaguuuacuagaugagagagaaacagcaacagacaaaaaggggcuaaaaaaauugaggagagguaaaguucuuccuuacagaauaaugucuguaaauauauguugaaagaacgacaaaaauagaaagcuaacaucuuauauaucccauauuauaaaugacucaagccagaaucaccaacaaaugcuaaaacaaacaauuaggggaaaucuuauuguggaacaagacaugucuauuaauucaagucacagcaaaccuaggaaaagauugacugauauguagccaugguaauaaguagcauccugaaucagauuaaagucuauuuaauuggcacuuucuagucaaccaaucaguaacagcccuuuauugcuaaaagacagccagucagcaacagacucauacaucucuaagugccaauuaagcaaccugccccacuccucaccugaaucaacauguuuccacauaugucagcuuacuuacuucugaaaaucuacuuaacuccauacuuuccacuuuggucuacucagacugaacucgaccagcauaguucuccuuuacaauaaauucagcuuugucuuugaauuucagaugaauggugaacugcauuaucaccccacuauauaauaauuaaaaagaaaaaaacugugucuuuuacagugggguaaucuggcagucaucaacuaaccaaauggugaaacuuggcauugucauuagugaugccaauagccugacaggauguacugaugcagaggcaaggggacaacauaaccuauuugguguccuugccaaaaaugguuuaaaugaaccgaaucaggagaaaacaaugagauggaucaagauaguaggcuguugcaugggccauauggcuuggaaucuucaaauaauuuaaugucaugaauauccaagggaguuagacaauugauauauauuuuaaaauauuuaauaaccaaaugcaauuuauuaauuuaugaauaaccaaaagcaauuuaggaaccuugacuggaucugugucauggaggaaaaaaagccaacugagaaagcaaauugagaaaaucugaauauggaaaauaugauauuacugaacuaaugugaauuuucuugggugcaguaaaugggguuaguuguguaggaauguuuccuuauucuuggaaaaugcaagcugaauuauuuaggaguaaagcauccuaacaucugcagcagacuacuguuuguuagaggguuuggcacaaaggaagugucuacagagacacggcacagauauaucaagaugucaaaguuaaugaaucucaaugagagauaaacaggugaucacugaacuguucuuucaacuuuacugagguugaaauuuuuacauucuauuuacuuuuauucugaaucuuauauacacagaccacccauggaauuucccagguauuuuucuucagccucaauuucucacuuacaguaaaaauaaauguguuguacucuguuuuuguaagucagcucaaaacuuuauuggcagaaacagugguccaaauaagcaaaguucaaaacauuuaauaauaauuuuccccuacauaaaaaaggcaaauauuuuucaguuaaggauaacaaagauaagauucccuuuggaguuuaaaauccuccaaucuuucagcuuuguccaugucauuauccucagcaaacacacacaggaacagaaaaccaaacaccacauguucucacuuacaagagggagcugaacaaugagaacacauggacacagggaacaauacacacuggugauauggacaggaagcaggagggaagggucccuggugaggguucuacucucaagccuggacccauggccuuaaaugagaauaggcaugcuuguuuuugugcccagauguugccuuuuccaaaaccacucugaccugcccugcacccuauccugugcccauaagaaccccaaaccccacgcuccaugagcagaagagcagcagagcggcagagcagagaacaggagagaagaggagagaagugucugaacguggagaggacaagaggcagcuggacaucggagacuagguuggggagaaguuuggccagggacagccuuacuccaagggaagauuaucuucccacuccauucccuuuccagcuccccauccugcugagauccacuuucaucacccaauaaaauccucugcacacacuacccuucaauccauuugugugaccugauucuuccuggaugccagacaagaauucaggaggcacuggguguggaaacccaaaaaggcugucacacugacucuucacugagcuggcuaacacuuaagcugucuguggauggcaaggcuaaaagagcauuguaacacacuuggacgcugccauggggcaugcacagggccugcuucugcuggagagaagcagccagcaguuccaguguuccuucacuccgguucccacacccguuuccuugcacgcucccucccguggggaguggccagcagugggcugaguaaaacuagcagcuucaguuccugccagcgaaguggucaagggagcucccguuucacuggggccugucgaggagguggggagaaggagagcaucagguuaaauagcuaaugcaugcagggcuuaacaccaggugacggguugguagaugcagcaaccaccauggcacauguugaccuauguaacaaacccacacaugcugcacauguaucccagaacuuaaaguuuuaaaagauaauaaaaacaagaguuauaagugguggaacaacaacaacgacaaaaauccuccaguguuuaucauaagccauuuugccuccaaugucaguaagacaaccuagaagucucugagaggagagaaaucuuuccagauccaucaggagacacagaagucacaugaaagcguuccuacagacacaugaaaaugcuaaggguaucuuuggacacugaggacucucccaccaacagccacacugacaacagccuuuggugucucacucagaggagucccuggugggaagccaggcuguaaucugucacaagagcaugugagcagaggccaccuuacuagauaaaaugcagcugguuaccgcauucccuggagggacagugaccuccgacagacaaggugaggcaggcagacaaaacagugggcaccgcaaaugaacaggcaggcgcggaguggugccuggaggaaagccucugaccuggagccgagggagagcugcuagauaaacaagccauuauaagaggguaauauuccauccuagugugagcggaagcugggaagaaaaccaacuguaggccugauguggacugcagcuggcaggaaggcugcagagcucgguucaaggcaggagauccugccccugucccuggcacagaacacaaacagcaccacuggauguggugggaggaggaggaaggaaaaucuauacauuuacgggacgugaaaugcaagaaauugagggaauucguccaggaaggaggaaugacaccauuaauaucaguauuuaugggcuuacaagaagauaaaugcauuucaagaguagccucaccccaaagagaacuaaccacacaauuaagaucaaggcuacugucauagaccuggcucugcuuugaaaaacaagcuacaaagggaaguuugggcuuuaauuuaaaaaaaaaaaaaaaauguucacggaaauaagagaaacuuuaagaaaacuuguagaacacaaaaaucacauuagacucuucuauaauucucauaacaauagaaacuuaacaauaauggagcuuauauuugaaugcuucauauggacgagagagaguuuaagcauuuugcauauauuaacucacaugauccucacaacaauuccgcuggguagauacuauuaccgcccauuugaagcauaagguaacugaaggaaaucuagguuaaguaauucccagggcuugcucuuguaagacaacugagcuuggauucacauccaggcccucagcugcaaagcuuauauuccucagcccaugaauacugccucuggguaugcaaaaaucaccuuugccuucaggaaauaaggcucacauuuuuaagugaacacucaaguugauauaguggggaaggcggggaaggcagggaaaucuggagcugagacaaaggaguggggaaacauacuauggguucagaggaccuauccacaaaccuguuggucucuguaccucuucacgcuguugaaaaauugacuacaccgaagagcuugaauuuaugugacuauauuugcugauauuuaauuccaaguuagaacuaagaaaauucuaaaauauuuauucauuuacuuaaaauaauaaacccauauguuaauguaauauuuuaauaauauuuucuaaaacaaaaaaacuagugugaagagugacaaaucucuaaugaauggcuugauagaagauaauugcauccuuauuucugcuucuguaugcaaucuaucaugagaugucuucgcuaaagcauaggaagaaguuggccucauauagacauauaguuggaaaaggaacuacuucacaaauucugcaaaggucuuggggaccuuccggggccccaggaccacuggucuagagaaaggacucuagaguuagaccaccuggauuugaaaccuggcucugccacuuaauagcuguuuggucuagaucgauuuagcucauauuaucucauucucucaucuauaaaauggagauaccaacaguacccaccugauagguuugcucaugagugcuaaauuaauauuuaucaaaugccuagaacaaucucagagcauaaauauuauauguuagaugaauaaauaaaaugaccuggcuuugcaagaagcaucuccgccagaguaacgucucuguacugaauuguacauucugacagcugagacaaugacagggaucacuugagcgaaagugaucaauuacacccauguuauaauagggauaauuauaauaggagcuucaguaaauugagaaaucaauugagauacaaacuucgacuucaugggagcuaagaaaacauaaucauuugaaucucuacuccucugaggauggauagcaacauccuuucaaaacccuuucauguucaaagucacaucagacaggggaaauucuuuaauguaauuucuguugcauuuuggcuauaaaaacaugucgagaaguuguuaagcugacaaauuccaagguaucucuuaaugacaaaaagugggugaauaguuauaaaggcucaagaguuaauguuauuuuaggguuaaguuaaauauauuuuuaccugugcaaauuuuuaucuauuucauuuuuaaaaauugauaaaggucauucaggaggugauuugagaacacacaacuuguuguagauaucuuucuuauuuauauuauugccauauaugaugcaauacauguaaaauucuuccaucccauccuacuauaccuuucacauauucuuugacauuuuauucccuccaucaaauaugaguugucuuuuagauagcaucggaaucauaggauacuaaguagcuacuuccucugucucucuacacccaccucccuaaaacuacaggcggcugacccacugauauuacuaugaauuuuuugcucuucaucaacggucaaaggguggucuucaguccaauggccugguuaacugggaauugccauauauggcuuaucauuuuuaagaaauuacaauauugcagaaagcauuuuauaugaaaauuauauuaaacauaaucuagaauguaaaacagcaccauaacgucauauugaauauaguacauuucaugacucagaagacacauuauaguugugccacaauccccaagaucugucuuuucaauauuaccccuaugcaggaaacaugugaaacuagcaauuaauaguauaaagaccaacuuaggaguucuguaaagaaguuaguuagaaugugaaaacaccgcugugcuucuagaaccauacugcccgguucaucaugacacuccuggucucuccauuuauaaacuuggaaauaccauucuuuaccuucuucaaggguggccaggaagauacagugaauuuuuaaagcaugccuaugaaguuccaugaacuuguuggugauaguggacuagcaaaauaaaaauuagaagaaagaaaacucauucaaaaaaaaucacaagaaaauacgcacaaauauuuaaucucaggauagauuuugcauaaaagaacaggaaaaacucauaaaugaccaaguugacaaaacuaugacaaaauuucuacauguuaauaacaucuuaaagaaacugaagaggcuagggccaaaaaaggaacaauauuugcaacaaaugugacagguagaggguuaauucguaaaagaucucuaacauauuggguuuuuaaaaauaucccaauagaaaaagaagcaaagcaccuucauagguaacuuauugauaaagguaauguauauauauguuuaaaaguuaacuccacuagcaauuagauaauaaaauguaaacagugagauauguaaaaucuaucaacuuggaaaagguuaggccaaaacaaaaaaccuaauucuugaaguuuaugagauguguacccccaugcagugcuaguauacaauaacuuccgaauguucauccauuuaaacaccacauaauauuauagcaaguagugauuccaguuuaagaaauuuagcagaaacauuaccaaagauccuguaccaaaauauuuguuacacauaugucgaaaagucaguaauaacuaauaaauuauaguagauccauauggcacaauauuauaccaucguuaaaaauuucauuuauaugcaggcugggugcgcuggcucaugccuguaauccaagcacuaugggaggcagaggcaggcagauugcuugaggccaggaguuugagaccagccuggccaacauggggaaacuucgucucuacuaaaaauacaaaaauuagcugggcaugguggccuguaaucccagcuacucaagaggcugaggcaggagaauugcuugaacccaggagguggagguugcagugagcaccgagguggcaccaaugcacucuagccuggacaacagagugagacugucuaaaaaacaauuauuuuuuacauacauauuaaaacgucagaaaaaugucaacaaugaaguagguuaaaaucauguuauaaaguguuucucuuuuucaagagaaacauguaagaacaaagaaaaaaguagaaaggaauaaacugcaguuuuggcaaagguuauuucuggaaaauaagauuauagaugguuuuuauuuuguacagugggcagauauucuuaugauuagaaaaaauaaaugaaagguuuaaaaauggguuacacuugauauaaacuagacugcagcuucauagauauaauuuaaacaaaacguuuauuuagucaagcaauucauuagcugguuacugguagacugcauuaaaaacaccaaauaguuugaauauauuuacaguuggcccuugaacaauuaaggggcaagugauccuguaccacuccccaucugcauaguugaaaauucacauguaacuuaacuucccaaaacuuaacuacuaguagacuauuguugacuggaagccuuaccaauaaacacuugauuaacaaauauuuuguuuauguauuauguauuguauucuuaaaguaaacuagagaaaauauuaauauuaagaaaaccauaaggaagagaaaagacauuuacaguauuauacuauauguauugauaccauagcuugacaucaucuauuuacaagaugaaucaucugucuaaaacuguagguacauaucaaggaauuuaaccuuuucuuguaacaucauggcuuuucucugcuucuugggagcacguccagcaucacuagugacccuucauguuagucccaugguacuauuccagguuuaugguaugcaucacacacaaagaaaaaugagaaccaugagagaucacuuuuuacugugaaacaauuuacuggagugaccaucagcucagagaugauuaguguccugaggaguuuuaaacagauacucccaacacuugagcucaccccaauagcaauacaagguggcuacaaauuucuuauaguacaguauguacuauaguuaauuuuaugcauuuaugauuucauacaccaucuuuauauuucuuuauauuccucucaacugcaaguggcaccauguccagacuguguuugugugccuacguuucgauaaauuuuaggcuuguuuguguuuaugguacuaaaugauagaacagacuaguaucuacauauauuaaugacauacauuuauucuuuuuuuagauauuucuagcuaguuuuuuuucaaauugucacaaauguccaaaaaauuuuucuaauauacuuauugaaaaaaauccacagaaguggacccacacauuucaaaccugugcucuccaaggaucaacuguaauuccuuuucuccauaacauuucaguaguaucagaacuacauuaaugcuccguaccuccuguguacggauuauaucaggaggcugagcuguggaugaaagagauuuuaaaaagaaacaguagugugauuugaaacuaaauaaaagagaaacaucucgucuagagagcaugucaguccuaguccaaaccuuuccagcauguacaggcugaacacuccaaaaugaaggucuacugcuuauugcugaauuguugguagucucaaugaccccaggauugcagagaugcuucacuuucaaaaaaaaaauccauuaaaauuaguucaaagaggacacuaacaugguguuagagggucauuuuucaauguuguggguggaggagcgagacacuuagaguaacucccauuaugguuaaugagaguugagcaucuagacucaucuaaacccccugaggguuuaauuuaaaaccacuauggcaaagcaacucuaagccaugaaugaacagcagcauuuuucacacaccuaccucuucccaaguaccaaaaacaguagaaauaauaaaggugaguuuguuugguuggguuugauuuuuacuaccaugccucauagaagagaaaaaaaaaggaaaaaggcucauaucaaaugccuauaaauuuuuugguuuauuuuaaauccaggguguuauuuuaaugccauuuuuaaaugacuaauuuaaacuugagucuggguuuuuccaguugcuaugugauguucacauagaaaugcaguauuuuuuuaaauuccauuuaagcuucaguuuuacaaauuuagggcuaccauuauauaauguccauuccaagacccaugcucuugaucaaccuuaaggcaucaggauaauggacaauaaaaaaaaaauaaguauuauuauuauuuuuugaggcggaggcuugcucugucucccaggcuggagugcaauggcaugaucucggcucacugcaagcuccgccucccagauucacgccauucuccugccucaaccucccgaguagcugggacuacaggcgcccgccaccacacccagcuaauuuuuuguauuuuuaguagagacgggguuucaccguguuagccaggauggucucgaucugcugacuucgugauccgcccaccucggccucccaaagugcugggauuacaggcaugagccacugugcccggccaaaaguuauaauuauuauaccaugcuuccaauaugccaaauuuauucauucuucugacuuccauaucaccuuguuuuaauucucucacaagagcccaggaggcaggcaaauaccuguuuucauagcagaaaauaccuuuaucuucacaugagcaaaucaaacaaaaaagaauaaaugaccuaaguuuccccauaugggacuaaaauacauuucuccaauucccuguccaaagcucauuugcaguuuugacaaguacaaauguuuuguacccaaagacaguaaaugaggcaguagagccauuggcaggcagagcucuuucuucucccauguacauucaacaauaccagaaacaggacugagagagccuuguaaccaucauuuccaugguuugaguuuugugguagggucagggaaggccucuguguguaagugaugacaagggaacaggaauugaaaggaggaaaaccagggacccuguguaggucagaggguggcaggugaaggucagaggaaugucagauuuuacuuuaagugaaagaaacagcaacagcaaccagaaguuuuuuuuuuuuuuuuuucugacacagagucuugcucuguugccuaggcugguugugcaguggcacgaucugagcucacugcaacuucugccccccugaguucaagcaauuaucgugucucagccuccugagaagcugggauuaaaagugcccaccagcacaccuggcuaaguuuugcauuuuuaguagauacaggguuucaccauguuggccaggcugguuucgaacuccugaccucaagugaucaccugccucagccucccaaaguguugggauuacaggcaugagucacuaugcccagccagaaacaaccauaauuucuuaaugcaaaggaacaaccuguucuuguuucuguauuuuuaaaaaucuaugucagcuacauagugguagacuggaggauggauagugguagacuggaguugcgggagugauaaacaaggaaaccugagagcucacugcacccaguucagacaagauuuggcaggaguaguagagauguugaguaccagacucagaacauauuuuugagaaacagccuccaugugcauuggaaggauguuuugagaaugcugucaauuacauauucuggcaucaucuccuugaggaagaauucacagaaaaucgccugaucucugguguugugcacauuucugcauuuuucugaacaaucagccuauuuuuaccucaagaauugaugcucuuuccuuauuuagguuggugauagaaaguucagggccaacuuugugacccaucuguuuuuguugguuuucaggcugcuaaagacacacccaagacuggguaauuuauaaagaaaaagagguuuaauagacucauaguuccacguggcuggggaggccucacaaucauggcagaagucaaaaggcacaucuuacacggcagcaggcaaaaggaaaaaugagagccaagugaaaggggaaacuccuuauaaaaacagcaaaucucgugagacuuauucauuaccacaagaacaguaugggggaaaccaucccugugauucaauuaucucccacgggcucccucccauaacacgugggaauuaugggagcuauaauucaauaugagauuugggugggcacacagccaaaccauaucacuaucucuagcaaguauauaaauauuuuauaucuauuugaugcacuaaucucacuuuugguccaucuuacuuuccuuuuacuacuucuugaauuuuguaguuugcuuuuuuuuaaagcacuuaaaucuuacucuacuuuuucauagucaccuuaaaucauguuuuaaaaauucuaggaaauaaaugaauaaacaaacuaaaauugucuaauggaaauuuccuugauuauuauagaaauaauaaaucagaagaagguuucaucaaagggaucaucagaaagaaauagagaucuacaaaagggcauguuauguaaggcaaccuguaugcaugggaagccaagaugauaaagccauaaaaacuugacuaaacugaagaaauugcuuacagagcugcuccagacuuccugaggaaggcaagacaguggcauauacaaucuugggaaaucaaaucucaugagccgacgaguuaucaaacccuucuguuagauuucucucagcugaggaaauaacugauuucaucagccuggcuggaauccacauggaaaucuaugaaaccugugcugggcaugggagggguugaguauuuuucaugcucaaaccaccuguuacuucucucucuuucaaagcaggccacuuuggaaugaugaauauuaguuaugucuccaagcauguguucauguguguuagguacauagaaauccugguugacacuauguuaaccauugcaguauacugccuggugugagaacuuaccacauuauucuacuuguuaaaugaggaccguuguccucuuuuaucuuuagagcuaaaaagccaacauggucaaccagggucacucaucuagcaaauauucauuuaacaaauauuuacugaacaccuccuaugagccuggcccugcccaggcagaggagaugcauucaugaauaaaccugagaaucaucccugcccucagagagcucacauucuagucagccugagacacacacacacacacacacacacacacacacacacacacacacacacacaaauaaauuauauaauaauuuaguguauaaacacuacaaaggaacgucaugugguaggggugcaauuuuaagauaaugggaaagacuauucugugacauuugagcacaaucuaaauagaggucugaaggaguugagugaacauagcauauguacaucuggggaauuggcauuccacgaagaauaaacagcugcugguucaagggcuaugaggcagcagugugcuuagaauguuaaacaaacaacaaggaaucuagugugguuggaucugagcgaauguggggagcuuugaaaguuguauguagcugcuguaacaaauuaccauaaauugguggcugaaaacaauagccauugaugcugucaugguuuuggaggccagcguggcauccaggugucagcagggccacgcucccucuuugcugcuccagcuucugauggcugucagcauuccuugacuugugaccacaucacuccagucugccuucacgaucauguuguguccuccuuuucuccauguaaucucccugucucacucuuauaaggacacugccauuggauguaggauuugccuggcugauccaggauaaucuccccaccucaaggugagauacuuaacucacacauccacaaagaccccuuuccuaauaagguaccauucacagguuucaaggauugagauauggacaucucuuuugagggauccccauucaacucacuacaggaaaaaugguaauagaugaaaucagaggggcaaugguugauggcaggggguggauggaggaguacaaguaggaaccuugucaaucacugugauaacuuuggcuuuaguuagaagaagguaggaagccacuguggggauaaugagagaagugacauagauucaacaagucuuaacaggaucacuccggcugcugccaugcaaaaaaguuccaauagcauuuaauccuuacauugauacuuuguuggcuuaagagcaugccaaauuuagauuagaaaugaaaaugagaagaaccugauauacagaucuucagaaaauauuuaauaauuaaaagaauauuccucuaccuaaccauccuguuuugaaccaaaauuaaauuuaucccauaaauauuuaucaaccaucuaauauacacaagauucugacucuaagaauugaagggaucacacccuaccuaaugugguauugacugacaaccccuuuuuuuuaagauuuaugucaucucuuuguguaaacaauaauugaagaaucucaacuuagugggagaaagacgugcuaccauuauauucuuugccauuacuuuuccagccacccuauguugaaucccuuucuggcucuuuaauaauaucuugggcagaacguauaacuauguagucacuuuccauaauuguaaaucucuccauuuuaaaauucuagucuugguucuuuuaaaauuuuauauccuaucaagcacagacuugagaugcaacuuuuauuacuuagagcucucuacaaguguucccccauagugaggcuaagcuaugcuagcguuaaaggcagaguggucuuagguaucagguugccugucaacaggugacagguggccaggugugguggcacaugccuguaauuccagcacuuugggaggcugagguagauugcuugagcucaggaguuugagaucagccugagcaacauggugaaaccuugucucuacaaaaaaugcaaaaauuagcugggcgugguggcccacaccuguagucccagcuguucaggaggcugaggugagaagaucacuugaguccuggagcucaaggcugcagugagucaagguuguaccacugcacuauagcuuggaugacagagugagacccugucucaaaaacaaaaacacaaaaugaaacacacaacacauacacacacacacacacacacacacacaaacaggugacagguaagugucccuggucuagcuccaguuccaucugcugggagccucugcaaauacgguagucugcacuggugaauuaacagacauguuuuuuccaggaagguaguaaagucucgcccccguuuguuucugaggauccauuuacaaaaggacagccaugucucccuuuuaggucugccgguguuccaugacccaauccccucucuggagaggccagcaccucaguuggcccagcaucuaccugagcaaccuaguggugccugccuccuacucggacauucauggucauuuacaggaaccgggggaccugcugagguuggugcuucugggcuucuucaaagggcuaccgaaaaggugaaauaguguagaaaaguuguucucaucuuuuuucccaggaacacuacuccucuucagugacuucuugcucugcuacuacaggccucuccaacaagccuccccugccccacccuacauucaagaaugcaaagaugagaagcaagcacucuugugugcucauguacaauuccaaacuccacagagcacaugggaagcucuccaaaagcaauuguaccucccugcacucccagaucaugacaguaccugugucagccugcagguccuacagcuucguagcaucaagccaaagaacaagaugccagugucauuuuguggaaagcaucccccaagagaugugacuuuugaggcagugggaguaauuauuccagaagagggaagaagaaagcaucccuacacuccucauuucaacugucgaucuuuguccucacguauccucucccuuugcgguuugggggcguggagguauguuucagugagguaggaaugguucugcugcugccucucaguaauguggauguggggagcaucuguccccacaugucagcauuccugcuuaggccuuagcuguuuauuccgcggaaauaugaaaaguuucacucaacaucugcugcacuccugaacuucaauuacauuacugcagauaugacucccugagagauggcuucuagagucauuuggucccuaaacagaauagaaaauacuaacugguauucuaggccucugcaugugaaacacucuagauuuucauguaauuccuguugauuuauuuuuaucuugacacaucuuauuuaacaacuauuaaagcaaucaucuuuggugaauggaaggguaucauggcuaacuuuuaaaguauuagcacguaaaucucuugaacugaaaauuaaucuuaaagauaaaaagaaguucuugauaacuucaggcauuucaaaaccuaucagaaaggagaaaaauuggagagccagaugaauuuagcuccuccuggacccauuuuaucucagagcaaauuaugcggcuaaccaagcuaaacugccuggccccauauagauggcaguggagaguaaggcuuaaaccuucuagacuuucagaagucacuaagguuggucuuauucuuaaaugauaaugaagcuuacaauaaaauaauaaagccacuaacagcaaaaugcccauaaaaauauaaauggcagaguaaagauuuaggaaaauacaacacuagaaaguggggcuaaugggaaagguuuaaacucuagggagaagaacuucucaggacacccaccccaccguacauagaaguuugcagcacaugugaaauguaacuggagaaggugaaaugaacaauggaaugagaaucaaaaguccuggguaaagcccagacucccaugaacuagagccaccauuggucugugccucagcuuuuccauucaaaccacucauaggccaaugaggauagaacaauuuuuguuucagaaagguucuugcucugcagcccaggcuagagugcagaggugcaaucacagcuuacuauaaccuugaacuccugggcuaaagcaauccuccuaccucagccucccuaguaguuaggacuacagaugcaugccaucacaccuagccaauaaacuuuucuuguagaaaagggucuagcuaugcugccuaggcuggucugaaacuccuggucucaagugaucccccugcuucagccucccaaaacucugggauuacaggugugcaccacugugccugugugaaacaaaauauugacuccaauaaugcauuguuagucauaaaauauaauuuuaauuauuuaaaauuaucuuaauguaagauauuaguuauauguauauaaauauacucuccacugccacaguuaccccaaacacauauacaaaaggaaaagaaaggaaggaaggaaaaaaggaaggaaggaaggaaggaaauugccucaguaucccccaugcuacaaguaagcuuucccuuaaaccacuauuaggaggcuaaguucagugugaggaagaugaccauuugauacgaagaaagaguucuguuggucuuaauuaaucagcuaaccuacaacuaugcuugacuuaauuggucuugaagaacaaagaacaugcuuggucuuaggaauauaaaggagcuucuuccaucuguuuuucucccucuaaaaucucccucuaaaaucuacugagaccaugugcauuggcaugucuauuccuguuauuacaauauugaaauacacaaguauuacuuauuacccuugcgugcugcucaccaccucuuuucuuccuccccugggacucuccagaccuccccacaaugcacaaauuaauaggcugaugucuggcacaguagagagcuuucaggaaccaccuuugacauuggucaguaccaccugucauacuaauuguuacacauaaacauaacuccacugccuaagacauauccacccauauccugacccccaaaugcaggcagauacaagcuaaaccaaggcuccugaaauauauuuaaagccuguaguagaaaucucacaaagauaguuuagauugcaaacuacuucagauaucugguauuguagagguuuuuaaggauaaguccaauguaggauuugugcccagaagcuauuugcaaauuuaugguuauuuuuucaguuaauuaguuugagaaaggaaauggcagcuaaguaaauaaauuagaucauuaauuugcaauaaauauaaauuaauuaugcuaauucuaagaguugaacacauauacguauuuuguauauauaauaaaaauaaggaacauacauaagacuauuaggagaggaaagcuaccuugacuguuguaaaaaaauccacguauauguacucaguagauuuuaacaguuuugauaugugcaugaaauauaaaagaauaaguaacuaccuacugauguucaaacaaaccuauuuucauuccaaauggaaauuagaauauauucugcauuauuugaguuaauuacaugacacuucuuauaaauaaugauguauuauuauuccauucauuacuucuaauuauauuccuuagcaagugcgaugccugcaacaccaugaccagucuuuuccuguuccuuaaaaucugaugacuugcauggaaagcaggucaaaaauaugcccagaauauaacgaacagaguucagugauuguuaaccaugacaguuuaaaacuacuugaaaaaguuacuguggaaauaaauagaaauggugaacagcuuuccaaauuacaggauacccaugauagcaacauaagaaauauuugaaguguugucuagauacauauaauuaucauucuaccauucacuagaauuggagaaagaacaccccuaauaucccucucccccagcauacauacacauuaacagaauuacauucuguguagauccgcagaucguaaagauacacauuucugguugcaaaagugacucuacagccuuuaugcaauucugagaaauguaccugcuaaaaguccuaaucaaaaugacaguugaauuuuucuccuguaaugcauaaucaggucaggccagcccaccccaucccaugcacagcacggucuggggcuagaagguaaaacauaguauggaagacaggucaagaucaaggaaagacaguuaaaacuaucauuaagcaacagggaccuaguaacccacaaggcuacuuuguacauacauauccucaccagagagcaggcagcaaggagccagaagagucaaggaagagaaggcagauagcaggaaguagucuagaugaggucuagagaccaacauguacaugccucaggaacaguguuucguggguaugucaccuucauuuugaaggggccagggcaaagugcacaaaguccacacauuuuucuucauccaauuucaaaccuuccuugcacacauacaaaguaccuacuuaauuccuucagcaucagcuuccaacaauccauuguucugucuaugauaaaaaauaaagaugucagucucggcuccagaaacaaaaaauaaacuugggagaggaagagacuagcaaggagggcuuccccuuccccucuagugcccaucacaguuacugccuucugaccccacgugcagccugaguccucaaccuuggcagcucacuaccaacugaucagcugguaugugagauaaaaugaauuuguuuucugcauuguaauucuuuagauggcaagucaagauggaugauggucacagcaaguuugucuuacaaugggaguuggcaggauucucugugguggauuuuagacacugaaaaaagauguuggucaacuuugaaugaugacagcauccaauaacuuccuuuguucccauuguccagugcuaucagaagcugcuuguagcugguggccauguacucuaauaacccaaggguaggugcacauucauauggaaaccuuucccacagaaguaggaaaaagaaagguccaacuuaacagucacugcuaaaugcaugucuuugaacacaauaaucugccaaaugaagucaagaaagaaaugugaccacaagaaaaccaacuugccccacuacaauggacagcaauauugucuuugaacauuucuccuccaaaagcucuuaagcuggcuaauauacaacaagcaugcacagagcaaagacaagacaugugcuuagggaaauuuuaagagcaaaaaccuaucuuuagcuauaaagauauuaaaauagugcuugugcucauuuuacuuguacaggaagguuugaaaagaacucuuuuuuuuuuuuuuuuuuuuuugagacggagucucgcucugucgcccaggcuggagugcaguggugcgaucuaggcucacugcaagcuccgccucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccgaaaagaaacucuuuagagaaaugaaagaucacuaauaacugcaguuuccugaacaauuaaaggaauucacaagauuacaaccuacugaggaaaugacaaauauuucugauuuuuauggaaggacuaaaagggcgcuuuuauguauagcaucuauucuguaagaaucacuguuaaguaaugaagcuauuuuuauuauuuuuccacuuauuucaggaacacucaacaugguaacggucugaaaacgggggaaacuuaacauugcucuuuggaaaguuaauauuccguauuaaaagauauuugucagaguuuucuuuuuuaccuuuugaauuuggaucuuggagcacuguuugcaugguagccaacuuuuuauuucuaaugugucagcagaaauguucuuaaaguuaccuagucuaauucucucacaaauauacuuuguaaggcugucccuacaugcaucauccuaauguuguauggcccugguaacauucugcgugagauggucuugauuggaaaaaucugcucuuuuuaauaacugauucaauaaacuguugacguaugauuuguagaauacaguaugaucagugagcaagguuucugucauuacacacccuauucaauucauccacaaauguugcugugucucccucauguugcagcuccuuaugccauucagaauagcaaugcagagaucaauacacucucugcugaagacgacagaacaaaugaauaauuuuauuuacaaugaaagccccagucuucaaauggauaccacuaauguuuaaauucauuuucaugcucaacucaagaagagagauagacacagcacaaagcaaagggaguggggguaaggagaaguauuagccauaaugguucaaauuuauuuaagccaugaacaauagcugggcugcacugagacacaggaauaaaauguuugcugcagaauucugaauguguacucuucaaaaugauucugucaccaagaaacucugaaaagcauuuuccaguaacaagaaauuaauggauuaaagacauucugacauauucuucuaagcguugcaccacagaagccaaagccuguucaauaggcuuuaaacaguguuggcaaggaacagaagcguuugcuucaggugggaacaaggagggacugaaguggcuguuuugagaaugaagcaaacgauccugcuucaaaagcguaucuuuggccucugauuugacaguucuuuuucuuucucugaaagcuaugaaaaagucagugagcaaagucauaagaaauaaguguuggugaggggcagcaaaauguuauaagagagacaaguucaaagaugacauuuacaagccucucaugaauggcacacuccccaaagggcaccugaaugccauuuuuaagaagaagucaucaaacauacaaaauaaaauguuccauuuuacauaaagaugccaauauacugcccuuaaaacacagauugguccauucacaaauuaacauguaaagaaauggcaaagaaccuucucccaucugccaucaauucauucacugcuuuuagauuuaacucccuacacucacacgcuuguaaacagaauuguaauggacaaaggaugaaggggaagcugggaaaaccuagcuuggacaugauacugaaacaucuggaaaaaaguggugacaagacuuggccuuggggaugggaaacgggaaaaggugggauuucggcacauccugucucucuauucuguuaacuggaacaaugcauauacuccugauguuuccagcuucacuuuagauucagugaacacaguacauuuggaugcuaagaaaaaagagaugugcaagagcaggucucguccauaggaagcaaagacucagugcagacagaaauagggaugcacguacuuuggauaugaggcagacugggcuguguguuuggucuugguaccuggaacagaguaugagcucaguaauaaaguacugaaugaaucaacaugagaauaaggaagugagugucacaaacagaggacagaguuuuguuuuguuuucuucccuaggagcaggggacaguuaucaaagcacuucagaugaaaugaaaagcauggggaggaaucuccaguugaggugaggggcaggagaaaguauaguaaagggauaguacaacacauauucagggaacagccggaaagaagggagacugagccaguacaaugaagguccuuaaaaacuauucuaaggaauuuggacuuuauccucaaaaaacagacauuccuuauugguuuauuaacaagggaagagaagaaugauauggucagggcugugguucagauaaaguuauaggcuacauuggaaaagcccagaggcagggagacagcauaaaucuagaugaaccacaccuaagggcuagacuagggcaggcaggagagaacacuggaggaagauaaaagcccacuccagacaucucaccauuuauuuaugaaauguuaguggacagagcuauccacaucuuccauucucaagucucaggacaaaagacuagagcuuucugcaagcaaaggaguaccuuauuaagaugcgucucccaggccgggcgcgguggcucacgccuguaaucccagcacuuugggaggccgaggcggguggaucaugaggucaggagaucgagaccauccuggcuaacaaggugaaaccccgucucuacuaaaaauacaaaaaaaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaaaaagaugcgucucccaguuguaacauggcagaguuuauaaagguaaaguaaaauaaaaaguuacaaaaucaucacauaaaaagcauugucugaauacacugucuacuggcccugagacuguuuuaaauacugcagcuguuaauuagacuuauagaguauaaugauuuuaaaaaagcucugguucucauuguucuuauaaucagagaggguuggauccuucuugcuaccuuccaaacaaacugaaguguguuaauuuuaauaaaauauucuccgagcccuugguauuuacucaaauauaaaguaacugagcaggguucauuucccaaauggugacaccagugccaucuacaaagaaacgaguugucauucacuacuugcucacuauucacuacagauauuuuccuagacauagacauuucuacuuuucuugaguucaaacucagguaugcccugguuuuagacaucacuuuuucugaguuuguuaaaaagucugaaauaucaaauuacucucaagauaugaguaaaaaaacuacaaagcagaguucauuccauuauuaaccauuuuaaaaaguggccaacauggcaaaaccccgucucuacuaaaaauacaaaaauuagcucagugugguagugccugccuguggucccagcuacuugggaggcuguggcacaagaaucgguugaacccgggaggcagagauuguacugagccaagauugugccacugcaacuuagccugggcuacagagugagacucugccucaaaaggaacaacaacaaaaaaaagugguacaucucugugaccucuaauuuucauaggaaugagagugaauuuagacaaauggaucuugucuaaauucauauuuucaucccaggucccuuuauuucuuuucuaaaagucaguuaaagcuggcaccuagagagagauggcauuuaaaccauauucuuuuaacaccugaauuuacagacauuuugcuuuaaaaaaccccaaaggaaaaagcccacuacaaacuuauagcaaaauaaaauguuacuucaagaaauucaggucuuuuaaaagauuucaauacacaauugguauuaaaauuaaaagugcuguuuucuagggcuuuucuaaaucauucuaguguuuuuuuuuaauaaacagaagaaaauaguuuucuaauauuauuuagacucauuuaaaagaagaguuuuaaauauuaagaaaagcuuacauauuuacuagaguauugcuuauuaguuuucuaaauuaauacaauuuauuugacuagaauuuggauuccagaaauuugggagucuauaauacaaucacaauuaucuuuugguacauguuuuucuuauuuguauuuuuuuuuuuuuuagcauacaauaguuacguggcuagaaaagaagcuuguucauaaaguucucaggcacuuuccacauuuucacuggaaaaaaaauguagcuuacucugaaaaaccucuuggcauauuuguacauucagaauuacuaagaaauucauuucaaagcaaaaucaugucucagcguggaaaauacuuauuaucugaaaauaucaaauuuuauucuguugccuucugcauggcaaacuaagugaaggaggaaagagaaaaacauccugaagaguccguacaaaauucauaugcacacaaucaggagugaaacuuuuaacaacauaaagauaacuucccaagcauuucaccaauacuuguuauucccacugcaaaagaauaaagcuccuauugaagucuauaggaggaaagacuacaacucaguggucagagggaaauaaaacaacuccaccaaugacacuggucaaugaucugcaagcugguauuuuucccaagagaaaaugcuauuucagguccuaauauuuuuuaaaaaaaauuuguaaguauaucuauaauauaaauuuaauuaaaacgcacaacuugaaugaucuccaagagguaaagcaacaaagucagucucaaauccucacauaucuuacuuccacaucacaaaggcaccacucaaucuacuauuaaaauucacaacagauaagcugaaaaccaagugcccgugauauucacugggcucauuuuagaagcaccuauuuauuuacucagcuaugguagugaaaaggucaagcaaaaauucaccuccaaagccacgguugcuaagcaacucuccucagaaguucugcaacauugaucaagcauauuacuggugccaccaacuggauucagaauaaauaugaguaacaucuuaccuggugucuccgaagugggagggagauggauucuuuauuuaccuuuuuggacagacuggaggccaaucuuguauuuauauucauuuggcugguuaggcucagaagacuuuuauuuucccucuccaaaaaaaaaaagaaaggauacguccugguaccacagguuuccuauucacaagagcgaaggacaguucuguuuugagaaacacuacagagggcuugaugagauguuggccaaaucugaacgacauguccucacaguugaagucuaaaagaaaagacaauggauaguuauaaaauucaauuaagaaacucaguucauauaccaccuuaaagaaagcaaauuccauuacuacagauucuuaguugcagagaggaugccauugaaauuguuccucauugaauguucaccaagaugcauucugggaaagucuuucuaaaauacuccacucucccuaccaguguuuccuugauuagaguuagcaauuuucaagcagaagcuuccacguggacaauaaaacagcuuuuccccuucacucccucugcacuucacggugccaccuuaacucaaauccacaaggcccuauuugucagcuacuuauuuuuacccaucuauuuugucaugucugcuaagcugaaaauuuucauuaaguauuaacuauaaaccuucuaauucuuaaaugcuucucucaaaugguuuuguguucauauaauagcaauuuagaacaaguacgaacacugucugaccuugccuacaauuacaaaaacaugagcacuuccagagaacuauucuaguaaaaucuccaaaauaaaggagaaaaaaaacauuuaaaaagaaggaaggagcaaaacggaguucaaaacuagaacaauuccugguuguaacagggccacaaagcagcaagguaccugaaauguucugcgucuuccuuuugagggaaagccauggggggccgggggcaggaaagggaggcugaagggaauuuggcaaauggcacagcugagacaagccaaauccaucuagcaccaaggaaugacuuuucaaucagguggaugccaauacaugacaaaguuacuuugugaaugacuaagacacacuuugugaaugacuaagaaacaccaucccuagaaaacuacuucauuuuucuaauucgggaacagccuaguaugaaacugaggaacauggaucaaucuacagaaaaacagagaaaggauuacaaaaaggaugaaauuagaaaauaguuggcuauuugugauaugcauuugguuuucaaccccauuuccuggcacgcaacuccuaaaauccuuagaaacuccaaagugaugucuuuuuguaugcuaaugauugacuggugucuagcagccucuaagagucuagguagcuucaggaugggguugaucacaagaaggaccaagcacacuuauacaccaauaacagacaacagagagcaaacucaugagugaacucccauucacaauugcuucaaagagaauaaaauaccuaggaaucuaacuuauaagggaugugaaggaccucuucaaggagaacuacaaaccacugcucaacgaaauaaaagaggacacaaacaaauggaagaacauucuaugcucauggauaggaagaaccaguauugagaaaauggccauacuguccaagguaauuuauagauucaaugccauccccaucaagauaccaauuacuuucuucacagaauuggaaaaaaacuacucuaaaguucauauggaaccaaaaaagaaccugcauugccaagucaauccuaagccaaaagaacaaagcuggaggcaucaugcuaccugacuucaaacuauacuacaaggcuacaguaaccaaaacagcaugguacugguaccaaaacagagauauagaccaauggaacagaacagagcccucagaaauaaugccacacaucuacaacuaucugaucuuugacaaaccugacaaaaacaagaaauggggaaaggauuccuuauuuaacaaaugguacugggaaaacuggcuagcccuauguagaaagcagaaauuggaucccuuccuuacaccuuauacaaaaaguaauucaagauggauuaaagacuuaaauguuagaccaaaaaccauaaaaacccuagaagaaaaccuaggcaauaccauucaggacauaggcaugggcaaggacuucaugucuaaaacaccaaaagcaauggcaacaaaagccaaaauugacaaauggguucuaauuaaacuaaagagcuucugcacagcaaaagaaucuaccaucagagugaacaggcaaccuacagaaugggagaaaauuuuugcaaucuacucaucugacaaagggcuaauauccagaaucuacaaagaacucaaacaaauuuacaagaaaaaaacaaacaaccccaucaacaagugggcgaaagauaugaacagacaguucucaaaagaagacauuuaugcagccaacagacacaugaaaaaaugcucaucaucaauggccaucagagaaaaugcaaaucaaaaccacaaugagauacaaucucacaccagcuagaauggcgaucaguaaaaagucaggaaacaacaggugcuggagaggauguggagaaacaggaacacuuuuacacuguugcugggacuguaaacuaguucaaccauuguggaagacaguguggugauuccucagggaucuagaacuagaaauaccauuugacccagccaucccauuacuggguauauacccaaaggauuauaaaucaugcugcuauaaagacacaugcacacauauguuuauugcggcacuauucacaauagcaaagacuuggaaccaacccaaauguccaacagugauagacuagauuaaggaaaauguagcacauauacguggaauacuaugcagccauaaaaaaggaugaguucauguccuuuguagggacauggaugaagcuggaaaccaucauucucagcaaacuaucacaaggacaaaaaaccaaacacugcauguucucacuuauaggugggaauugaacaaugagaacacuuggacacaggaaggggaacaucacacacuggggccuguugugggguggggcgaggguggagggauagcauuaggagauauaccuaacgugaaugacaaguuaaugggugcagcacaccaacaugguacauguauacauauguaacaaaccugcauguugugcacauguacccuagaacuuaaaguauaauaaaaauauauauauauaaauaaaauaaaauaaauuaaauuaaaauaaaaaagaagaaccaaagcaggauuauagggccagaacauucagccccacuccucaaucucccaggaagagagaggggcugaaggugaaguugaucaccaauggucaacaguuuaaucggucauguuuacauaaugaagccucuguaaaaacccagaagaacagguuuagggagcuucuggauagcugaacacgcagaaguuccugaaggauggcucgcccugggagagcauggaaguuccaugcucuuucccccauaccucaccuuaugcaucuuuucaucaguauccuuuguaauauuugcugugauaaacugguaaacuuaaguauuucccugaauucuuugaguuguucaagcaaauugauugaacucaaagaagggaccauggggucccugauuuauagucaguuggaaguuccagaggcccagacuugcaacuggugucugaaagucaggugacagucucauggcauugagcccucaaccuguggaaucugaggcuaucuccagguacguaacauccaaauucuucugaaaugaaucaaaggacauccagcugguguccgcugcuuuguguguuggggggaaagaaaccccacacauuuggucacaguaguagucuuugcugauuguuguugcuggugugaaagcagaagaaaaacauguugaguguauuuuuuuccuuauuuuauauagcacaugaauaaugcaugauuguuuaaugauucuaauauucucaaugacacagaagacagagagcugugcaaaugucacuuacuauggacacacccacauagccagaacuguacacauuucagguacuaaagaaauaagauaggaagguuugccccagugguacaagauaaugguuuuuagaacauuuacaaccagcucauuaaaaacccaacaguucucaaggugacgucccuccacaauagcaucagcaucacuugggaacuuauuagaaaugcaaauuuugaggccccaccccagaccuacugaaccagaaacucugggacaagggcccagcaaucaaggcuuccauagcuguccagguguuucagaaccacugaccaaacccaacuauccucccaaucccugggccuuuuccuacagaauuccugccaaauggcugccuagcauaugcuugaauauguccagugaugggaaguucaucacacauuccuccuaagacagucaacucuacaaauaacauaguugcucuuuauaccaaguccaucuguuuuucaugacuuuauuccuugggaucauauaaaacaaguaucaugcaaguggcagugcuucagauauuuggaguuagcuauuuuucauuuuuucuuguuuuucaagaauaaagauggcaaaucacauccaccauucuacaaacagcauugauucaagugaccugugauuauuucccuccccagaaucuacuuccuuagagucuuagcuguaccacuuugauuuuuugcuuuuaguaacaccccaccauauucuacauguggggcuauucguacuaccugguucuagggaugggcaagugacccaggcacccauaguccuuugacauaugauugguucgggaguggacacaggacacaaaaugagccaaucaaaggcaaggacauccuucagaguaauacugcuauuaguaacaaugccacuuucuuucaacugaguugccaaacugguagacuaugaaccugaaacagcuacgaguuuuccuaaaaaagagcuggcuugaugugagagccaauacugaggcaaagacagugaagacacagagacccauaccugaugacacugucugagcacauggaucuaacauugccagaagaagucauguaccagaaguuucuuucaggauaauggaauagaauugacuuagcacaggcucuacuugaugagcuacuauuaucaugagcccaugaaaggcucuucuuuuucuuuucacuuuuccaaucauuuuccuuuuuguccucuguguucagucccauucccucccuucccaccacagaaauucacuuuuucauaauuaauguauuauucagaauccucuuuacauguuuguguacauacauuuuuugucaaaaauacacagggcccuuauacauaauuuuuaaauuuguauauaaauuguagguuuuaaaucccauucuucuguauucucucaacauuguuuuagaaauuuauccauguugccauaaacaauuccuucacugcauuccacuguaguauuccuugcccauuccucuagugcuguagagcuagcuugauuacaaccuuuuaccacaaguuacacugugacuaccauucuuacacguuucccuggauuccuaucuuagcaucccauuguugggauucaggucagauacuuacuuagauuuucuaaaauauaugcaccagcuugcacgcccagcagcaauacauuaggauuucuauuuuccuacauccuuaccagcacuugauaguacuuccugcuuuccaaguuuuuaauuauugaaugguaaaauggcgucucuuccuuuuacuucauuugucucuaauagugugauguguguguauaugcauguuucucuucuuaugaauugccaauucauauacuuuguccucuuucauauugcuuuccucccuucaauuuucuaauuuuguagagucccuuguauauucuaaauauugaucauggucuauuaaacacaauaauuauauuuucaccaucuauuaauuucucuaucguucccuccauugaacagaaaucauucauuuugauguauuccaaguccaucaauuuucuuuuuauaguuugugcucugcaaaucucuccgaacaaaucccucucuaccauaaguuugcaaauauauauauuccuauauuuucuucuaucgacuuuauauuuucauccuuaacauuuagguauuuauuccacuuggaacuuuguuuauaguaugaaauacagaaacggcuucauuuuucuuuuugugagccaauuuuccuaguaccaauuccugggaaugauuacaguaaguucccauauauacacaggaauaagucuagacuccuuucuauucugcuucagagccagacgcuguagaacaaaggucgcacauuuuugcacauuuuuuuuuucuguaaaggaccagacacagcaggccacacaaugucuguugcaauuacucaacuuugucauggcagcaugaaagcaguaugaguaggcguggcugugccccaguaaaacuuuauuugaauaaacaggcagcagcccagauuugguuuauagggggaguuugccagcuccugcuguaucuuguuaaugucuaaagaaaaacagagauccucuuucuguauuuauuaucccauauaaauuuuagccuccacucugccccuuucaaaaaaaaauucuuagauguugauuagacugaauuuaaauuguaagaugggugaggggaaugugacaucuucaaaauauucaacgaagccauuuaugaaugcugcauuuaugcucuuuaauaccauaauaaaacucuuguaauagaguuuuaaauuucccuuauauguuuuaugcauucuaucuuagauuuauuccuagauagcuuuuaguuuaugucacuauuauaaaugguaucuuauuauugucauaguuuauaauuaguuacucccaauacagcagaaagcuauugauuuuucuacguucuuauagcuggcaaucuagcugaacucuugcauugcuucuaaugguuucugcugauucucuuuuuuguuguuguuuuguuuuguuuucagacagaguuucgcucugucacccaggcuggagugcagcggcgcaaucucggcucacuguaagcuccgcuucccagguucaagggauucuccugccucagccuccagaguagcugggacuacaagcgcccgcaccacgcccggcuuuuuuuuuuuuuuuuuuuuuuuuguauuuuuaguagagacaggguuucacuguguuagccaggauagucuugaucuccugaccucaugauccacccaucuuggcuucucaaagugcugggauuacaggcaugagccaccgcgcccggacuucucuuuguuuuuauauauaugauuucacuuagaaauaaugauaaucauaucuuucauggcaauuuuccuacuuucauguuucuuugucauacugcauuggucagcuaugugguaauguauugagaagcagaaguaacacagggauccuuuucuuguuccugaccuuaagagggcugaguuuaaacuucuuuuuuuuuguauuaugaaugaugucuacucuagguuuuuaauaugaagccuuuaaucaagcuaaaaauaucccuucuauuucaaguuuucuaaggguugauaccuuuuuuuaaaaaaaauugguuuuaugaaaugcuuuuccuauaucacugaugacacaauugcuuguuccgugccauuaauguggcaaacuacauuagcaaauuuaaaaauaauaauucacuauucuuucccuauuaugauuaauucaacuccgucacaagguauuauuuuuuaauauacugcuagauuugaauucuuagccuuuugaaugucauaagugaaguuggccaauaauuucucaaccuauuuuuuuuuuuuuuuuuuugagacagagucucacucuguuuuccaggcuggacacaguggcacgaucugggcucacugcaaacuccgccuccccgguucaagcgauucuccugccucagccucccaaguagcugggauugcaggcacccaccaccacacucagcuaaguuuuguauuuuuaguagagacaguguuuuaccacauuggccaggcuggucucgaacuccuaaccucaaguaauccaccugccucagccucccaaagugcugggauuacaagcaugagccacugugcucagccaacuuaucuaguuuuuguuaucaagauuaaacauaauaguuugguuuuucuuuuuuguuccaaagagaguuuauuaaacgagcauuuucuguuucaugagcguuaaacaaaacucuuuugucaaacugugucuuuuucuccugugccagaaaggacuaaguuuugacaaucauuacaauuuauuguuuucugauuuacuaaagauuuuuuuuuucuuguaucaauuucuuagccauauauccuuuucacauaauacugguaaaaacuuauauucuuuuuacuggauuuaaaaauauaaucuguaauuaucucuuuuaccuauuucguauuguguuuaucaugguacauggagauguuuuuucuucaucuguuauucaaaaguaagaucuauccuaugaaguuuuuuaaauaaugaacuucugguucuuuggcuuuuaugaauuauuuuuacuuuauuaccacauuuguauuuauuuccucugauuuguuuuccuuuauuguuucuuuggauuuacuauguugcaguuuuucuaguuacuugagucaaaccuugggcuuauaggauuccagacuuaguguuuuucucuuggguaacaaaagcuauauauugccgugaaaguauuccauuagcucuaucucucaccuacugugcuuuuauuaucacuccgcucuaaaacuuugcuauucuuguuauuauuuccuauuuaaccugaggguuauuucauaguaugucuuuucauauccagauauauaggauguuuuugcuaucuuuuuguuaacagugucugauuuuauagcacuguuguuaagagaaccucuaagcuguugauuuuuuagaauuugaggcuuccugacucauugaaaguugaagcuugugucuaauccacaugcccucugaaauaaaguaugcucugcuuuuguugaauaaguucuauauacaugagacaucaaauuguuauccaaaucucucuuugucucauugcuucauugguuucugagaggacuguuuuaaauuucuaacuauauuugcuaaaucaaugucuaacgccauaaauuauuguuuucuguaccucaaagcuacauuacuacauguggauauguuccuauucauuucacucccuuggucuucuuauuccuuuuucuucuuuguauuugacaaguauaaauuuuuccaucaccuuacauuagcguguguucucuugaauuuuuuuuuaauaaaauacuauagcaucuuguuuucuauccauuaaagaaucugcuggauaaguuuaaucacuacacauuuacacuaauuauucuuugagcuuauuucagauauuuuaucuuuucguuuguuucacuucacuuuuucuccugucuaccuuccacggguuaagucugguuuuucucuccccaugaguaugaaaauuacacauucuauuuuuauuucaguagugguuauucguguucuuauccuauccauacuaaugcuuaguguuuaaaagcagaucaggaucuuuauccuuaguauauuccuaccuccuuucaucucuuccagauaucauaucccaucuucgucauguccuaacuuuuaugcugaauugauauuguuauaauuucaaauaaugcuuuauaugcuuuuuuacccaccaucccucucuccccacuuacucuacugauuguauuuucauuugucuuguuuacaaagauguaaggacauucccuucucacaggcagcugugggcuccagcaccaccugcuucuuuugaaucuuacuuucccuuucuggccuuuaguccucccuuuuccucaaaacuaggcuacacuuuugaguggauaaagagucucagcucugccacucucuuccugaucuuccagaauucacugaaccuucuaauccucagacaucucauuugaaaauaguagauaaugaaguauacaaagcaugucucguugucugccacaugauguagguacccuuaaauacuaauaguuuucucucuuucccuacccaaaucuaagucuaccucuuuuuuaauugugguaaaaauccuccccauauaugcugcuaguacaccuauuucuucaaguuuuaauuucaaugaagaagaaaaauauucuaggaacucuaaaagggacaaaagcauuaaaaagauuaagagucaauagaguuugaugggaaaauuugugcaucuccaggaucugaaacugucuccaagacugagauaaauauuaaauacuuuccuuucacauaaaaauggcagaaagcaauuuuauuuucagauaaguaaaauugcugaaucuuucuaccaaauauaaagacuagauguaccaauauucuguggaauuuuccagggaaaaucaucuucagggaacugcuucuuagcaaauauggagauggugguuucuguaagccagagaagcaaauacuggauuaggaaccucaguccaagguuuagacccuuagacuuguagugagcauuagccaagaaggaaauacaaggaacuugguuuacucuagaaaugguaauugaacccuacucucucuuuauaaacaaacagaaguagauacauaaaugaaaaaaaaggucucacauuucuagccgauuacuuucuucuuuauuuuuuuggugaaaacuucuuuuauuugggacuaaaaauauaugauuucaacauucuuaaaugagucuccauuucccacuuuucagccauaaaagguagccucuugcuaccucucucuuaugacauauuuguacccucucuaccuccuauaaacuaccuuuacaucugcaucuccuacaauucucgccagcugguagcauaacacuuuuagagcuuuaucuuuaaaauuuaauaaacauaaaagaaacaaugaaaagaucucuacuauccuuuugugugugacucaguggauguguucagucauuuuuuugacagggcuagauaggcaaccuaacuuguaguagaguaagguucagugacacaaaagcaaaugcaggccccaaacugggaaaucuccaagcugugaacaggaacugacaauagcucacuucaggguagggcagauucuuuuuccggauuugcuuucaaauguuauguuaacauccaacuaaaguaacgaaaucucuuuugguauugccaaaagagauucacauuugagucagugggcuggggaaggaagauccacccuuaaucuggugggcacaaucuaaucagcuggcaguggauauaaagcaggcagaaaaaaaggagcacgagagagagagagcgagagagagagagagagagagacacucuucauagagaauauuauucaaggauuucuuaaacuugggaauauaagacuucagggcccugauuugggaaauacugaauuaauaacaacucugucacuuuaggcaaucccuuugcacuaaagccacauagcaguacucuguuaucagacaacaagcagcugauuuaaaauauaagccuauaucugucauuuucauauuauuucaucaaauagagaacaauaaauacaaacuuuuugagagcaugagggccuucaaaacccacuggccgaaguuuaagaaacucaggccuucagcaaaugcaccuaagaaaccaagcucaugaagaugugaaauucuaaucaacagauuaccugaaaacauuuccaucccauuucaugauuucucucucuuuucuguagcaaaugauguuuuuggaagaaaaagagcgcauauuucccuugccuggcuacucaaaaugugguccucuaaguagcaacaacagcaucacuugagaguuguaagaaauguagauucccaggccccagccuagauguaaugcauaaaccuguauuuuaacaagauccccagcuaggcuguuuguacauuaacguuugaaaagcacaucucagagcacuaguuuuaaaacuaggucuauuaagaucaacuugagaacuuucucaaaaaacaaauuccuauacuucaucauacucuugacuccaacaaucucugcaacaauguagcuaacccaucacggggauuugacaaacauggcuuccgauuguaucuucuuuccaauucauuuuaugaacucaggcaaguuccuuagcuucuuuaaauuugagaaaugaguaugacaacaguaccuucuucucaaggacacacauaaagcacuuaaauauuugauaagugcuagucacaauauugguguauuuugccuugacaaaaguaaugccuaauuuuauucaauaaacaauuguuaauugucaacucauacauaagcuaauauuguuaaguugcuucguauaaugcuuaucacaaaaaugguauguaaugguuacauaaauacaaauaaaaucauguauuugacaccauacugccauuaggugacuacuaucucuccauauuagagguagagcagugucaaaaacuaccaucugauuaaauaauagaaauaacagcuaaguacuuacucgguacuuucaucuuucuaagcaauuuauaugauauguuacuuaauccugacaacccuaugaggaagguccuucauacaccaacauaucaacauuuaugcaucucuuugauuacuucucaugcauuaauuccuagauuugagaaucacuguguucaaaguauauugaacuauuaaggcuacggguaugaacuacuaaauagcucucaagaaauguagccaauaguugauauccaacgguuguauagaaaaaagucccauuuccccaaaacuuuguuaaugccaggcauucucuaauucuccaaauugcuaauaaaaauuugucaugacuuaggaauacaacauaaagggaaauaacuucuucuaaauguccuagauaaaacaaucuaccaugaaaauuaaugucuccuaggcaaccaggaagucagacacaaugaaaaagaaacacuguucucuucguuaaaagaauaaaacuguguuuccuuuuaacuagaaaaauaaaguuguuauuucauuauggccaggaauauuaagguucacuguaaaaaauaaucugcuauuuuuauacccuggcauuacucagugaauggcaaaaaucuagaccaauccuagaaggcacgaaugucuuugggggaugucagaaaaagccuuaacuccagacacuucuaccaacuggagaguagguuucuauuucaauuaacuuaaacacuaggggcucaauuguuaaccaagaauguaaaugagcuuauuaaaagcugcuggcuaauggaucccaagaugaaccuugagaggaacaaugcccugucaucuaacugaggaacaacacaaucugaucuggccccgcucugaaacauacuuuauugaugacuuggaaaacaaggcacauaaaugaaugguuggagacauauauugaaguuuauaugauuuguaaaacauucuaaucuacaggcguaugucaaaauuccacaggagacaguagaagaggauccuagaagaagauaacaaagugaacaaagagaaagagaagacaacuugaagugucccagaauuuaagcaaacaagaauaccuguaacauuuuuauacaaagagaauuuuuuagugaaguauauuaagucaucaacuuaugucacuaaaaaaauuuucaauuguuaacaagucaaagaaaauccaaaaccucagcuauuuauaaacagaaaacaccuagguauuucaaaaugccaacugccuuuucaagaucucacuucaucaguuaccucuucucuguucugucauuuuuuuuuuuuuuguaaaccuacuuguuuuacauauuuaaccucauucucaccaguuucuucccugucuccuaaaaagauguucagggauuacauauacuuaauaaccuuuccucaucaaacucuaaucaccuauucauuuaauaaauauguauuauauacuugccauauuccaaauacuauucuagugguaaauaugacagaccagcccucugcucucauguaguauucuaggcacagggugcauauugcaagcaguagagacuacaagccagucaacaaggaaaaauauucugauugugacuugaaggaaaugaucaaaauccaagaacaggaagggacuuggaggaggcagaaguggcugccuaagugucaaaggaaaggggaaucucacguuugaucugcgaguugaaugauaagaaguccacuguaugugacuauauggggauaaaauguuccagauggaggaaacagcaauugccaaggcaagaaugaucucaagaucuuagaggaauggaaagaagagugugggguggagccuaacagcaggcagcaaggcagaggugaggagauggguuugaaagaugagcagggaucagaucauacaaggucuuguguggcguuucacuuaaugagaaacucgugauaacaaagauucaagcuccagaguguucagggucuaaauuugacuuucaaaaaaagauuuuacuauuguacauuaaaaaucaucucaggacgccuggugugguggcuaauaccucucauuugggagaccaaagcagaaggaucccuuaagaacaggacuucaagaccagccugggaaauauagugagaaagaaagaaagaaagaaagagagaaacagagagaggguaggggagaggggaggggagacgggagggggagggggaagaggugagacgggagggggggaggggaggggagacgggaggggggaggaggggggaggaggggaggagagaggagaggagaggaagaaauuagcugggugugguggcaugcaccuauagucccagcuacuccagagaccauggcacgaaaugccugagccugggaaguugaugcugcagugagcugugaucaugccccugcacucuagccugggugacauagugagauccugucuauaaaaauaaaccucaggagcuuaaaaaaaagcauaugccccauucccagauuauuuuucuguuaagacuuuugaaaagugacauacaauucauauaccauaaaauucacccuucuaguguacaguuugaugguuuucaguaugugugcaaaauuguacaauuaucauaacuaccuaauucagaacauuuuuacccccaaaagagaaaccauuuccuuuagcagucauuucacauuuuccucuagcccacagccccuggcaacuacuauucuacuuucugucucuguggauuugccuuuucuggacauucuauagaaauggagucauacgauauauagccuuuuauguguagcuuauuucacuuagcauguguucaagauucauccacauuuuaccauguauucauccuuuauuccuuuuaaaggcugaauaauaccccauuguauguauacaccacauguuuuucuccauucaucaguugauggacauuuguuacuacauuuuuggacguuugugaauagugcugugaauauucaggugcaaguuuuguguggacuuauguuuucaauuauugaacguacaccuaagagugaaacugcuggaucaugugggaacucuguauuuaacauuuuaaggaacugccaagcuguuuuccuuaguggcuguaccauuuuacauuaccaccaccaaugaaagaggguuccaaguccuccacauuccucaccaacaccccacucccagauauuuuaaauuaauuggucuggcugagaccuagauaucaggcuuuuuuuugguuuuuauuuugaaaguuccuauggugauucuauuccuaacguauagugaaggccaagaagcccuuacuccagccuguucauugccaacuugguaaguauuuauaccuacucccucuuccugauaaguauucauaccuacucccucuucugcuccagagcucuuuagacauguuacuuggugcccccagcacucucaaugacaucugcuuuguagcugacucauccagugagagaaggaaagauaauuaaggaagauacagucuuauacuuuuaacagucucauuuauuucugaguggggccagugucugugugaaaucuucaugguuaucugcaugucuggauggguuuucuccaggcacucugguuuccucccucauuccaaaggugcaugugagauuaagaggcaugucuacauggucccggucugagugagaagguauguagagugaguccugagagggaauggcgcccuguccagggugggcuccucccuugggcccugagcugccaagacaggcucuggccaccugagacccugaacugcaaugaauggguaaauaauuaucuugcuuuuauuaaucuuucuuauaauauguagacaucaucuuuauuucuguauuuaauauuaacaauauuuugguuuuuauuuagaaguuuggugauguuuuugugaggagaaauaugccacaggaauuuuuuuuuuaaucaguuagccuauggucaaauugguuucauuauacauuguuuugguuaaaguuguaguuucuaagaaaccuaccuaugacucaagugaggacuuguguuuuuacguaaugugaaucagcaacccccuucuuccacugauugauccgacggagaccuuuuaugcaaaaagaggucacugcuuuaaaauauauauauauauauauuuuauauuuauuuuauauauaaaaauuauauauauuuaaaaaaauauauauauauauauauagagagagagagagggagagagagagagagagagagagaggcuccugaaguucuucucaucuagucaagaaagauauaggguguaaauggauacuucuauguuuuaugcuucaaccugaccuugaguauuaaacaugguaucauauuuacaaaaauguauaacauuuagaacuacuuuugucacuuuauaaaaugauucuuccaaaccaaacacaggugaugaauaucuaaaacaccagcaucaaggccuagagcuuuguguuuguacaaaauaucagggaaaagccaagcacaguggcucacaccuguaaucccagcacuuuaggaggccuaggagggcagaucacuugaggucaggaguuugagaccagccuggccaacacugcaaaacccugucucuacuaaaaauacagaaaauuagcugggcaugguggugggcaccuguaaucccagcuacuugggaggcugaggcaggagaaucgcuugaacccagugggcagagguugcagugagccaagauugugcugcgccacugcacuccagccuggguaacaaagcaagacuucaucucaaaaaaagaaaaaaaacguaucagggaaagacagaaaccugaauaaaaaggaaacagauuucuacacugaaggacaaaguauggcaugacuucucagucugauggaggccgagauucguuuuuuucauucugagauucaucuuaacgguuaaaaaaaaaaaaagaacaaacaaaacgaaacccaaaucauguuuuucauguggacuguaauagcagagacgaacuuacauguuuaaauacaaaaacaauccuuaaagaggagaaucagaaguugaaaaucaccuuacuguuauguaucuuucuggaguaaucaaaauuucuacuauauuauagucucuauaccaucaaaaaauccacagauaucacagauauucaucuccauggacuguaugaagacauuguggacauauugggacaucaacucagaaauaaugucaaaagcuuguaugguaaaucugaaucaacugugaucuuucagaagcaggagcuuccaaagggguuccuguagcaucccuuuaucagagcaaggccagucagagguuaagaaacauugggucuuuuacuuuaacacuucucacauauuauuuuaaaaauaaauaccaaaagaaauaccaaaggaaaaaccacauaaauuauauuuugaacauuuacauugaacaaauuaaaguucccaacauaagugaauacaacauaauaauuacuauucugcauaugagagaaauuauuccaccauuuuuugacuccugaauuguuggcaauauucauggcaaagcaaugcugcucauagguuuuugcuaaaacggaguauaaggcuaauuacagugucaauuauagcuauguaucauuuguacucuauagacuuacuccuauuuuaaguggucuaccauauucuucuaauaucuaacgguguuauucacaagauaacuacaugacugauacauuuuuuacguaacaguguacuacaggugguacaaccuuguaagagaacaaguuuagaaguauauaaugcacaucuuccuucaauccuguuuauuagcauauggaaaacacauuugaagauaaccagauauaaauucaaggccuugaauccaaagccgucccaaacuacugauucccuguguucuuccaggcccucagaagaugucgguuaaaggaaaucauaaaaagucaaacuauagccucuguguuauguccccacuaaagccaguauggccagacuuuacuguagcugagagguucuugcucauggagucuugaaauagagcuucccaacuucagcagagaugccuauuauacaacauuaaauaaaagacgaauuuaaaugaaucaagucuugacucuucuuccaccaucauggguuuuacagaacagcauuauccagggcuccauucaagguaauuuugcuuuuucauugcuugacaaaugcuuucccauuucccugcacccuagacaaauugguauuucucagcagcucuuagaaugacaauggcaguuuucucuucaucguuuuuucauuucuucauccucucgccaugagaggcacucaucaggggaucucuaauccuacccaucucauuaccucuucacucuauuugucaccauuuggaauuucagaacucuuaauuauuagcuuacuguuaccaacaguaaugaggcucuggcugccuacuggggagcaucauccaacacuaacaagcuagcagacugagaccggcaccugaauuccaucacgugguuccauuguucaggccaggugggacauuucugucugcaggcaagcuuucugcaggagagcuggaguuugcaggguggcuauuauccauucacuuuggucuuaugauucacacugacucaaaacagcuuuccuguguggucaugcucauuuacauacuggcuauugccuuccuuauaauaacacuuaauguuuauuucugccuuguccuccuuuucacuuguauaaggacuuccuggagcuaagaguucucaaagggaacacuaauuggucauuuucuuauagcuacuuuugaucuccuccugaccuggaaugaacagugagucucucacagccaucugggugauccgucuauauacagaccuuccuugacacucccgcaguagucagcauacugccucaacacaaaagaggcuagacaaauguuaagugacaucuauaaaguuuucugagcaccaaagacagacccagaugcagaggagacagaaagguaaaggauuaagaaggagcuggucccucugaaacuaugacaaacaugucuuuauauaguuaacgagggaagaugcaacugauccaaaauccaucucuuccuuggcuucauauccuuucacagcaacaagagccuugcaccaaugaggacaaaugagcauugguugaauacuucuaaaugcccagccuacauuaggcacuugaccugcauuugcucauuuaaaccccaauagccuguacaguagaccuggaggaaaacaaaacccacagaagucaagcaacuugaucaaggucacccauuagugaaaaccccaaagcucuucucaguacaaguggucacccaacaccgcucagaaaacgguuaggcaaaaugagggccugggguggguuuuggaauagcaacacccugaagguaauagaggcuggugguagagaagaggagcaguggcaucaccuagguguguaacgcugccuuuguccccuguagcugcugccuucuauccaaggugaccaccguguugaacacugucuaggaaauacugugcucagggcaaaggaugcucucuuuuuuucacauuuuuauacagcuaagagaagucauuucugaaaacaggacuuggaggucaacguuuacauaugaugccaccaaggacaucuccugaugauacccaugaaggagagaccauuccguuagaaaacuugugcaguaacauuuaaaauuggcauuuguuaaccauacuaauaagagcuaauauuccuguagcccuugcuauauaccagacauuaugcuauaaaugcuuuauguaaauaucucacuuacuccucuccaaagccucugagguauuuuuaucacccuaauuuuacaaaagaaaacacuaagaguuuaagucccuugcccaaguacacacggaagcaagugauggagccgagauuuguacccagguaugugacacuggucuccuccccaccuccaacagugcuaagaaagaucuucugcccacauugcauuaugugcuguacuuuuuucauguaaaugaucauuccaaaugucuacauccuggugggugagcggaggaggugacaggaagaacaaaaaaaaaaauagacaugaugucaagaaaggaauuaauuuucaagugcacaaucacugcuacccacagagucugucuguuugguuuuccauagguauaaagagauuacucagaguccauaagguggccaugccaggucucucggggucaagcagacaggccaaggguguacccaggcucuccuuagcucucuacauggcucugccucaucugcuugcuugguucacccaugacaucagagaaacaaaguugggagcaaugcuacuucaagcauaugccaguuacuaaggguaauuuauggcaacucucauugccacgugggcugagaagcacaacauaauaauuaaaagacugauaagcaaucacuaaugaaaugcauagguauuguugaaaaaugcauuuugaguccaaguaaaacaaugauguguguucucccagugcagaaucucugagcucuguaaucuuaaaggcuuuugcuuuuaaaauacuauuucaaaugccagcuauuaguaacccauacauuugcacccugguuucauugcaaaaaugaggaaggaccauugcuuuccaaaagaggcaacaaauagaauuuuuuaaaaaacgcuucucuuggaaaauuuugauccguuucaagugaucuuguuuagaagaccccuacgccaagaguccugccgggacagaguuguguuggcaucacuugacugcuaccugugucgucuuugccuuuguguaucgcaaagccuguuagaaacagcucauggaagcggggcucagaagacagaggugugugcuagacccugcccuaccuuuguucucuaacagggaagcauaaugucaaccaaucucuagucaucucccugacccaugucccugacuggcauacacacagggccacaugaaaccauuccauggcucaggccaggguuucaagcaucaauuacccuuaguaacagcacaugccugaaguaggguugcucccaacuuaaauauuucucugaugucaugggugaaccaagccaagcagaugaggcagagucauauagggagcucaggagaguuugaguaugccauuggccuguccacuugaccccugagucuaaugacucagcauggucuuuggaguucuaggauggcauuauuuacuucuccucuugcacaguccagaaagaacauuuuuccccacuaaaugcacauucccaggagcuccgaccuccagucaaaaaaguaaaaguugcuugguaagcucacugccuggggucuucuauaccaggaagggcccaggccuagcacucauguuguggcaucuuccuccugcacuguaggcagaugucgcuaauuaacuaugacauguucuccugcagggcauuaacagaaucuuuuagauaccauuaccaaucaaucagaguugcugcauaacauggaaaaccuauugcucauuucacuuuucggcuuuagacuaaugacccagggaaacuuuucauggcagcccugagaugguucgauccauuucaagcuaaggaugugauaauacguguaucuuccagaaucuugacucuuucaauuaggagcaugaauaacaaacuucuagcauugaaauaacauauucuacgguaauccucugacugaucaccuuguuaauaaauaucuaaagaccgcauuuuucucugagcuuccaacuuccaugggaacauucugauugugauauaauuuuuaaauuagcggguuuauucauagauuuguguuaguaaauggcaagcuucuuacuaauuagcaaauuguguaaauccacagcaguauuaauuuucaacuguauggggaauuaauauaagacaaaauaaauaaggagacaauuaaaauuucccuagaggcaugcauuucuauaaaauucagcacaaaacaagaaaacauuaacccauuuugagggugcauuuagaaaagaucacaaaagaugugucagugucacagagaacaagugaagcaugcauuugcuguggcacgcacucucaguuacagcuaaauucccuaaagauauuuucucaaguuacugcugcugagauguccccucuugccuugaugcacuuuuccagcacuuucucauuuaauaagguuuuuauuauuucuuuauugauguuuccacucaaauugcuggugugcucucucucacuuuagaggacaaugcacaguauaauguucugauccucaaaaacugccccacaagaggucucucacuaaccaagcgcuugcuaauauccauuucacuuuucccacuaacccacugagaagauggaaagcauauguaucucugggcuccuguuuaaccucccagcucuagaagaugagaaaaagcaugucccucuuacgggcacuuacaccauuucuuaugaagccaucccacacacuguuaaacaaaucugauuguuucucaaacuccccuuuaacugcuucagcuuauugcuaagauguuggagucuuccuguguugguggccauggaaaccaccugucuauuuaauggcaugaggucuuuucuuuacuuuuccuggcaugccaggcuguuggggaaaggccagagcccuaaguuuaaacaagucaaguacagauguuuaagaaugacagcucccaacagcuucagaucauagcuaauaccaaaauuaaacuguaacaugguaugcucugauggggaaacugugcacaguuucuaaguacacaaacaagacaguacacagacaauuguagguuccauuugggggcaauuuucuucccuuaucauggcuaucagugauacaaucugcugcagaagaaugugguguuaacuaauuaguauaccauauagaagugccugucuuguauuauuuacagugccugggacacacuccuaguacagggcuucucauaggcacaguaauuaugcauuugccucucugucuuacauauuagauaaugaucuccuuaagggcugggaauacggucagagauugggauugccuaucagcccccucccaagcagaccuaagcagccaggugguaggcaagaacagcuucaugaauggcuacuaggcaguucccaguagugccuggaaauucuguaaguaaauuuuaaacggcuugguucaggccaaaaccaaaauggaucuuccuguucccucaccccaggucugcagugacauacuauccugaucuccucuuucuguuugagguugaaaauggaaaugggaagaaccaggcaggccuuaucuggccugcuugccauauggagacugaugggcagacuguucacaaccacaagcagguaccacagaaagaggacagaauagagccgguccuuuacuuuuaggugaguuuuccuccacuggcauguugucaccaggcaaggcaguugccauuucuacugauguaaggagacacacacacacacacacacacacacacacacacacacacacagagagagagagagugugugugugugugucaaggagagguggggaggaagugaguaggaagggacacagagccagggacuaaagagaaaagucccuuccugugaaaagaauaagauaauauuuucauuuaccauccccauauacacagcagugagcaaagugccaggcaaauaauugauacccaacaaacaucagcugaaugaacaaauggauucauucauugcacuuuuccaugucucuaucucuaguauuuaagauuuuuuuaauguaucuuagaagagccuacuguuguacaccaaaccaaaccaaaacagcagaauguccuaaaguacugacauauguguagaaauuacacaucaaauuaccaaucagauagacgcuaagguaggacugaaaugugggccaaacccauuuuggaaacaaagaacaaagucaauacucaaggucaagcucuuagacagcuauucuuccaaagcaccuggaccccaagacacacucaacaaauuucaggucauuucuucucucauuaagccaguuacaaccaaguuauagaaguggaguccuuacaagucgcuauugauagaauaagagcuagucaaagaauguuugagccauuuuuuucccagccucagaugauggggagaaaaaaaaaacaccucaaucaaggaugucaaaaugaaccaaucugcaauagucaucugggcaggggacaggugaauagcccaauucuucucacagaaaugaagaaaaaguucaggccauuauccaggaugacuugaaaaggcaacucagugacugagcuuuguaguucugacaccauucaaauagaaaugggagccagagauagaaggacugacggcucauucucaggaaugucugugacuaugcuuagaugugucaguagacaacagcuuccuaccaaaugguacaggcuuuggcagccucuuuuuuaaaaggccuuuuaguaacuagucaggcaccauucuuaauaucaaaacauucucucuuuuuuauugcccagacucugggaaucuggaaaaugaaagaaaagaaaaaaaaagaaaagagagagaaagagagaaagaaaaagagaaagagagaaacagagagagagagagagaaagauaauucugacucuuccuagguaaaguuaugcuuuccaguuaacuugauccacuaguuauuacccgaaaacaugcuuucccuauguuugaguucucauucauuuauucaacaucuacuaugugccagacccuguguuagaugcuagggauacaacgguuaaugagaaaaagaaaaugucuuaucauggagcucauuauuuaucugucuuauaauuaaucuauauuacuuuauuuaacaacuacauacauuaaacacugcccuuuuaugguuacggaaagacagcagugaacaaaacagacagucucuauucucugauccagggggaaaagacuaaaugaguuaguaacauuuucagauaguuaggagagcuggaaaaacauacauugggauaaugccauugagagugagugauggaguggcagcaggacuguuguuugagauaaauuggccagguggcgucuccaagaagaaaagucucacuugagacugguaaaugaagccagcaauccaggaaggguguuugucaggguggccagcuuuuccccacuccuagguuuuaagaggagucugacacugacuauuauuaggaaaauaaguuaguuggccuacuuggaggguauaauaccagccagcaccuuaauauucaauguguggucuggggaauaccagcaucagcaucacccaagagcuuguuaggaaugcaaauucucagcuccacuccagauguaauugaucaaaaucugcacuugaccugaccccuagguaauucauauguguauuaagacuuugagaagcccuggagcuagccaccuugaguaagaccuaaagucauguccaccaagccuggccucuaucagucauuccuuuguuuauuuuggaauucauuugagaaauuugaggacccaggcauagacaagggcugcuauuuauuggagguccucaagauccucuaaauaaagggaagaacaaguacaaagcccugauaugggccaggcugaauuaugagugaaaucaacagaaauaaacgcaagccauuuaaauuuuaucccuauaaaauggcuagccuuuggaaguuuuuaggcaagggagaaguaauauguucuacgugaaacuuuggagcagugacucugggugcugcagagagaguggacaauagccaagcaagcauggagaaaccacacaguuaagaagcuacaaaggcgagcccgaugggaagcgguagggacuugaguuggugaggcagcagugcacuuauucuggauaugucuugggagaagagcuaauaauacuuacugaugaauagaaauguggggcagcaguuaggaaagaggauggucaaagaaccagucagugcaggcauacuucauuucacugcauuuugcuuuacugugcuucucagauauugcauuuuuagaccaacuaauaacccuacaaucgccuuuuaaguguucaagugaaaggaagugucacacaucucucacuuuaaaucaaaaaguagaaacgauaaagcuuaguaaagaaggcaugccagaagccaaagacaggccaaaagcuaggccucuugggccaaacagccacgcugugaaugcaaaggacaaguuauugaaggaaauuaaaagugcuacuccagugaacacacaaacaguaagaaaguaaaacacuuauugcugauagggagaguuugaguggucuggauagaagaucaaacaagccacaacauucccuuaagccaaagccuaauccagagcaagguccuaacucucuccaauuguaugaagucugagagaggugaggaagcuacagaaaacaagucugaagcuagcagagauuggucaugagguucaaggaaagaagccauuuccauaauauaaaaugucgaggugaagcagcaagugcuaauacagaagcugcagcaaguuuuccagaagagcuggcaaagauaaucaaugaaguugaccauauuaaacaauagauuuucgauagugacaaaacagccuucuauuggaaggcgaugccaucaaggacuguccuagcuagagaggagaaguuagugccuggcuucaaagcuucaaugaacaaacugaaucucuuguuaggggcuacugcagauggugacuuuaaguugaagucagugguccuugagcauucugaaaauccuggaucccuuaagaaugauacuacaucaacucugccugugcucuguaaauggaacaacaaagccgggaugacagcacaucugucuguugcaugauuuacugaauuuuuuaagcccccucuugagaccuacugcucaggaaaaaacauucuuuuccaaauauuacugcuuacugaugauguaccuggucacccaagggcucugauagagauguacaaggagaugaauguuguuuucacacuugcuaauacaauaucuauucugcagcccacagaucaaggaggaauucugacuuucaagucuuauuaauuaaauacauuuuguaaggcuauaacugucauggacagugacuccucugauggaucugggcaaaguaaauugaaaaccuggaaaggauucaccauucuagaagccauuaagaacauucauaaugcaugggaggucaacaugaacauaguuuagaagaaguugauuccagcccucauggaugacuuugagggguucaagacaucaguggugaaaaaagcaggaaaacuagaauuagaaguaaagccugaagacgugacuguauugcuguaaucucaugaucaaacuugaacagaugagaaauugcuuuuuaugggugagcaaagaaagugauuucuugagaugaaaucaacuccuagugaagaugaugugaacauugucgaaaugacaacaaagaauuuggaccauuauaccaacuugguugauaaaacaacagcacugucaaagacgauuaacucuaauuuuaaaauaaguucuacuaugaguaaaaugcuauuaaauagcauuacauucuacagagaaaccuuucauuaaaggaagaaucaaucaguauggcaaacuucauuuuuauuguaagaaaucgccacaaccacccaacuuucagcaaccaccaccaugaucagucagcagccaucaacauugaggcaagaccuucccauuuuuauuguucacauuuuuuagcaauaaaguauuuuuaauuaagguauguacacuuuuuaggaauaaugauauugcauacuuaauagacuacagcuaaguguaaauauagcuuguauaugcauugggaaacuaaaauucacaugacugauuuauugcgauagucacuuuuucacagugguguguaucugaacccauaauaucuuugagguauggcuguaccccuacgaggcauggaggugggcauacuacccaugcugcccccaagcacuauggcugaccccuugcugggcugaucccaaauacaaaauacaagaauucauaaacaauacaacacuuuccguuaauggagaaugcuauaacaccuaguucccacuucuauucuucaccguuggauucuaauagaugccuguuauuccuuuaaaaauaugagagcaauggauuucauuuacaaaaaagggaaauuaguuacacaacaaaaugaauacucagaaaaauauuucaagcaaauagauaaaagaccacuuuuaaaaaucugaauauccaagauaacuugcucucguaaaaguuugugauuggcaauaagagacagauugaaaacugcuagacuuuucaaaaaaccagcuccuggauucacugauuuuuugaaggguuuuuugugucucuauuuccuucaguuccgcucugaucuuaguuauuucuugccuucugcuagcuuuugaauguguuugcucuugcuucucuaguucuuuuaauugugauguuagggugucaauuuuagaucuuuccugcuuucucuuaugggcauuuagugcuauaaauuucccucuacacacugcuuugaaugugucccagagauucugguauguugugucuuuguucucauugguuucaaagaacaucuuuauuucugccuucauuuuuuuauguacccaguagucauucaggagcacguuguucaguuuccauguaguugagugguuuugagugaguuucuuaauccugaauucuaguuugauugcccuguggucugagaguuuguuuuaauuucuguucuuuuacauuugcugaggagugcuuuacuuccaacuaaguggucaauuuuggaaucagugcggugcggugcugagaagaauguauauucuguugauuugggguugagaguucuguagaugaucaaguggguuucaucccugggaugcaaggcugguucaacauacgcaaaucaauaaacguaauccagcauauaaacagaaccaacgacaaaaaccacaugauuaucucaauagaugcagaaaaggccuuugacaaaauucaacaacgcuucaugcuaaaaacucucaauaaaugagguauugaugagacguaucucaaaauaauaagagcuaucuaugaccaaccaacagccaauauuauacugaaugggcaaaaacuggaagcauucccuuugaaaacuggcacaagacagggaugcccucucucaccacuccuauucaacauaguguuggaagcucuggccagggcaaucaggcaggagaaggaaauaaagggcauucaguuaagaaaagaggaagucaaauugucccuguuugcagaugacaugauuguauaucuagaaaaccccauugucucagcccaaaaucuccuuaagcugauaggcaacuucagcaaagucucaagauacaaaaucaaugugcaaaaaucacaagcauucuuauacaccaacaacagacaaacagagagccaaaucaugagugaacucccauucacaauugcuucaaagagaagaaaauaccuaggaauccaacuuacaagggaugugaaggaccucuucaaggagaacuacaaaccacugcucaaagaaauaaaagaggauacaaacaaauggaagaacauuccaugcucauggguaggaagaaucaauaucgugaaaauggccauacugcccaagguaauuuauagauucaaugucauccccaucaagcuaccaaugacuuucuucacagaauuggaaaaaacuacuuuaaaguucuuauggaaccaaaaaagagcccacacugccaagucaauccuaagccaaaagaacaaagcuggaggcaucacgcuaccugacuucgaacuauacuacaaggcuacaguaaccaaaacagcaugguacugguaccaaaacagagauauagaucaauggaacagaacagagcccucagaaauaaugccacauaucuacaaccaucugaucuuugacaaaccugacaaaagaaacggggaaaggauucucuauuuaauaaauggugcugggaaaacugguuagccauauauagaaagcugaaacuggaucccuuccuuacaccuuauacaaaaauuaauucaagauggauuaaagacuuaaauguuagaccuaaaaccauaaaaacccuagaagaaaaccuaggcaauaccauucaggacauaaguaugggcaaggacuucauguccaaaacacuaaaagcaauggcaacaaaagccaaaauugacaaaugggaucuaauuaaacuaaagagcuucugcacagcaaaagaaacuaccaucagagugaacaggccaccuacagaaugggagaaaauuuuugcagucuacccaucugacaaagggcuaauauccagaaucuacaaugaacucaaacaaaucuacaagaaaaaaacaaacagucccagcaaaaagugggugaaggauaugaacagacacuucucaaaagaagacauuuaugcagccaaaagacacgugaaaaaaacgcucaucaucacuggccaucagagaaaugcaaaacaaauccgcaaugagauaccaucucucaccaguuagaauggcaaucauuaaaaagucaggaaacaacaggugcuggagaggauguggagaaauaggaacacuuuacaguguuggugggacuguaaacuaguucaaccauuguggaagucaguguggcaauuccucagggaucuugaacuagaaaugccauuuggcccagcaaucccauuacugaguauauacccaaaggauuauaaaucaugcugcuauaaagacacaugcacacacauguuuauugcggcacuacucacaauagcaaagacuuggaacugacccacauguccaacaaugauagacuggauuaacaaaauguggcacacauacaccauggaauacuaugcagccauaaaaaaugaugaguucauauccuuuauagggacauggaugaagcuggaaaccaucauucucagcaaacuaucacaaggacaaaaaaccaaauaccgcguguucucacucauaggugggaauugaacaaugagaacacauggacacaggaaggggaacaucacacaccagggccuguugugggguggagggaggggggagggauagcauuaggagauauaccuaauguuaaaucacgaguugaugggugcagcacaccaacauggcacauguauacauauguaacuaaccuguacauucugcacauguacccugaaacuuaaaguauaauaaaaauuaaaaaaaaagaaaagaaaacuucuagacuucccaacacuuugagaaacaguugccaccuaacuacuaaagcaaaaugaacuaaaccuaccacuggaacucaaccuuuaggcauuuuaaaaggccauuuuuaaugaauucccuuucagcucuuagucaagcucaucuuuuugaauucgaucuuuauuuuuaacaggagcacauacuuaaagagguagaagguaugaagaggucagcagugaucaucuuuacuuauaagagacaaagcauuccucuuggaaaagucaccauaccauuuuggggacuuaaacuuugaauauuuuuucaagaaaacacauuuaugacaauucauuaugcuagagauucuuuuuuuuuuuuuccuuucaaaaauauuuuccauuuuaugucuucuaaggcugaugaaaacaggccuuccaacucugggcuugccuuauugccugucuguggcugaaacccaaacauuuuccuauuacaguuuaaguguuuuuauguauguuuuauacccaaauucaguaaagguuugacauagaccaagguaacauuucaggcaguaucuuuaaaauagaaaucuauuuucagauuccaggauguagaacaguugguuuugaauuuauaacuuugauaccagcauuuuccucuuuaauuguacuucuaaggauaccuccuggccaccaaaggacacuggcgugguuuauuucaguacugugauaaagugauugagaacugagauuuuauucccaaagaggcuaacuccuuuaucuuauucuaaagccaauuauuuugcaaauuagauccacugcuuacauaguaugacaugugaauagauguaaggaaauccaucacuacuacuccaagcauaugccuacugaguaaugaguuagcaggaucaccuucauguuugaagacaccaggacgauauaguagaggagaacguaagcucuagugucagaacgccuggguucuuauuccaucuggcuagcuaggagacuuugggcaagucccuccccuacaucucaguuuccccauuuauacucaauggcaguacuucccaaauuagucaccucauauuuagagauauuuauuuauuaauacuauauauauauauauauauauauauauauauuuuuuuuuuuuuuagacagaguuuugcuauugucacccaggcuggagugcaacggcacaaucucggcucacugcaaccuucgccucacagguucaagugauucuccugccucauauauagcugcuuuauugagauguaauucacauaucauacaauucacccauugauguaauucacccaaaugauacaauucaaugguuuuuaaucuauuuacccagugguacaaucauuacuacaaucaauucuagaauguuuucaucacugccuagggaucuuuaaaaauuccaaagcccagacuaugccacaaaucaauuauaucacagucuauggcggugggacacagacaucaguaguuugcgaagcuccccagguaauuccauugcacagauauguuugggaagccaugcugcacuggaaucacugucagaguuucagggaaaauaaacacagaaauaaagaaagaggagauguucagcagagagacuguccuaugauaacauaagcacagaagugguggugagaauaaucauacugaggacgaauuuaaugggaaagacuauuuaaagaauuacacugcaacuuuuauaaucgggacuaaaauagcaauuuuuuuacucguugguaauacaucuccaggcacagcauccucugagaguauguauaaguugggaauaagaguguugagguaggaaagggaucaggaggagauaagaaccuguaacuuaucuaacacauuucaagacauuaccaagcuucuuggccuucuaaaaagcuccugguuagccuuacaggaugccacugaagugccaccccuuugugaaaucuuuucccacugaagucacaguuugaugcuucuuaaagcucugcguuuggcauaauacagcaauuaucacccagagucauauacuucagaaguuggucaccuucaccagggcaagaguucuuugaaggcagaaacaauacuuaguacauuaaaaaauuaaaaaaaaaaaaaaaaaacuaucucaagagccuagcgcauguuauggcacaguguugacaaauauuuguuggacugaaccaaagcaaauucacauccacuacugucaacacaaaaaugaaaaaaaaauagugcacuaguuccaaaguucccagaacacuuaggggccauuguagcucucagaagacuggcaagcaagaccugcaauuuuacucuauaagggacauuguaagagcaaagcuugggguacuuaauaacuccacuaaauaaauggcacaaccacaagcuguuauuaggaacacugaauagaggcugggcacaguggcucucaccuguaaucccagcacuuugggaggccgaggcagguagaucacaugaggucagguguucgagaccagccuggccaacacggugacaucccaucuccccgucucuacuaaaaauacaaaaauuagccaggcuuggugaugugcgccuguaaucccagcuacucgggagacugaggcaggagaaucacuugaaccugguaagcagagguggcagugagcugagauugcaucacugcacuccagccugggcaacagggcaagacuccaucgcaaaaaaaaaaaaaaaaaaaaaaaaaaaagaacaaugaaugacguauuaccaacacugagaucaagaaaaaaaauugccauccaggggaaaaagauuaauuaauaucaauuaauuuucuuuuacaggaguagauuauacagaagucuuuaggcuucugaggagaauuugagaaaauuuuacaguaaacaggaauuugcauacgcucugggagcaaaaaguguguccccagacaggucaccugggguauguucaagaugaagaacaaaagucgggcauuucucuaaguguagagucaggagggugcaaauaaaggcaggcuuuagagggaauagagaaacuuuuggauucaaaagaaauacaauuaucauuacaauagagcuacaugguuacacaauaagcaauacuauuaagcacccucucuggaaagaguguucuuugaaaaacaaaaugcagaacagauccaaaagcaagguaacaaaagcuauuaggugaaguccaucagaggaagaauucucuuuccauagcaucuuccuucaaguacaagauaauuauguuuuauuuauggcacaggaauagaauaugagauucaccauucaauaaacucaggaaaaucauuucuuuggucauugcuuuuuauuuauaaaaugacggcuuggaucaagguaguguuucccaagguuuucuuucuuucuuuuuuuugggggggaagauuuaacaggcauuacuugaagaaacuuagagucaauagauucuaaauuauggucacuugaaaccagcaccacaagauuacccaucaagaccuaaucaaccaaauuaacaauuaguauuugggcagaaaguugaugcaauaucuccaauaucaaggcaguacagacugcuuugaaacugauauucuucucugugcaugcauauacacacacagacacacacacacucauacacacauauauuuauaauuccuucuaaauauuugaauguucauauauauaauucuuucuuuuuaauuacuccaagcugagcauguguagguuagauucacucuguuuuauaauauuuauuguguuuauagaauauguccaucacauccuagccccuaggcauguuuacaaauaagauaggaaaaaaagagacuguugauaacauaauggcuaaaaauccacagccaauauuuucagaaagaucacacaaaugcacauacaugcauacacacacagacacacacacacucuaucuacagaucauccugguauccaaugugaauuccaucaguauucucagugcaaaccacacccugugguuucuuuuccuacucccuacacaacuucugccaucuugagucuuaaaauauaaaacaaaaaaauauaugguccauugauggaaaggauagaaggcuuuagaugggagacagggucagauucaucacaucauuucuuuugacagccuagcacagggguuaauguuggcuggggagauggaaaaaggaaagagguaaugggagcagaccugggaccaguuggucagcaacucgcagaguucuuuaaucaccaacaaccucccuguacugaggcaacaugcugcuaaaugcucaacauacagcauuucguuucauccucuugaugucccuacaagguaguuccuauuauuuccauauuucacuugauaaaacugaggcccaaguuacaaaauaucccaaguuacaaagcuacuaaguggcaggcucaggaccugcacccaggucuucccaaggccaaaguuuagacucuucaccagaacugcuuggcuuuuugcuagaaagccuggggucaggaagguuaaccauucacaaagagcucagaaguggcaaggccuggauggaaugcaaucaugaggacaacauggggcacuguccauaacugugugauauugcacuuucccugaucaaacguccccucugaggguguccuagggacauuugagaccauuucccucugacacaucccuucuucugcagaagcacccaucuccuuuagaauuugaauuucugcuaaaaaguagaugcuuuccucacaaauguccccuccuccuguauucuuucuccucuuggaucuccaaacuaaaaacuguaguggguauagaaaggagagucucaagugcugugaaaaucuuucuagaggacuuucaucccuucccaacagccugcaauguggacuucuguccccucaguaacaaaccguacauguccuuccugaacugagaacgaaccugcagcauccagagcagcucuaagaagcaggagaagacaaaaaaggcaugcagcucccugcugcucucaggaaaggggagagaagcgcagcugccuccguucaaggcugggugagagugaugagucaaaugacugucaucauuuggauucugacauuucuuccucuacagagaaaacgaaagagucugcuauuggugaucauucauucugcguucauuuaugucuuguguacuuuuuuuuuuuauuuuucgagauggagucuugcucugucacccaggcuggggcgcagugacgugaucucagcucacuauaaccucugccucccagguucaagugauuauccugccucagccuccugaguagcuggaauuacaggcaagcaccaccacaccuggauaauuuuuguacuuuuaguagagacagcauuucaccauguuggccaggcuggucuugaacuccugaccucaagcgauccacccgccucagccucccaaagugcuggcauuacagacgggagccaccacgucugguuaguauuauguacuucugacuauuguguucuacuuuccgauuuaaacaaugaucccagcagcuaugggagcuacaaagagccaggaguuuggaagcuuuucaagacacugugagcccucuccuuuuauccugacuucuuucucacuuucugccuuuucuugaagaacaagaaaagcaacuccaguggaaaccacuuaagccugcaauuuagcucacaaauuguccccagcauccuuguaucuccuucuccaacuccuuuuuuuuuuuuuuaaccuuagcucuuccugaugauugugagcauagcucagaguaaugccaacuguugcuguaucagcuuaaaucagugugguaccuggugauggggcacaguugaggcaggcacuacgagcuuagacgagccuucagccccaacugaaagggauauauuguggagcacucacgcauucuauagcccccuccuaaucccucaagaaucccaggcugggaauggcugcaacuucaggauuguaaaguuguguaaacacaucuuuacauugacuacaucaugguccaacguaacacuuugaaacaaagggcuugagugugucccuguaccccuucauuccugaguuaaaaacaaagcuccaucagucgacucauauuuauagagugcucccugcucaucuccuuucaguccuuccgcuugccaggguaagaaaauuuagugcagacgaucccagccuucccagacuucccuccuccuuccugacagaauuaguuguugccccccaccccccauguuuuaucauagcccuuugcacacuguguuccccuuauuuauaugcuugucucuccaguugacucugagcuucuugagguugggaacaucguuugugccugucacaucuuuaugggcccaagaauagagaugauaggcaaaaguggaguaaagaauaaaggaagaauaaacauuuuuaaaaucagucuccaaagaguuuuccuucuggcagguaagacaaggcauacagugagacaugaggcaaggcaguaaguaauaagggucagaauaaaaaggaaaaagaaagcgacuguuggacuuggcugaguagguugauagcaagcuaguaagaaacaugaguagguaucaaauagacacaggugcaaaaacagggcugagaaagguaugucggaagggaugucuaguuccaaagugugcugagauuaaggaauuagaaauguaagcugagcuccagauacuggaagacuuuuaguaucaaacaaacaauuccauuuuuuucuuuugucuaaacauuagagauggguacacaaagaauauuuaccugguuggaauguccagaaggacuguaguggacuggaacucauggaagggagacccaauggaaacuguagaaacaggcuuacacaauagcagaggaaacccuuaauaguuauuuuaaucaaauaagauuuucauuuaaaagaaugaaagaauuaagaagaccacaguauaaaauguaaggaauaaaguuuauagagagcaacuggcaucggagacagaauucacaggucagaagagaacuuacaaacauaaguuccaguucuuggagagaugcaagaacauacugcuccuauaaguuaagaacagguuguuuguucaucagaaaauagaauuuuaugccuuacgguucacaugaagaguugugaaugaaaguaugagcagugcaaaggaacaaugagggaugccgggacaccaaagacuagcaacgggaggaagccaugacuaccacaacugcugaaaggacaagggcaaaacagcauuacucaaagccacuggcagccacagucacggaggccaagaugacuggugggagauguaguugcagaaggacacaguuacuaucgucuggcaaauaaaggagggaaugaguauacucaccuccuucucuucacacccuguaaacuuacacuaaugccucccauugagcaaacaccagggaggaaguccaggagacgcaagacagagacggguagaaguugaaccucaggcaaaacaaagauuacccaacacaaggcuguauaaaaaaggaaaaaaucaguuuaagaggcaagagcgucauuggaaauuaagaauaugauugguaaaauuuuuuuaaaaaauacaagaaauggaaggcaaggcaccaaacauuuccuaggacaaaaagauaaggagguggaaaauaugagagaaacgucaggaagcacagaagaggggucccagagagagcucugaguuuaauaaacaccaaggguauggugucugcaaaugcuccagggaaaaacacaagcaaaaggaaagaaaugcaaccugaaaauucuuuaggauucaauaacacguaaugauaaaacaguuucuuugccccgaguccuuggagcauaaaaaaaucugggacaauccguucccuuaccacaucagaaaagcaacuuuuuguuucgaaaggucuguggugaaacacaauuccaugacguuaaucaauuuauuucaauugggagugaagcauaaaugaaaaguuccuauuucagaacagaccgugaaaaugugaagauguuauuauuuccaagcuaaaaggagaugugagauucucugccuggcacauuucagaaagguacaaucagccggggcaggggaauagauuuaaaauagaaaaguaaugggaaaagugcuuuccauguaacagacagggugguggaugaaaaccuaucccccuaaagcccacuuuauuaauauacauuuuacuaggcacuuuggaaaguuugaaaauccacaugcuucucauuucccauagcuucugggucuaauuacauauuugcauccauuugcauacacacacacacacacacacacacacacacaggucucauccagugauauagauaauucaauauucaacuugucgaucaucaccuuaaaauagagaucuaauuauggaaaaaaauuguaugcuguuuuucaaauaaauaaaaaggaggacacugauuaaaaauauaacaccccucauugaucaacagguaccuuuuugguuuuaaccuaucauaaacaugagguuugguacuacaugguucuggcccucccaaauuaacacugagcuaguucagggaacaagcucucacauaccaaauucugaagcugccuuucagcagcaauuugagggaccaagaacauaggcuuuccaaaugucuagaagcuaaccagauuccucucuccuuaauuuagccccuuacauuaggugccccaugcucucuuuugggucaaaaauaacagggacaauuuaauacccuaugacuguccauuaaauaucugaauuaugaggauucagauguaaagugcaauaguauuuuaauaaaaguacacuaaauaaggaagcugguaauagaccucuuaacgaaaacguagucaaugguucauuuaauuugauggcagaguccacuuucaaauaaucccaaaaguguauauuuuguaagaaaaagguugcagaguucaccucaggguauucuuaaaaaauuguuugcacacugagaagacaucagugcuaagaggcuuuccugauuacugaaauuugguuggaagucuuuuuuauuucuauuaaaugaauauauacaaccguucggcugccucaggacauuuaugaaaaugagaugcucugucuuaaggaaguuagcuuuaagagcgacauuugaaucauuagaugccucauuggcuguuacaaaaacaaacuucaaucuucugcuuccccuuuucuaauauuagcuaacaauaauuaaguugcuuagacaauuccaggugacucaaauuucauagcacgcucuucaaaaggcuaagggaucacuuuaaguuccuaaagcccuaagacuaaguguguuucacucacuuuguguagcuccagcccagcaucauguaccaaagggauaacaugauuaaaaaucaucaacuugucuuccgaaaucuguuucuaaaccacagcacaaggaacagacauuuaaauacagaaagggauggagaacuacaaucuuuuaaaagugcacacuuuagugcccagugugguggcucacaccuguaaucccagcacuuugggaggccgagguggguggaucacaaggucaagauauugagaccauccuggccaacauggugaaucccugucucuacuaaaaauacaaaaauuagcugaguaugguggugugcacuuguagucccagcuacucaggaggcugacgcaggagaaucacuugaaccugggaggcagagguugcagugagccgagaucucaccacugcacucuggccugggcgaaagagcaugacuccaucuacaaaacacacacacacacacacacacacacacacacacacgauaaauauucacaucaucugccuuugguuauucaaccuauaguuuaucaugggaaacaagaucuuauucuuauaaaguaccugcauauuuucauuugcuagaaauuaaccaauucagcuuauaucauauguggcacaagguuuugucaugaggaggacauuuaaagaauaauuuaaaagaaaacaaguucaaacguucacauaaaacaaaauagccaucucuaaggagaaaauggguauugcugauccuaauguuaauauucuaaaauaaaugaaacauuuuugaagggaguauucaccaccacagcuaaagaaagccacaaaaauuaguguauaugugccuauauuuauauagguacauuucccaauuuuauucuuuuacuauuacagauagcuaauuccuaggaaacauuuucuagaugucuucuuuuauauaccaugucuuuggacauuaauuacaggcaaagaaaguaaacacucacaagaaaaagggaauuuuacaaucugaucuucaauguuaucucaagaaaugcuguuauagcuccuugguucugguuuccaugcaccugcaaauuguccuuucacccaucacuuguaaguaguagaggagcaagcauaccuguacagucaugcauugcuuaacaaugagaaguucugagaaaugcaucauuaggcaauuuugucauagcacaaacaucauaagagugcacuuacacaaaccuagauagguauagcccacuauacacauaggcuauacgcuauaugcuauaugcuguaaccuauugcuuuuaggcaacaauucuuuacugcauguuaacauacugaauacuguagauaacuguaacacaaguauauuuguguaucuaaauauagaaaagguacaguaaaaauauauuauaaucuuaugaaaccucaguuguauguguacucuaccacugaucaaaaugucauuauguggugcaugacuguaugugaacauuucuugaucauaaaaauaaaguguauguugacuuaguuagugcccuggcaaguuaauauguauguugacaaacuauaaugcuuaacaugaguaugguuaaaauaacacuaugugaauauauaaacacaugucuauacauauacacauauauaccuauauauacacacacauauaaauauauacaugcuuauaaauuacagucugucuuacauuagcuaaacuauuacuacaguuugagauaaauuugagauguuacaauuggaaaucuccuguuucaauuugagaagggaaaauguuggcauauucuccugaguggagaaagaggcuuucuaugucagcagauacuucagaggaacguuaaugucucgagguuucuagcaaauuaacagcccagguaacaaaaugcagggaacucuggccaguugcuuacuuacucaguuggaucuggccacuucuccauguauucccaccacacuaaauggagcaugagucauuugaguaaugagucagaaaaugucuagcagccuccgugcaauagcagacgugaugcuuaagauaaauuucagagauacuaggaugguguuuuucaugucugcacaucucucauuggugaugaauaaaauuccuucucccuucccaagagacaaaaacuguaucauaugcuauccugaggcucguuccaacucuaaaauuuaaaauuucaagcaaaaccuauagaaagaggcaaauacaguguauaaaugucuacaauuuguguccuauucaaaauuaguuuuuguggaauguugucuaauggauucaguggucacguuaaugacaacuucacucccaaguacuacaugcccuguuaaagaaaaaaugcuuaagugaacaaaaaauuuaaacaaauuuuggaguucagugaaauuaaugaauaaucucuuuuucaaucaucccugauuuuuuaaaaucacaauaccuaaauuaugaugauaggaauuacuacuagacuuugaguuuuaaucccaguaacaucuuuagcugauuuaaaccuauuucaacuuccauuuuaauauuucaucucauuuuaucuguaugguuaauauuaauuuccuuuuugcaccuucugguuguagcacaaagccagcuauacaauaguugugugcugcugaauggaauuugaaggcaauauaaaauaauguacagcaucacugaacuggggauuaaaaaucccaaguuugaguacugucuuggcaaugcacugccuuugucacucagguaagucacuucuuccuuacaaaaguuucuuccauuacagguuucaccucucaugacaauuccuaucaauuaguugaggcugucuggaguaauuaggcaggacgcuggugggauggagugccaugauugaugagugaugccugccaaggguguaugacagcgaagugguagcaauuuuguccuguacuuggcaauuguagauuagaacagggcugcucaaaugugcaucuaucaccaggaagcuuuuaaaaugcagauucugauuaagucuggggcgguggcugagauugcauaguucuaauaggauuccagguggugcugaugcugcggaguuagagaguacacaagaagcaaggcaaagucccuugcagcucugaaugaauauggaaucucaaccucucauucucucuugcucacucgcacacacauuauuucuacuuuauguaugugaaaaggugcuuacauaugccaagaauacugacaagcacauuaaauacguaauucucauccucccccacaaaagguaguuagaaguuuucagguaagaaaauggagauuuaaagaggguaaguaauuugucuaacaucacagagcugacaaguagucuagaugagagaugaaccuagagaacuuaauucuaguaccuugcucuugaccucuaucauaugcugucuugauacuguaacaacauuagacugcuuacuuagugccagccacuaggcuguuuuguacauauuaucuccucuacuuuucuuaagaacucuaggagguagguaauauuuuuguuuuacagauaacaaaauuaauuauccuuccacugucucaaucucgguaaaaccauagugauuccuauuaaguaaaacauuagauucauaucuauaaugaacuaaacacaaagaacaguaggcuaauaaaagcaacauguauaugcauaaggcuaagaguaaauauauaaaaauauucuuuuauaaauucauccuauguaaaugcauuuuugacagguaaacucaaauguuucugcagaguuuagugaugagguuaucaaaguccaagugauuauuggucccaaacagaauccaucagugggauuuacagugggagaaguaucaaagauucuuuuuucaucauacucuuuuacuaccuaaaaguucuuuauuagcaagcaaaugaaauaagauuggaucaguaaauuucccuggagaugagauuucaauauaagcaggugacaguggaugcugcaccgaugcacacuuaagaagagcaaacaccauugcaaugugagggcaggauuuuugcuuuacuuuguuuaaaaaaacaaaagugugcuucaaaaccuaagggucugaagcagugauucucaaccuuggcuggaggcugcacuuuggaaucaaguguguagaggggacuuaaaaaauacugaugccuagauccccuagagauucugauuuauuuggacuggggugcaaccgagacaucaggauauuuuuaagcuucuuaguuuuuaaauguauaaccaagguugagaaucauuugaauauaggcauaccugucccauguggggggcgacuagucauuaaaggcaugaaugucuaauugaugaaugcccucgucagagcagacugguggcauucagagagcagcaaagacuuucucccuugaaguuaagcuuaaauuucauaaguaagucuauuuuaacagaaaauuuuauaaaacauuuguagauagucugaacuacgaaaaucauuuucuccccuuaccagaauuauuuccacuggagggcagucuccucuugggaagaaaugaaugcggauacaaccuucuuaacagaccaaaguuuaaaauauugacuaagacuguggcauucacauggguuucauuucaagacaauuucugggagauggaguauuugggauaaaaaaaaauguguauucuaugugaagauacugccaaauuaaagguuuauuucugucugcuaaaacuaaaaggauaaaagcuuaacccaaaagauaaacacauccacauauggaagacccugggguguacaaacauaacaacaacaaauagaaaguagcauuuauuauagguuuacugugugucagauccuguacuaagcaauuuaaauauccuacuugauucucagaacaaaucuauauuuuauagguaagaaaacuaaagcugagaaguguucaaagaaauguguccaauaccacauaucaaaaaaguagcugagcuaggacuugaacccuaucugccugacuucaaaaccagcccuugcaaucaccaaugauaccgcuuuacugcuugagugagaagcaacauggucccuaugcguaagacaagcgucuaaaucagaacaugucaacacaagaaaacaggaggaaaaaacucucuuuacacagcauuagguaaugaaagaaacugaaaggaggugauucgggcagaaugagaaauuccuuauucuccuuacugguuuuauauuuuaacaguuuucacaaacuguuuuugguuccucuucauuucuuaugcaaacccuuuccaauccauuaaaaauaaauuuggcauucccauugcuaugucuucagccgcuguacagaaccuuggacuagcuggucauauuccucagagacuuauuuccuagaucagggguugucaaacguuuucuguaaagagcuggauaguaaauauuucagguucuucaggccccacggucuuggcugcaacuacucaauucugccaguguagcaugaaagcagccagagaugaugugaggauauagaugacagacgauaugaacaaaaagggcaagacuggauuccaauaaaacuuuauuuauggucacuaaaacuugaguuucacaucauuuucaugugucaccaauuauuauucuucuuucuauucuuuuucaaccauucaaaaauguaaaaguuaucuuuagcuuaugagccacauaaaaacaugcuguggccuggauucagugggcaggugguaauuugccaauccccguccugaauaagguguccuguauucauuugccauaacgcaaaggucuugucacaaagauaucuagcaauggcuccaugcucaaagagcaaauguauccccagauaccaucagcuaguauuucagaaucagcugccuucccccaaaccacuuuuugcuauuguauacaaauucucucaguaguaaaaguaucccaguuaaaucacaucagcacucugggaaauauucuucuuggggaaauauuacagaaucuggaaucugaaaaugauccagaaggucacagagggcugucauuucccaaaggcauucuccagagccuccaagcuccucacagcugcagauacagguauagguacaguuccuuagagaaaauagcuccacagaaugaccaggaccuaagaaagcucuuagcaggggugugcuagagccaucuccuaucagcucauagaagaacucauuauauuuuucagcauuuugugagccaguugacaugaguugauaaccugaaauuggccauggugggagcaucagcaccacagaaauucagaaauguguauucacaaguguuacaaauuaggcuuuuuuuccccucugagagcaauuguuaaacauuggccagcauaccucuauccauuaccccuuuccaacagacaaacuccucuuagaucuguuuuacacauacacacauacaacccuugugagcugcgguggcgguggcaguaacuguggguucagggaaaggaaagaauuuccccaaguaauaaacaaauguauuuaggauuaaucaccauuuuagaucauccuugaguuacuacucccuuuggaaucccaaaugcauuccccuuuuauauuaaauauggucaacuggagacuaaggaguucaaucauuuuugcauaggaucagaaauuuaucagaaucuuuuaucuucaauuaucuucuguaauuuuauguguucaucuaacauggacaaaaggaaagaaguuacaaaguccugcacugcauuguacaacugugauccaagaggugccauuuucacuucugcaucaugcuaauuauccaugagccuauucccuuuuuuauuuuugcuacuacugaaugaagauccuuacaauguaauaucuagcaauguucuaauguuccugaacuauauauuauuuguuuuuaagcaagaggcucucugauuauuucugguuccuggucucacuccacuaaacuacaugagcccauaaaccuaaucuaaacaaaucauuuugaauuuauuuuuucugcauuugcugccuucaucuuaguuuugcaucacuucaggcaucaacaaaacuauuuuaauacaauccuuucccucuacuucugcaagauuagaaaauaaaagagaacauuuauagcuacuaggugagcuggaauaucuaaaaagggauuauaucccucccuauuugucaauaaauaugacaauaguucaugugagaguaagcugaagcugaguggccuauaacuaauucugaaaauuucuaagcuuuagaaaaggauauccaggacuugaaugcuccugaaacgauacaacacauucaugcguaaucagagauacguagauucaaauaaaucuaccucuacaaucuucagaaagcaauuuuuggagucagacacaggugcauuuuguuagaguuuacugaaacucuuuacauuguaaagcuguagugguagucacccuuaaguuauucauagacaauuucaauuauuuauucauagacucacaugauguuauuuuucauucagauccaaagcuuguuacacauucugcaacaaaauauuuaaugaaauuccaagacuuaaaaaaucuugcagugaaagcaagaaagaccuaucaauacugagucaacagaguggaccuaccaauucaaccaggcuugguacccaaaggcacaacucaacauaaaguuaacauuucacuauguaaauucuaacuccaguuucuuuuugaaacacaccuuccggucaucuauuuuuccuucuugaucuguucauaagucauaggacagaaucaauuaccuaggacccuuucauugucaaugaaaauauauuucccaaaguggguucugugaaacacuauuauaggcauuauuacaguuguuuuacuauuuuuuuuaauuccagauuuggauaaauuugggagauguggguuuucacuccuuggggacuucucagagcccuuaguauauuaauguacaucagaacucuccaaguagggcauuagaacauacaguauuauccauacauuuuaaaacaaaagaauuuucuucucauggagaaucucauuggacuaguaucccacgaagcacacuuucaagaaugcugguuuauaagacacagcugagauuugcauauaggcaccaaaaguggaaccacagagaaagggggaaaucaucugagaucccucucacaugagcacacuggcugcaguaaaaugagcaauagaaacugcugaguucuuuuacaucuauuuccagauccugucaaaaugaauaaauaaagguaagcaggguaggaggacagcaauccugugaaauaaccuccccccagucuauuugauaguuuccaugacuugaucauugacucaucaaaauagacagaugugcucuuauccagcaaaguuuaaaguuagagauaaaaacaacaacaaaaaccugagcuucaccuucagcaaagaagugucagcuggagacuuuagaaauucaaagagguaaaaacagaacuaucauucaacccagaaauccccuuacuggauauaaacccagagaaauauaaaucauucuaccauaaagacacaugcacaaguauguucacugcagcacuauucacaaaagcaaagacauggaaucaaccuaaaugcccagcaaugauagacugaauaaagaaaauguuguauauauacaccauggaauacuaugcagccauaaaaaaagaacaagaucacgucuuuugcagaaauguggauagagcuggaggccauuauacuuagaaaaccaaagcaagaacagaaaaccaaauacugcaugagcuuacucauaacuaggugcuaaaugaugaaaacucauggauacaaagaggcgaacaauagacaaugggaccugcuugagggcagaggguuggaggagaaagaggagcaaaaaaaauaacuauuagguacuaugccuaguaccugggugaugaaauaaacuguacaauaaacccacaugacaugaguuuaccuauguaacaaaccugcaccuguaccccugaaccuaaaauaaaaauuuuaaaaaauucaaacauccugccuaggauuacaaauuuauuaaaaaauuauuuccuuccaucuaagcucucuaucagaaaaguaaucauggaaccaacccaaaugcccaucaauaacagacuagauaaagaaaaaguaguauauauacaccacggaauacuaugcagccaaaaaaggaaugagauaaugucauuugcagggacguggaugaagcuggaaaccaucaucuucagcaaacuaacacaggaacagaaaaccagacacgacauguucucacucauaagugggagcugaacaaugagaacacaugaacacugggaggggaacaucacacacuggggccaguuggcggguggggagcaagggaagagagagcauuaggacaaauagcuaauauaugcagggcuuaaaaccuagaugauggguugguagguucaguaaaccaccauggcacacauauguaacauguaacaaaccugcuuguucuuuacuuguaugcuggaacuuaaaauaaaauuuaaaaaaaacucaaaaagagaaaaaaguaaucaccugauauucaccgggauaaagaaaggaauuuagagaaaugucuuuugucccuacaguugaggcguaaaaccugacagugaggaugaaggcccuuagaagccacgcaguuccacuaacaagcccauguaguuauuucuaccuccauuaccugcugcuuuauuaauauaauuaaccacuauuuauugagcuucugcuaaugccaggcacuaugcuaggcuguaugccuauauuuuuauuuuauccucugaccaugguaacaucgguugucuuauuauccugauuucacagacuuggcacagagaaguuccgucucaugucaaagaucacacagccuggcugggguagaaucuguaucaggaggcaagucugccugacuccaaagaucaugcaaugccccuucuccuuuuuuuuuucccuuccaccacucuucugucaugccuuuucccuagcuauuaccauuuaaaagcaguugugauuaaaaacaaaggucagcuguccauaacuuaacucaaauguucuuucuuccuugcucuuagagacaaauuaccaucuuccaucauucacguggaccaagaaggauuuaggcugagaugauuaugcauaauaaucugggucucauuacaagcugagcacuuggaagggccauucucucagcccuuaaggcagcugaacuugaucauauuuucauuuucuuuucucccuauauccacuaaagaucaacugacacagaacaaaugaaguuacuaacaauuuacugauuucuuuaaaauauauaucuucaauaaaggaagaacaaacagucaaaugacugaaaucuaaguacggaaugugaaaaaugccacucucuaaaauucucaaaggaagagaagaaaauaaagaggggaaggagaaagagaggggaaggagaaagggagaaaaagaaucgaaggagggagagaggaauggaaggagggaaggaaggguauagagaucaucugcauuagaaucuucucaggcugggggucccugagcccacuccagaccaacugauucagaaccucuggggugggauccaagacugcauuugcacacacuccucucgugacuauaauuuuuuuaauucauuuauuuuugagacagggucuugcucuguugccuaggcuggagugcgguagcaugaucauggcucacuacagccucaaccucucaagcucaagugauccucuuggccucagcuucccaaaguguugggauuacaggugugagccaucaugccuguccuggugauuguaauuuacaccagauucaccuuacccuaagaagugacuuguauauguguugcuuauggaagucagaaguuucccaaguuuaagaauucagcauuuagcuccaggaaaaauuggucauaaauaugaugaugacacauaugugagacaaugacugcaugaguccaggaaagaauaaagacauucuccugagaaagacuccucguuggagccuauggguucuaccgggcaggugacucacccguuggagucacaggugacucagcaacaggguuauguaacaagaccaccuuccuuggugcuaauuuuagauuuaaauagagaaacuauuugaaugucaaauuaaccuuuuuauauagagagagaaaaaguauaacccaauguaagcacaagguaauaagcacagggcaacacauucaaacagaugcaaagcacguggagugaaaagugaguuuuccuuccaggcccaaccacuucuuucuggcacuucagaaacacacuuuguagaaccaaucacuuguauuugugugaacuccucccuguuaauacaaagggaggaagcccauuauacacacaguucucuccuucacuuuucccagaauaacauauccuggaggccauucuccacaguacauacacauuuacaucguucuuuugaacaucaucacaguccauguauuugaccaguucacuuuaauaaacauuuagacuuuuucuaauccuuugcuaauagaaaugaugcuauaaggaacacucuucuucauauggcuuuguccacgucgggggauauauuuuuaagauaacucuguggaagcaaaauggcaagggcaaaggauacaggcacuuuugagauauugccaaauuuucccucccaggaaguuguagcaauuuaaacuucuauuaauaguauaugauacuacuuguuucccccacaccuucaccaaagcaguauauuuuugauugugauuuaauuugccacuucgacuucuuacuggagaaagugcugaccagcaaacaugaauguaacuuggcagcuauauuucuccuggagaaugaauacauuggcauucuaauuuaucaucuucuuaugcauuagguaaguaugaaucuguggccuugacccucuucaacucuggguaaauuuacaaacuuuaguuucugggccugcuaacacaggugaacagugaugccuccaagagaggacacaucuacaagacugcuggaaggaguccucuuuuaauuuuacucuuccaaguuuuaaaaauaaauugcaaaauaauuuuucucuaauaaguuaacgauuuaaaauuguaauucaauuagaaauuuuuuuaaauauuaugaaccaaauuuuucuugcucaagucugcaagaagggaggaacucuguggaacgcuucagaucagaccaccuuggcggacaucaaagaucuaauucaaaugacaucuacucacagacucaguggucugcuucauggauucaaaaguuaaucaaaauucauacuacaaaugcuguuacuaaucgccacagcagcaaacuagaaccccuccuugcccaccacuuuuacacuccacccccagagaauaacagacaacaugcuguuucuuccaguaauucuuaggauguuauugauguauuguuuauuuuucauagaguccaugcacuuaggaggaaacagggcauaauauauaugcacuuucagaaaacuguuuuaauguuauaaauaauauccaaaaccauuaaugaguuuuagagguggcugccuugcagcggggaauuacuuaagcacuggaaagccaaucaacaaauauuuauuuugcaacuucugugugcaugccuaaaaaaucuuauuccauuaguaaaauaaguccaucuagaaaaauacauuaauucaacgcauauuuacuccacacucacauguugcaccacagcuccaagugugaaugaggcagagacccugcacucgaguuaggaagacacagccaacugaacugaugacuuaaacgcaaagggacagagcacaggcuauggcaggauuacagaaaaagggcuccucaucaagccuugagggaaucagggaaggcuuccaggaggaagcaaacugauaugauuuccaagaaggauucauccaggggggaaaaauggacagaauuagggaaauacuauugcuuaaucauagaaguucaccuaaaccccaugaaagucagcaauaguaccguuucuaccugaaauacagucagcccaggauuagaauauguucagcucucaugucauaaaaucccuaaagaacuuucugaaaagcuaagcccacugauaagaauaaaggaaaagcauagcaccccacaaacuaaaacauauuuuccauuacaaauacauuuucaccaacucugaaaaaccaaguggacauuuaacagauccuagaagacuuugcucccuaauugccucccaauaacccucacucucauuaaacuacagcaugacccucuaguuuggaggcccaccuucucuuuacucaaaaauuuccaaaccuaaugagagauagucuuagagaaagaugauggacuuaacagacugagacguauuuuccuuccuugguguuuacauuauuugacagcaaggagccccagagcaggagcuaguuccaagcaaaguccccaaagaauaucaacaaggaaaaacagccacuaggcuguauaaauccacuugcuauaaaauuccaacacacacauaauaaccagcauaugaagcugaauccuuauaggaaaacaauucaaaauccagguacauucaucaggcccuccccaugucguggaagacuaaaguuaguagcucuuccauauguuacacuaugaaacaagaugaaaauggcagagaggaaaaugaaaugagccuucugagauucauucuuuaguuuguucguucaaauacacggcagaagagggugcuuuccauacagaaauuauuccguuuugacacacucuaacuuaggcuauuuggaggagaauugucuggcucuaccuuacaguacacacuucccaaagucccacaaaucauguggcuuugggagaagagagaguucggggagcauuuaccccgaccauaccaaaaugaauuaacagggauuaauuuggguuacauggucuaugugccagucagaacagcuuccaguguguuucagaauuuaagguggggaaaaaagaaacagaaaaucggauuucaaaacuacccuuuaaugaaaagcuguuaaagugauuuaucuuaacaaaauaaucaucaaauuagaagcuauauguauucuuaagacauuuugaacuccacauuguaucaaaauuagguagaauauauauauuauuauauauauauuaucucucuauauauucucuauauguaaccucuauauauauauauacuauauauauuccauauauauacuauauauacucucucucuauauauauauauauauaaaaucauagauacaccaugauaauuuacugagaauacuaaaggagaugcgaauaaaaaauauguaucuagucuauuuguuagaaaucagguauaccuaucugcaacagacaaaaauaacaauggcuuaagcagacauggucuaauuugcucauguaagucugaggaccagcagaccagaacuugucuggccacuggcaccguggucaucuaaaacccaggcugcuuucagauucucuucuaccaccucugugaugguucuuauucuccuagcccaagauggcauuccagccaugccauucacugccugggcagcaggauggaggcagggcaggcuuccaaucuuuaaugacauguuccagaaguugcgcccaucacuucucauugucacuugucagaauuugauuauacaaccccaccuagaaacaaggaagguuagaaauguaauccuuccucuaggcaguugugcaggcucccagaagaaacagagcuggauuauucaagaaagguaagcgucagagguaguaggaaaguagccugagucuggagagagugaguagagccuccgugagaucuuguccucucuucuagccccucaucuagcaagauuuacaguggguuccugugccugggauauagcacugucuugaugguuauagcaaaggucccaguggcugugccuggcuugaaagaagucaacagcagcaauagcaaagcuugaccucaaauugauggcacagacaggcauaaagagaagccugcccaucgcuggguauccugaagaccuuucuccaacaucuagggggaaaaugugggcuuucauucagugggcagagcccacacuuucauuuugacuagaacauacauucugaguauguaaucuucuauugguuaaacuuaguuauacucucucacuuuguacccuuaacaccacauacaagacugcuuuugauaaggaauaaggacaggagauccuuuuuuguccuccaacuagccugcaaaaaaguauuacuguagauugauauuguauaauauuacaaagaauagcacuagcccaggugaccugacacuucucuauaauaauuuucucuggcacauuaauuuacacuugcaugcauaucacugaagaaagguauuugggguuucuaucaggacaauaacaggcuugaaauuaguguugaaaaacauucacagccaggauuucacccccugccccuggguucucuauuuuagcuuucuacauuggcaacuuucaacuuuugcugcucaaugcaaauaauaacuagcuuaaugauuuagaagaaaauauucuuggaguauguuauagucguauguuaacugcaaauggcugccaccuccaaauaauugucugacacuaugucugacuaucuguuccuccauucuauugaucucuccuaugaacaaagcagacagauaugcagguacagcucuuuuaggaacaaauugcccuuucuccaagcugacaucuuuagaauuaagaacucagagacagccaauguggaaaaacauuucuccccugccacaugcuuggugggucagaaagucaaucaaauucuauuucacaaaaaaaacuaauuccuaugagaugggaggcugcauuaauauuucuaagaccaaauauucucccucaaguaauauaaauuuauagguauaacuuuucccaaugcucuaucgacuucucaugguauaugaaaguaauuaggcuucucugaaagccagagcugcguugagaacuauauuugaguaaacacaaaagaaaagcauuuugaguguuacuuuuaauguuuccagaaaaguuaacaccuauaaaaauauuguuuccaguuuucuguauagaagucacugaaggaggaugugugaaagucuguggaaacaguacacuggcaaacugccagcuggaaucgcacggagcucuguuguaacucaaaucuggccaggccgcaagucaaagcauguccuaagaaauauaguacacacauacagcgaacacaaccauuguaacucuagcccaugggaagcugaacauucaauggacaguguccagacuauauagaaaaauagaacacugacccaccaccugcagaaaccagucgaggaaaccacaacuuuugcagccaucggccccaaaugguugguacuuaaucaacaacugccaacuuccccaaguguugcccccugcauccaacacaggaccaaccagugaaagcugacucugaucacauaggacaucuggcuucuagguuagccaccuccagcuuccugugccaacagccucaagucaggucacaccugaauccuccuccucccuucccucuccucuccccuuccaacacuauaaaggguuuucuauuccccuacuuccuuuugagucuucaccagccacaugugaugauggcugccacccuuguucuagaaagcccagaauagccucugcuucuucucauuugcauugcuuuuucccccauaucugguucucccugggggccuucuauccugccugggcccucugcuaggaguuccuuaacuuuucccuucuccauccugcagcaucuucauccuucccugcuuccaagggcuguguuucuguagaugaacuguuucuccccuauuugaggccaguccuuccaacuguauucuuuccucauuauuucuauuccuucuuccuggaccuuuuguuuccaccuguuguaucccuugcuguguuccucacaugccacugggacagcacagaaacagucccaaggcgucuaccuggccaagcacaguggagcuacugugaggacaggauauaaagaagcaacagucuggccucaccaagaaaagggagcauuacagauugauucaucugcauuacauuucaagccaaaguugaacagucuagauuuggaugcaaagagaacagagaaaaaagcuaggagccaauagcaaccaauucaggggucagaguggcaggcaucaagaaaguaggauggacaaaggagagccaacgaggagaaauuaggggaaagcgaaacaucaguaggcagaaggcaauuguacaggauuaagccugaggacaccauguuagucuuuuuuuuuuuuauacuuggcuccuguaaauugcagugagccauguauuaaagggaaagaacauggaggaucaccaagcauuucuguccuaaauauauacauauacauauaaauauguauauauguguguguguguauauauauauggacacacacacauauauauguguguguauauauggacauauguguauauauauauacgcacauacguauguguauauacguguagauauauguguguauguauauauguguguguguguguauaguguguguauguguguauuuuaagagacuaggugucacuccuguugccagugccgucgugcaguuauagcucacugaagccucaaacuccugggcucaaguuauucuccuacuucagccuccuaaguagcuguaacuacaggcaugcaccgccaugccuggcuaauuuuuuuuuaagagauggggucuugcuguguugcccaggcuggucuugaacuccuggccuuaagagauccucccacagcacgggaauuauaggugugagccaccaugccuggucccauaauauauuuuccuuugcaauacagucuauaguuaacauccaaaucccaugcaaaguauaauaaaacaccucuuaccagcuucuucuagggcucagaaaaacucucuucucuccauuuuugccucccuucugauuucuccauuauuauugcucuauuaauucuucuuucuuacaaauaaaaguauacuuacccauuaugaacuuuuaaauaaucaacuucuuuuucuccuguaauuaaccaaaaaaguucuuggaauaaucuacuaaacacccagucuccacuaucuccucagucaaauacaguguuggcuucuucccuaggccauucuuagagaauuccucuccaaggucauucgagcccaaaccucaugcccuucuucagcacgcacaggcugcaggcucuccugaaccaccuugaaguucuccaaccuuggccuugccgacacugcacuagccuuugggaucacccuuuuucagcucagcuauuuuucauucuuucacuccugcccaucccucuuuuaucaucccucagucucaucugcaauggaaacaugaccuaaucuccaaaauccuuuccaauugcuaucuccuucuggaucuccaaaacagacaagauugaggcucccguuugcuguucuugguguuugaaucacuccugcagcaauuuccuacacagucucauaguaaaggaaucugcaccccuguauucuacuucucacugggacuguaagcuccuuguggguaauggcuaaaucucauccaccuuuauaucuccaagucuaacaauaguacuagacacaucucagguagagacucuggagugugacugccuauagagagcaugauaauacuuucuaucucauaauacaacgccuagcaugcuggcucuuaccaucaucaucaagagaugagaguuaaauuaaaugaaccuaauaaugugaagacagauguuaguauugucccccugugcuguuucuacuguauuugauuucagauauuuuagugaaaaaaaaugugcuuugaacuaucuagaugacaccaaaacugaaauuuaucagagaccucugguauucuguuuugugcagacauacugcuucccaaauuauuuuacacagcaccauccccaccucauuuccugugcuuauggacaacggaggcuugcagaauuaaaguaugccuauuuauuccauaagaaaaugggaauaaauauuaagauaaugguugggggaggagaaaguguacagaaaauaauuaagucaaacucacccaacauuaacaugggggagaagagauuuuuuucaaaacccugccucccuagagcccuaaaccuuuucaucgauuuccaauaauagugagaacuuuugcuauaaaauuguuuuacagcagcuaacaagcaguaaauguuuaaucauuauacauacuuaggagagcagcauuguuauuuuauagauuuuaaaaccaggggcucauauagaucuaagagcuuucuucuugcaccuagaaagcagcagaaccauaccuugaacuguaguuuuucagacucaguucuuacccgcugucauucauauccauaccauucuccaaaagacucauguaagaaaauaaucaccaugcaaagaaaccauccagcucuucaugaaaagcucuaguucagucucuaggaggacccaaaugacagugaagucuaagucucagucucuaaugccaaggaaaugucagggaauuaagacccucaagugugaacaugggaggguaacucaggcuccucuucuaauaaagucuaaaugggaguucaucaaacuguuuaaaagccgaucuuaucaaccuaacuaaaccuaauucuucuugcuuuaucugaaacccuguuuuaaaguucaaaaugaccaagcuaugcaauuuguaugcagagaagcuaagcagcugagagauauugagccaggacucucugucuaguaaguuagaggaagaacaacaaaaguagauugccagauacaaagaaauaagcaacaucagagagauaccaaauaaaagaauguugacagcucuuggcuucaggaaagccaagaagaaucauacauugaggaauuggcauuugagcgaaggagguuuagaucauauucuuucaucuugaaaguauaaaaaggucuggaaagauguaucauccuaagcacccaccaucgaaguuagauagcagcaauuuaauuccagccuucauauuggagagcacauaggcaacuuaauauucagaaacaagauuuggggggacaauuuaaagagagggcauuuuccagauuaauggauacagcugaauaaauguguucuuugcuuuaaaaaucccucaaaauaauuagcaggaaagguagcgaucaagcaaaauguugacuauuuuucaagcuguguuuucucuccucucagaauuauuaauaaacuuaccauauuuugguuaaaauauuugcucacaaggaguauuaauuuuccuaaaaugaauaggguuauaauauuuuaaaauguauuucaccaacagcaauuaauuuguguugaguguuugaggauagauaauuccacugggcaacaaaaaucacuuaaucuuccauguuguugcaagagcaaagaaaagcaacugcauuuuaaaaguuuaauuagaaguaaaagcaaguuuauauaaugauauaucacacugcuagcaaguaauaaagauaaacauccucgcauauuaucagcaccaaaaaacagucaaauuucgcuuugcuuacagauugcagaaacuucuauaguaugaaauggcuuuuucagauaccgcuucugaguuugguggauuuuuuucccaagaacuugugguuaggauaauuugagggauuacaguguagacagugacauucccuuguauuugagagaaguuugugcaauucagacaugacuguguuugcuuuuagcaaacauacuguucacauuuugagaaaaacugcugaugcagucuggugaaaguguucuagcaaugccaaaucacugacagaugugcugucugccaagggauuucccuaggaauguucuaauuuucuucuaucuguuuagagaaaguucguuuaaaaucuguuaaaauguauuaaugugcaguguuccauuguaucuugcugugggcauacuagcaaaagaaaaguuacaggaagauugguacuggggugccuaccaaaaacuugaucccgccagaucagaaaccugcccaauccucgaucuuacagaagggagagcucauauacucuguaauaacuugcauugucuauaauuuuauuguguuagaacacaaaggggcucacuauucuuccaaacucauuuaaaaauauaccugcuguugaaacugcagucuagagagauuaggugauauauccacagucacagucaauuggccagugacaaacaauguggucaccugcaaauaucaauagaauuaagaaaacaaaagguaguucuuaccagugaguuuugcaugaaggaugugaggcucaaagauaagauacuuugaguacggaucuaaaauuuuuauuuguuaccaaaucaauguuuucuauauuuccuaaggugacuauuaagucggagucaaauaucagaaacaucaucacaguuauaaacuuaaccauuguggggaagauuaacauggcuuucauuagugaauuaaaauugacuucugcauguugguacaacaguaagacaauaucacaacuguacucccaaggaaguaaaaugcuaaaaaggacaaguuaaaaaaaaaaaaaggaaugcaauacuaccagaaguccuaaugguaccagcacauacacacugucccacaucaaugagaaugcucaccuacugccugagaaguauaauaaugaacagcuaucguucuugcccaucuaaacucccuuucuuuagggcaggaguucuugaccucagcacuauugacauuuuagaccacauaauucuuugcugugaagagcugucuguguacucuaagauauuuauggccacuacuuacuagaugccagcagcaucuccuucccaguagugacaaccaaaaauguauccagaugucgcuaaauguguucagauggggaaaggggagauauaaaaucacucccuuuugagaaacacaacuuuaaggaagcagccacuuccucacuguacugguagggcugccauucacaucauaugcccagaaggcacuuagagcucaguaaucucauggccauggccuucccaauauccacagauccauccugcuaaaggcaccaaugaucagcucuucucugggacuuguucuuuaauuccauauccuacacaacacucucccaaaccucuuuuuuccauaaguuauucaaaguugggucugcuacuuacaaacaaggaagccuacuugauuaaaaaaaaauaagcagcaaaaauaauuguuuucauuuguguaagaaaaaaauagugcaucugucauaaacuaauaguagaguaaggcaggauuacagaaucacacuccccaccuccacccugcaagaaacuaauuuuuaaaaguaagaaaaugauaaggauuuuaaaaagcuaauaccuuacccaacaccuauaaaaccaauaaagugguauaagcuuugcuauaaauuuugaaagccuaagaaaagaaaacaaagauucugauacgucagccccaccaacucacccuaauccaacccuacacacacccagaagcgguacuaaucaaagaagguaaguagacagauuucugaaguuucucagaacuacccuaaauaugaaaagguauggacugacagaaggggagugaugaggcaaacccagacaaauucgagaaaaacaacuuuguuauagaagcuccuacauguccuuuugagaccuuaucaggacuacaguacauauuauagauguucuuuuuaugagaagaugcccccucugggcagaccaaauuagaaaaaugcaucccucucaugagcggaugcaacagcccugcaccaagcaugcuuuuuuggaggcagagcacagacuggaauugagcuccccuuccgggccccucaccuauguuucuccauucaaggacaaccugcacacagcagcaguucacagcagcccugccagcagaggcuggaaggguccccagaguuuguugacuuccacagcaaugugccaagugacagaaccuuugaaagcccaaagacugcaacaaugcugguugaggaaugggcccagggacagaauauuaauaggaucucggaagauacagcagggaucaggucgcccagugugggcugcacccugcuuccccacagccuucuccacccucacccuccacauuuccuaccgcaguggcuuccuaaugucagcauguuucagagcugccugaaagccuugugauaaaacagguuacugggccacaucuccagaguuucugauucaauguguaugaggugaggcccacagauucccccuguuaaaugauguugcuggucugaagaccacauucugaaaaucagucaucuuuagaaaaguauguaaaaagcagcagcuagcccucaaaccauagcucagaauagggaagacaaacuagugucaaggaacuugaaaucaaggaagaugaagaucaacucacaccaguuaagaaaaacaacaauaacaaaaacauaaaacacccaucuuaauagugagcaggauaaaaauaaaaggcaugacuaccaugcaaacuuacuaccugaaugaggagaggguggggaauggcagaaagaaaauaacagaauguaaaagacagaugaagaacucagcuggaagaaaauguaacugaaauuaaacaacaguuuccucauaaguguuuuauaauauuaaggaaacuaaaaagaaucuucaauaacagcucaaaauugagaagauaaaacacaaacaagguuuugaaaaggaaauuccagaguuaaggaaguacucugaauauauuacauaccaauaaaaacuuaauuaauucauuagaaacagaaauagaaaaagucaaagcugaaaacuaaauuaccaugauggagaaacucaaaauaauuucacugaauaccugagaaaaaaggcaaggaacuuguucaagcaaacaaaguaagcauuaauuuggaagacagauagaguaagccaagaaaaucaucaucagugucccugaaacacuggaccguaaaaagaaaaauucucaguuuucacacaaaacauuuaucuaaagugaagaaagaacugaauccauggguggaaaugauacaguauccugagaaaaauuuaaugaucagcauugucauccuaauuaagcuauuacacaucaaggauaaaacuagagcuguucaaacaucuaagaagaaagcaagucaauuacaauagggaaaagaaaaucagccuggccucacacuuucuacagcaacagccaaucucggaaaaccauggagcaaugucuaaacuucagagaaaaagaaaaggugacccaagaauguccuaucagccaaguuguuauucagguauaaagguaauagguagauauucucaaaagugaaaaaucucagagaauauaaccuucaugaaaccuucuuggagagaaaaaaaauugcuugaugaugaaagguacccagcuaagagauaaauaaaaagaaacaauccuggcaucuagaaaccaugguaaaaagacuaccagagcuggauccaaauaaaaauacaaccaggacuaaacaaaugggagaaugacauuugcaaaacagaaugaggauguuaugagccugugcaauggacugaauacuuaugucuucuccaaauucauauguugaaauccuaacuuccaaggugacaguauuaggcaguggaagucaugagggcuccauucucaugacugggauuagugccuguauaaaaaagaccucagagagcuagcuaauagccccuugcacuaggugagaaaauagcaagaaaguaccaucuacucaugagaaagcaagccuuugccagacaccaaaucugccgguaccuugaucuuagacuucccagucucuauaacugcaagaaauauauuucuguuguuuaugagcuacccaguuuaugguauuuugcuacagcagcccaaacagacuaggacagccugucaggguaaaaauaauaugagcaacauaguuugaagguaguaagagagguagcuggaaagaaauuagaaaucaaucauguaaucucuccuagugaauaacaucuaaaauugguguaguuaaaaacucauaaaaacuccaacuuuugaauguuuuuauauuuuuucuuaaccuuuagaaaagucuuuaggaacaaauagcuuuaauggugaaaaaauacauagcugaagcucaacaauuccuuggauuucacuuucaguuucuuuuucuucuguuaaauucagguaaaauuaaauuuaacaucuuuauugauaaagcagauauauuaugaucucugaauuauucucauccuuacaauguuaauucuuacuaucuauccauuuuacuaucuuccuaucuguacauguguauuaagagauguuuagaacgaugcucuucaacuguucagaggguauuucucgguggugggauuuaggguauuguguugcuuucuucuguauaauuuuguauauugccuacauuuuuuaaugaugagcauaagucacuuguaaaaauauacaaucaccacucuaaaaaggaauacaugaaauauaacaccacuuuucugacacagugaguauaaauguaucucuuucaaugagcaacaucauaaagugccucucuggguaaggcaucauugugaauauccacccucauugcaaaguacacuagaagugaaugauacguaagaaugaguagaauguauccaaggcaauaacacuauaaggcucuguuucauuuuuguaaauagaucucuggcuuaggcuccuuuaauuagcaguaccuaacauuuccugagcauuugcuaugugcccggcugcaugccaccauacuuuauagguauuuuguuauuuaauucucacaguaacuauaagguaauaauaauaauggugacgaagagacuaagaacagcucagaguuguugagugucuacuauguacuaggcacugcuccaagugcuuuucaggcaauaacauucuucaguaggaaguacuuauagcaaugggaguacauugugcagcagaagagaaggcuaucaaggccagcuuuuaaaaauacaaggauuuacauuuaguacagugagagaaagugcacaggugagucuggccuuguguagagagaaaacauaaagagaaaaaacuggcagaaccacgcaauuaauuaaguacuuuugaccacaaaagugaggggaauccaggguagagcaggacuccgaccaagaagauauaaaggccuuggucagcuucugguugucguggaaaugggauuucaaccauuauaaugagaucaaaucauaugcuaacaaagaaaucaguaauuagaguuggggccacccacagagcucaccuccaucuugggauaagaucuaggaagagccagacaugcauuuuugccgcagauaaaaucccaaaaggaaagguuuuaaguaugaaaggguugggcugaaauaacauacucaagaauauugcuauucugaguguugcuucugcuuccagcucugaccaggucacugcagauaacaaauuaugucauuucuuauagcucuauuccacucaucagcuccccuucuaugcaggaaggagcaugaaaugggaaaaaaaccgagguucccacucuugguguccuaagugaucagccacaggaagaaaaagaucucugcucauuuucccucucacuuacuauugcccaggaaucuuggaucucuucagaauagugggcaaacugagagaaagcaaguucauuuaauccucaaaacaacccuauagauuccauucuguuaucaucauccccauuucacagauuucacaauggacagggaggagcagcauugaagggaucaguaaccugcccaagguccauuuuaacacaagagcuuucugacuucauucaggcuccccucucugugauugugauuucucucaugucuaaaccauucacauuuuuuaaaauuaggauuucuaugcuuaaguauguaccuuuguucacaacuaaguugaggauucuauacucaaacacacacacacagagagagagagagagagaugcaguugauuuuccccaauacuaauguccaugaacugaaagcuuaggcaauaacuuaguauagccacagcuuugguuugguucaguucuaggguacugcuuugcaaauuaaagguguaaucccuucaaaucacugcaauaaaagugauuugaaaucauacuauuugcagucauaauagaaacaaaugccuacuuaacuacucauggcucagcucuggugagaacacaucaauagaguaaaaugcuuuuagcuuuccagagaaagguuccaccugacagauaccaagagaucaaauauucacuccgcuuaggacaaagaaguguacggauuaggacauacuugagaagucaguuucagaaggcaccaguuuagaaaagaacccugaaagaccucuaccauuuauuuauauuucaauguauucauuccauuucuuccuaugucuuuucauucauuuguuuaucuccuuggucugugugcugcaggcuaaaacuacagcaauuaaacacaagguccuugcauccaggaguucuucucaauccaguaauggaaacaacuaacaucauauacuauuuugcuuuauuuucugcuagagguacggacaggaggugcugugggaacacagcuaauggggcaccugguucuugccuaugagaguuuugagaaggauaccugaaguaggguuuagaaacugaccaucacaggggaugggagaggaggaaagauaaaguuauaaggaauucucaaacuuugaacaugugaauguccuauauguaucuguaaauaguauauaaaaacacuauaguaucugacugcucugucacagaugaaaaccuucaaagagaagcugaucauagacacaauuauagaaaccaggggauguuaucucgcccaagucugccugacuacuuuuaaggaugcuaaauuccuaaucucucaaggaugacauucuucuugccccagagugugcuagagccagagggaccaacucuuucucccuaacuuccuacccaacaaagaauccuccucuacaauauuccuaauggauguuuacuauagcaaacaucacuuguucaguuuugguuccucagucccuauucccucauuguaauagcauuuuuuuuuuuuuugagauggagucucguucugucacccaggcuggagugcagugacgcaaucuuagcucacugcaaccucugccucccggauucaagugauucucaugccucagccucccaaguagcugggacuacagaugcccacugccaugcccagguaauuuuuuguguuuuaguagagaugggguuucaccauguuacccaggcuggucucaaacuccugaguucaggcaaucugcccgccucagccucccaaagugcugggauuacaggcgugagucaccgagcccagccugugauagcaucuugauucacuuuuagggacuuuucuccuauuauaagccaccauuaggauagugaauugggugccuuuucauuccacuccagaauuugagguccuggagacuucugguauauuuucugcuguaauggaaaaaggaugagcauguguccuaagcucaguuaauuggaccuucucuuccagggcucugaauccuaagaagagugacaugccacucacucacucauugcuguaauggcuucuuaauagccaaguagacuccaucuugauacuuuccuguuucuaagccuagucccuccugcccgcaucuugauucuguuaacuccccgauauccuucuauuuguaacaaauuccuuuucuacuuauauuaaccucagucucuguuaccugcuuccacuggaacucugauucugcuugaauccuuccauuaaugggaauauuacuacauugagaggcugcucauuccauugcuggaccucuauauuuguuucaaaaguuguuaauucaagcuaaagccggguucucuauuacuagugucugucaucaggaauuagaaagaauaaauuuuagucccucuuccauauggcagucacuauaguauccaaggaagggcaaauaaucauugauaaccacaccacuaaagcccuucucccagcugaaaaccaccaggguuuuuauaaaucuucuagaauaauauaaauuuucagacaccacagaaauagaagcuuugaauugccgaugagcagauuaaucauuuucagauggucucagggaacuaaacagucacuuccucggugggccucuuucgaagagggcacuuucauguuuauuacuugcaaggguuggcaaaugguagaauucuuuuuuaggaugauaaggauuuauauuucuaucuagucugccacuaauuaaaaguauauuaucuucccuacugaaguugggguaauuggugguuauuuucagagcaacucaucagggugagacagauucuuucugauugagguagcagagguguugaacauucauuguguacugaguucacguuucuaguaucacaauuucccacaccacaugcgugauagaugugucuucaacauuugcaaacaauuccaagucauuucucccuucaauuauucccucuucucugacauccuaacaagguuuucauuuuguacuaauuucacuaauuuaggaaaacuuuugucugcaauacauacauauacauauauacacacauauacauauauacacacauauaaacauauauguauauauauucauauucuugagaaguaggccagaaacuuggcuugcugugaaaaucagaggggaaauaaaaaggaugaauggagaauagugucuauucccuuuggcacuucuuaccuaauacucaagccccuuacuugcugaaacucaagucuucuccucccugcucccacuugccuuauaucuucucucaaugagugaggauuaagggcagguacuucucccauuccagagaagcagcagcuccaucuggagcacucugccucuuucugauggagcccucagggguguacacuguaauguccaucuucccucgucugcucacgcagaggacaagacucucacucucacccucuuucuuucccuaucuaauuuucucuccuuucucucucucuuuccucuucauuucuaguggccaccagcucugaagguaacaucccagccugaguaggccugagccaauuauucuagaccagaaucagcggggguaaacacaaacacucucauucucuagcuguuuccucaggugcuauggcuguucuggacuguucuccccuuccacugcucagaugauauaugacacucaauuacaguugaagagaaauggaucaacugcucuagauccaggccccugaagcuacuuuaauauguacauaaguguucaccagagguucaguccagcucucuggggugcuacaugggugcagaagguccaaagacccagcuaauaacgaaaguugacuuagcuuuuauuuagccuccuuuauuuuuuuucccaccaggaaaaaaaggaguugggucaaacaggaacugggcccaauaucauuacaacaauacugcaaggucccccuucaucccaaugccacaaucuagacuuuguuuuuaggaauauauuuuaggaauaauaaauacaaaagaaaaaauaaauccuaaauuaugaacaucguuauuugguuuugcaagucagucaaagucauguaaagagagagaccuagucauuaucaggaaauaacuaucuugaauuagucuguaacaauuucuucucauugaguauuuuuguguuucccuucucuucauaauagguaacaugauuuccuacuuaaaacgguggcagaguuucccuuaaaaacaaauuuauguuuuaaaagucaguugauucaaauaaauauuaaauauaugaaugcauaugcuggucacgcacaauuuggaaaaaaaaaaaaaaaguauauaaauguccuggagacuucugguagauuuucugcuguuccuacucugaauggacauggaucauuuucaugccacuuuggggauugaugcaugacuccuguugcuuccaaacugucucaaaagaaaauagcauuccaccugacagcugcaugaacucaagucuuucucauguaugggaggcauaaguauguccauccaacaaaucugccagcauugccuuuauucugguacugucuaaggcugccuauucccuucugcacagaguucagccuuuugcuuccuuuuuuauuuauuuuuuuuuugagacugagucuagcugugucgcccaggcuggagugcaguggcgccaucucagcucacugcaaucuccgccucucggguucaagugauucuccugccucagccuccugaguagcugggauuacaggugugugccaccacacccagcuaaauuuuuguauuuuuaguacagauggggucuaaccauguugguuagacuggucuugaacuccugaccuugugacucacccaccucggccucccacagugcuggaauuacaggcaugagccaccgcgcccagcccuuagccuuuugcuucuuauggaaaagcauucuucauuguuuuauucacuaggcuuaggcaaguaccacccuaacucucaaauagccuuuccaucugggcacccuucuucaugaugucuuuguuccuggaaugugccucaaaggucugauuucuuaggugccaagcagaguaaaacuucuaaucuuccuucuaucaauccggaguuccugcuaucucaacaauauacugcauacccaaagcacaugcauaaaauaaaguuuauuacaacaagacuuuguuuacagaagaaagauuagacugauugaauacauuguucuacacugauuuuaauuggugcuauaaucugaucugucucuaaccagcuaaucgguauuuaaucgguugcuuuaauuuuauuacaaggcagcuagaaugcagcuguagcuagagaccacacaguaaauaaacuacauuauuauuauauuuaugcauaugaguuuuauucugcuugugucaaaauuauacucacuuccacuccccuccuaauuuguuuguauuaaaccauugcugugcacuugcauagugggaagaguuaaaaaaugccuuuuuauugccaaggguaaguuaugugauaaguuuccagauguacccaccuucauuugccaaacaaucuugugauugauuuaaauauuuauacagugcuucaauuacugacauuguuucuauuaauuaaugauauuaggguuuaauucuacagaauacagaaauagaaacagaacaaauucaugcacaaaaaagcaucugauaugaucacccugaauguaguuucaugcuagaguuucuacgcaauuccccagagaaugaagcauaccagcauuaauaaaacucuaaguguuuuaggggcuuugaacaugggugcgauagguuccaaagcccuauguaaguauuugaacaacuugaccuuauuucagcuucuugagagaacuauuagggacagucacagaaucaacaugaaaaauuauuaaguacccacauacugccugccugaaaggacucagacaacuacagcaaacuucgaaaaaauauuaauaauaucaaaacaccuugcggcugcucuuuuagaucgcugcacauuuuuaagauguaauuuacuggaagcucucuuuugcucuuuccugucauuucaguuaugcaagaacacaaugcucucacccuacgccagucuggagagcuuugcuuuucucuugggaggaggcauggugcaaugaugagaagaagggcuuagcagcaggccgacccuggcuccagucccagcuuuuacauacucccugaaugacaucaggccauguacucuuaagccuaaauuuccucaucuguaaaauaggagucaucacagcuacucugauauuagugugaggauuaaaugagacaacaccauaaggcucuagccaagggguccagcuguuccuuuggcuacugugaucucaggcucauuuagcccaguaauuguggcucaucucauaguugucuucucauccugcugagauucauuuauuuaacaaauguuuauuggguacugaugggggugccaagcaugggcuagaaaccuggaacacaacacugaagguccaguuugcaacacaaaguccaguugguccaaugaaaaagaggauuagauuugccuuuuaacaaaacauuccuagguagauguuuaugguaaagcuaacaucgagccaaguaucacagaaauauauggcaggacauuaaugccuaguguuccauuauaggaacgcuaagcaugugggaguuauuuauaaccuacagcucaaggucaucaccaaggucugauuuuucacucaugcaaaaauucaaaaaacugaaaccucuggcauaaacggguuaaggaagggaaggccccuuaguccaagccuuuccuuauaaagguauggaaagaaaccauuguuccucaucagcaugagagcaauacguguuguuuacauaguauuuugccaucugugaugauuuuuauguaguguaggacaaggacuuucuaacgcucggcucuauacuagaccagguccaaaaaucuaccugaguaucacuaccucugucacugaacuacuguaacccaauaacaggauaagauggcuaacaaaagaugcccucguaggaggaacuauccaguaguuugauuucauacuuguccuaaaccuuuaaacuuguucuacccacaugucacagauauggagguuagugaaaacuaccuguguguguacagagcagcugggaggacauuuuggcucuguucuaggcagucauguagggcccccuuacuuugcuccugcagaggguccugauacugucacuguucugcucagcuucaaaacucucagcaggaugucccauuccucaccuagcccucaccugcucuaccuaaugaugcucaaucacugaacuggcccagaaauaauaccugccuauccugacuucuuacccaaaccuggggcuaccucccugacuggcauccuaggggggcucuccauggccuuuagugaaguggucaaagagaagggucaacucuuuauacaaaagaaaaaugagucaugagcuaacugugaaacucucaauaagucacauauucucugaucuccauuucccaaaucacacaaauugagagccaucuaaauugccucccaacucugagacucuauggauauacauauaugaaucaucauagcaaauauauaucuauuauagaagcuaaaggaaucuucucacuuucuccaauuaguaccaacuagauuacuccacaaaagauacuugaccuuguuaaaacaaaaagcaaaacaaaaauacucuuuuacacuauuaucaggaaaucuaugccuggcuuuagcagcagaguauaaauauuugguuauuggauacuuuucaauuuaggggaaaagguauaucuauugcuuaaaaacauuugugcccuucuuauagccaggucacccauuccaagucugaagaaaauaaauugaaguggugguaaaaguuaguuaaauuucagaauuuuuaaaagaagggauaucauucaucucuggcuagauaacucuguaaaagaucuaucuguaagaacagaaaaugcucuuauaagaacuuugagacuagauaaacaaaugcaugccacacagaccaccacucccaucuccucaggcuguggcagacauuauuaaucaauaacagaauccuucccacuaugucuauacacagccuucaaauggcucucaaugcaguaucucagguaacugccagcaacgaaucauauuuggcaugaaugauaaaagguauuuggaaucccuggcuuuaugacuuugacuguuacccugacugccauuuagaggauuaacagccaagaaugucacagugucauuauuuaaauaaaauagaaagggaucuugccugcaggaacaugccucugaauauuaguaggggauuucaagcuugaaacucuccagaaguuucuuuuucaucacucuaaugcuugacuuuuucuuccucugcccccuccuuccuuaugaacucucaaggauacuuacaggucagaagggucuucagguugaguucuggccaaaauuuguggcauuuccaagucucacuucacugaaugaguacaacccugagaccugucugggaacauggagugaaacagaaacuaagagagccaccacugcugaggcagggagggauggccuggugauacacaggaaagguaaguguggcagugcagugagagaugggcuggggaguaagguagacaaaaggaucuaaagaguggaguccaaaagcacaaugauacaaagugagugaagcucaggguuuagcaaguuaacaugaaaacccuagcuccugaaugaagaguaccuuuugcauggagccuggauuaucuuuucugcuuauaucuuucuuuucuccucccuccagcccuucccuccuuccuauaugcuccauuuucaacucccuuuauauuccuucaucuuucucucccuacuuccuuuucuuuaacuuccauuucuuucuuuuucagucauuccuacauuucccuuuuucucucauucuccuuugucuaagcuuuagacaacccugcucacuagcuccuuggccuuuaagagcuuauaagggcuaaggggcuacuaguagcuucuccccaugcaacauaucacacaggugucuuggagggacaaaguggggcuugagacuccuggaugcuacacagcagagguaagggcucagguacccaagagaagaaaucaaugaaguaggaagcagaggugaaaagaguauaucagcucaacaggaucaacaaaguccaggaacacugucaaaauaagcuuggcagaaaaucaacagagcagagaacagcaugaaacaugaagugauacagguuguggguggguggagaaagagaaauacaaggcaagcaaaguggcagcauuaauaagcagccaugacuggacacagaccugaagauggauauuaggaaguaggugcccacugagaaugagaguaaaaaccaaagugaugaacuaugccuuuguaacaccugacacaaaagaaaagagguaugccaguuaaauggcagcaccauguacagaaaugaguagauauuucuugguuuugcuuaauaucgcucuggaagcacagaauucauguucuaagacuuaagaauaaccuaaaccagcccagugugguggcucacaccuacaaucccagcacuuuggagguggauggaugaccugaggucaggaguuugagaccagccuggccaacauggcaaaacuccaucucuaauaaaaauacacaaauuaucugggcaugguggcagaugccucuaaucccaacuacucagaagccuaagucaggagaauugcuugaacccgggaggcagagguugcagugagacgagaucgaucacgucauugcacuccagccuggacaagaacaaaacaccucaaaaaaaauuaauaaauaaauaaauaaccuaagucuauuugggugccaaaaaauguguauucuauuuggacauuacaguggauugacagcauagaaauuauuuauuaaacccauccuacuggaccugaaggugaaccccaucguaacagggugccugguagagucauucuuaacuagccaucgauuuguaaaaaauugcaaaaguuguuuuuuuuuuguuuuuuuuuuguuuuuuuuuuguuuuuugagauggagcccugcucugucgccagacuggagugcaguggcaugaucucggcucacuacaaccuccgccucccagguucaagcaauucuccugccucagucucccggguagcugggacuacaggcgcccacaaccacgcccggcuaauuuuuguacuauuaguagagacaggguuucaccauguuggccagaauggucuugaucucuugaccucgugaucugccugccuuggccucccaaagugcugggauuacaguaaaaauuucuuauaucaaaugaccguucuugaauuguuaccuuggauuaacagggagcaacuauuggcauuuccauacagcaaucuacuaucuggggauaaucuagcuuuccuggagggauggaaacaaagugcauaaugguuguuuaccaaucauauaauaucagacaccaauaauuugucauucacucuaguguucuacaaucauuagaggagcuauucaacugcucucagacauaccagcuaugaucauguaggaaacgugauuccgugggcugaauguaccaacucuucacuaacaucucaauacucuagacugaaguuaaugaccagugcaaaccaccagaguauuacaguaaaagaacagcaguaaaaaggccuuaauaaaucagaaauuuaaauuggcuauucauuuuaguuacagccauucgucagagcaaagugaugguccaauucaccuaugcgguaacuuacauugaucauaacaguacuuuaaguaauaucauccauuaauuuauuaagcaaauauuugaguaauaccuacuauguguacaacccucugccagaugcugcaagauauauucagacauaaaagaaacaaucuuaaccuuuaagaaacuuguaauccaguaggagaaaaagacauuuuguagaagucuuauucaaauaaaauaugauuccauaagauaaggcuccaucuaagcucucugcauugcaaagcugauggcaagaacuacauuucccagaauacucuucccuggaugguucgagugaaguuuaccaauaagaauagagugagauguggaagaaaaagagauaaagaaacuguucuuuggaagucagacaaaugugcacaaaugaagucuuccucauugcuguacauugagagaugucccugcuuuccuuaucgaaacucugaucugucuaugaguuauuaacacccuugucaguaauaucacuugucauuaggucacaauucuugggacuaccauugucuagguucuucuauuccacaugcuuuguuucugugcauguugaguccaacauguguguauauuuuagguagugucaccuguuuggauauccacaagaccuauuuacacaacaccuguuacaaaaacucaccccagauguuuucuuguuuguucaguuuaauuuauuauacaaaucuucacauuugaaaauauaagcaaaagugauucuaagccacuacaggaaauucacaaaagcaacaccuggugucaacauauuucaucacauuuuaaugauuaugaugugcacaggugugcugaaaguuucuccuccauacucuuugauucuuuuuuaaaauuuuuuuaauuauacaaguaauacacuucuagaacuaauaagcaaucauagcaagcuugugggacaaaaguuaauauacaaagucaauugucuucuuauugcuagcaaugaacaauugggacuugaaauuaaaaacacaauaccauuuacauuaaugccaaaaauuuaaauacuuagguauaaaucaaacgugaaagaucuauauaaggaaaacuauaaaacuuugcugaaagaaauacaaaagaucuaagaaaaaggaaagcuauccacauacgcagacaggaaaucucaauauugucaagauaucaguucuucucaacuugaccuauacauucaaugcaaccucaguuuuaaaaaucccaagccaaaguaaaagccaucuacggcacacagcauuccgaaagguuugggcuaccugacuauuauggcaccaagaaaucucugguauaugagaacuuucacuuuaauucaaaauguuggaugaccugauuuucagcagaaaugcucuucaaaucaguuucacuuaggcuuuuuggugugaagugaaacgaugcagacaaugagcuuuggagaaugaggaaccacugaauaacuuacuauggaaguggauacugacauggcaaagaaacgacagccuggaguuuuuaacagaauguucccaaugagcaggaccugaagauguuucuucguuccaaaggagcuagcaaagaagugauuguuagcaucauaucaaaauaacuaaaagcuauaacacacacucuugaacgucuuucaaaacaaugggaucuaugaaggauuaugauaucagaucuugauacuguaaauauuuugggccauucuccugaaugcuuucuuuugucccaugaaaaccuaaacuuagggauucuaugaguuccucuacucagcuggauuuaccuguaaaugccuuuguugauuguugaccaaugucccuuguaccuuuuccaauagucucgaucugaauaaacagaugguuaaaguuuugcaggaaguauauuuuucauugggucacaaugaucccacagauuuuguaagaaagaugauuuuuuaaaacccuuucaucuuaauucaggguaccaagcagguaaaaacuaacauugaauuuuuacaggcaaguuucaauuugaacaguagggaauugcuauuuuaauaugugguccaggaaccaaaauccuagaccuuuccaaugacuaugccaaaacaaacuacacaaauaucaaacagaagcuguuuucucucugagguacugaagaagagguacaaaagcuugccuuaaguuauccagauguggggaaaaaaaguuauccagaugugaucuuuuggcagagaaaaaguuuagugagaagaauauuuuagcuuggugcaaaaguaacuaugguuuuugggcaaaaaccauaguuacuuuugcaccaaucuaauggauugucucauagaauaauaaauuagccuucugugaaaguaauuugugauaacugaaaaauccuuggguucuggauucaagcauaaguacuuuauaaagucaaaucaaagaauuaguaaaugcuggcuguaacuugaggacaucaagcaucacucuucuacucuggaguuaaaaaaaaaagauacaaaguaaauuuaaaaaguuaagcagaacacuggggaauuuuugaaagccagucauauaauguagugguaucuuuucauuuugaauuugggccuuucaaaaaggagggguaugauuucuuaaccacagauauauauauguaauaauucuuuggcuauuuuguuuuacagguuuauggaaacucaugguugauaugcucaggugcaguccuccuagcuaccuauuuuccaguuugaauuacuccaacauaccauuauuugauacaggcugugcugcuguagagaugguagugccauggugauuugcuacacagaucaucccaucaccuagguauuaagcccagcauccauuaguuacucuuccuuaugcucucccucccagcagcaccccuccaacaggccccaguguguguuguucccuccauguguugacgugugcucauuauucagcucccuguuguaagugagaacauguggugcuugguuuuccguuccugcguuaauuugcugagggcaaaaccugauuacuuugaaaacaaguucuacuguggcaggcagaaucauggccacaccuaaagaugucaacguuuuaauuugaagaagcugcgaauauguuaugcaaaaagauuuugcaaaugugauuaaguugaaauuugauuaaguuaagggccuugagaugaccuugaaucaucugaguggaccuaauauaaugcuaaggguccuuaaaaguggaagaaggaggcaaaagaggucagaaugaugcuguauaagacagacuugaccacuuugaaggaggugaaaaggaggcuuugaagaaggaagggaccauaagccaaagaaugcagggggccacaaagaaaacugaaaagccaaugaaacagaaucuccccuaaaggccccaaaaaggaaugcaguacggcugguaccuuuucagcccagugggcccaguaucauacuucuguccuacagaaccacaggaugauaaauuuguguuguuugaagccacugagucugauaauuuguuacagcagcaaagauuaacauagcaacuaaguagaugauuuguugcauuauagguggucacaaaauacaauccuuuaguaucauguauuuuuuccucuuacaagaguaauuacauuuaaaaaagcuaucuacuguucuagaaucacugucguuguuuacaauaaaguccuuuaaaugugcgcauaaaaaacuaaaugugaauaaaauguaaauaaaggaauauuuuugccuaauaaauacaaagaaaaugaaaaucccagcaaccuauuuuuuguggauauuaacaaacugauucuaaaguguacauggaaaagcaaaagauucagaauaugcaagacaauauuaaaugagaagaacaaaguaggagcacugacacuauccgacuucaagaguuagaacaaagcuauaguaauugaaacagugugguauuggcaaaagccaccaaauacaucagugaaacagaagagaaagcccacauagucuuuuccacaaauggaucuagaacaaauggauacccacaugcaaaaaaaaaaaaaaaaaaaaaaaaaaagaaucuagacaaagaccucacacuauucacaaaaauugacucaaaaugaaucacagaccuaaauguaaaauguaaaaccauagaacuccuagaaaauaauguacaagaaaguucagcugaucuugagcaugaaagugacuuuuuauauauaauaccaaaggugcaauccaugaaagaaaucauugauaagcuagacuucauuaaaauugaaaacgucuccuugauauaagacacugucaacugagaaagacaagccaaaggcuaggagaaaauauuugcaagaaacauguaugauaaagaacuguuauccaaaauauuuuuuuuaaagucuuaaaacucauuaagaaaaauaauuuaaaaaugggcaaaagacuugaacagacaccucaccaaaaaauacauacagauggaauacaggcauaugaaaagaagcucaacauauauuauuaggauauugcaaauuaaaacaaugauaccacuauguaccuauuagaauugugaaaauucaaaacaaugacaacaccaagugcuagugaggauguggggcaacagaacucacauucacuguggaugggaaugcaaaaugauauagcaaccucagaagacccgcaauauuuuacaaaaugaaacguacucuuaccauacaauccagcaauuauaauccuugguauuuacccaaaguaguugaaaacuuauuucuacacaaaaaccugcacacagauguuuauaguaacuuuauucaaaauugccaaaaccuggaaguaauugagaugaccuucaguaagugaaugaauaaacaaaucaugguauacgcagaccauuauucagccauacuaaaaagaaaugagcuguugagccacagaaagacauggaguuacuuuacaggcauacugcgaagcaaaaggagccaaauuuuaagggcugcauacugugugauuccagugaugggauacauuggaaaaaaaaaaaaaacuaugaagagaauacaaagaucaaugguuugcaagggcucagaggagggggagggaaagagggauggcuagauagaacauaggagauuuuuuagggcaguaaaacuauucugaaugauauaacagugguugcaugucauucaacagcugucaaaacccauaggauguacaaugcagacugaaccauaacauaaccuacagacuugguuaauaauaguguaucaaaauuggcucaucaaauguaaaaaauauaccacacuaaugcaaguguuaauuauaaaggaaacugggggagugguggggcguaggcaaacucugcacucguugcucaauuuuucuguaaaccuaaaauuguuaaaaaagaaauaguguauugauuucuuaaaaccaaauaauauauaaauagccuuauaaaaaaugucaaaccacucagaaguauccagacuaaaacauuuaacucccaagugauguuuucacaccaauccuuucauuccuggggcaaaugcuccucacaguuugguauuuaugcuuccagucuacuuuugauuuuuuuuuuuuuuuuuuuuuugagauggagucucacauggucaccuaggcuggagugcaguggcacuaucuggacacaccacaaccuccaccuccuggauucaagcaauucuccuaccucagccucccaaguaccugugauuacaggugcccacgacuacgccuagcuacuuuuuuguauuuuuaguagagacaggguuuacauuacaauggccaggcuggucucgaacuccugaccucaugaucugcccgccucagccucccaaagugcugggauuacagccacuagcuaccgugcccagccccagucuaauuuuuaauaugcuuacuauuacacuuauuuccaaaaaguguucaaacauaaauggaacauuuuauaaauaucauucugaaauuuggacaguuccuuaaagcaacuacuagugacugcacugagcauuaugugaaaaaaaaaagacuccagaaaauacaugugcaagguggucacuauacaaacacacuuuuggcuuuccagagcauuguacagcaauagucacauaguaugggcucuagaaauacuugagugguuggcaauuaagucaagaugaaaaggaaucaggccauuaaaauauagcuacaacugggaggcugaggagggaagaucgcuggagcacaggagauuaaggguacagggagcuaugaucaugccacuggacuccagccugggugacagagugagacacucuccaaaaaaaaaaaaaaauacaauuacauggucugacaguuaaauucuagagagaaucaaccuuucauccacacagcuaguaugccaaugagguguccacuguguagggagaauuaacccucugcauuuuucuuaaggauuugagcucucuuagcuacacaaacauaggaauuguuauccccaucuuagaggcaagaaagcugggagucagggagcuuaaauaacuugcuugagaugacucaaugauuggugauggagucaagauugaaaacccgggcaagccuccaugucucacggugccccuaaaaguacuuucuacagguaacaagcacccaaguggucuuuuccucaucagucccaaauuggccgaaaagaucaucugugaccaacuggaacaggauuauauccauaucucaauuaaaaccauguuuccauuugccccuuccuuaaagcaaaucacaguucuuuauguggauuuuuugaaacguacaaaucuagauuuuuuuuuuuaacacauucuggugcucaguugcuuaggaaacugcuuuugucauuaggugggaaggacuaacacacuuaagagagagaaaggcaaagggggaauauauaguaaacccagugcugaugugaauuguauccacagggacuauaacaaaacaaucagaacucaaagggaaaaggagcuuuugaguggguugugaaauaagcuauuaagucaugcaaauaaauccaaugucaacacuucagccugggcugauuggaugcaugcauuaaaacucauacuucauaagaauuuaaggccucugguguucucaguuuuucuucuuuuucacuuugggguuuuuugguuggagggaggcauuucuagagaaagcaugccugcuuuacgcuagaaucgcucaugaaguagagaauuugugcaucaagguuugaaacaauacauuauuccaagaccuuguccuucaucaguaguuucagccuuugccacauuucugagcuccgugcucaaaagaagcaucucuucucccaggcuccugcacccaaccaggcagggauccaacauucagauaauucagacgguacacacauucaugacuucaagaugcugcuguugacagucguacaccuuaacuugcagugggugcaaacauaaucagccuuuucucccacgaagcccaucuuuagaagcacugugagauuuuugccugucuuguucaagaccauaccuacagugccuagugcgggaccuggcacacauaguagauacguaacaaguaaucacuagucuguuacaugagcaagaaauaacuuuuuuaaugcaauugcguggcugaucuauuugucaccaaaguguaaccuccccuguccaauaugccaucacuuuauuuuccacugcaagcacaagaucuugcagcucaagaaagaacugugcuacauggcaugcucuaaauucgacaugccaucucaauuuaacaugauacuuauguaagccaauagucccacuuuacagaugagauauuggagcuuuauagaaaucaaguaaucuagccacagucccagagcuaauaaaugauaggacaaggauuuauaucccaucauuuuagcuguaaaacauguucauuuuuuucuuuuuaaaucugugcugggcuguguucugaccucaagugaaauacuguguguuuguaucacucaacucgcacauaccaaaguuuaagucaagagccuuuaugacuuauaaaaaacaauugcuugagaggcacugggugauacauaggcucaguuaaagcagaaggaacagcacuagcaugucauauugguaagauacaaauuaaauugcaguuagaaauggacugucaugguaguaaaacuaugggaagagcaaggaaguccucguuucggcgugucuucaggaacacaccgguuaaccaucuauuugcccaacccgauuuggucuuuaaacuugccugaagaagccaguuggagggaacagaaggcuucucucaaggucaaugucucccuccauaccccccacuucaggaucuccuaugcaucaggcacugugcuauacaacgaguaaaacauaguguuugcuuuugaaaaauucuacaauacaugaacagauaauuauggcagaacaugcuaaguacaauguuauaguaauacagagaaaaacagaaaaacugacucagagcacauucaaaagggcuguuuaauccaugccuaaguggaguaaggaggccaaaaguuaaugaggagagcaucccagagagaagaaaugguagagccaguggugugaaggcaaaagccaguaggacguaugcagagaaguccaugcaguucaguggugccagaaugcaaaaugagaagcaaggagugguaagagacagcaggaaagcuuagcuuacuuuuuaagucagccaugcugagcagcuugggcuucaacuugacaaugaugaacacauauuuggcaagauuuggcagaggacagguuggauaugaaguuuagaaaaaucccuacagcugguguggauuugaauggaauuggacagaagaccagcccaaguuaggaagcugauggagagucccagcaaaauacaggaaucugagcaaguuuuauaguuuuauaaauauaggaacaugaaugagaauaggaaugaagagagaggacugcuuugacaaugauuccaaaaguaaaauauucaagaagggugggaauggagucuaccaagaagaaaaacuggauaaaggcagaauaaaaacuuggaauaaauaauauuacugaaauuacuuagcaauguuaauaauguuaaaugugucugugguaggccugacccucuggcuguccauuauuccauauguggucuuuucugacuggcuucuuucacuuacuguaauguuuauaagguucauccauguuguaacauguaucaguacuucauuccuuuuuuuuacaagaugauauugaauugacaggauaugccauguuuguccauucagaaauugauaagauauuuggcuuguuucuaguuuuuuuuuuuguuuguuuguuuguuuguuuuugagacagucuugcccuguugcucaggcuggaguacaauggcacaaucucagcucacugcaaucuccgccucucaggcucaagcaauccucccacuucagccucccaaguaucugggacuacaggcacaugccaccaugccuggcaaauuuuuguauuuuuuguagaggugagguuucaccauguugcccagacuggucuugaacuucugagcucaagugauccacucgccucagccucccaaaauguugggauuacaggcaugaacgaccacgccuggccuuguuucuaguuuuuagcaaauuuaauguugcuaugaacauucacguacaagcuuuugaguggacauauguuuucauuucucuuggguauauaucuacagguggaauugcugaaucauauggcaauucguuuuucaaccuuuuggggaaaugauagacuguuuuccaaaguggcuauaccauguuacauucucaccagcaauguauguucaaguuccucuaugucuucuuuucaauuauagccauccuaugaggugaugugguaucucacuaugguuuugauuuguauuuucuugaugacuagugaugcugaguaucuuuuuaugggcuuauuggucaucuguauaucuucuuuggauaaauaucuauucagaccuuuuauccauuuuuuaaauuggguuuauacaaauauuuauauauucuagauacaagucucuuaucagauauaugauauguaaguauuuuaucccauucuguggaguuucuuuucagcuucuggauguuauccauggaaacacaaaaguuuuuaaugcuugugucuuuuuccauuuguugcuuguguugucuuuuuccauauguuguuaagacaucauaucuaaaauauuuugccuaauccaaggccauuuguuaugcuuauguuuccuucuaagaguuuuauaguuuuagcuuuuacauuugaggccaagauucauuuugagauaaucuuuguauauggggucagguaaggauccaaauucauucuuuugcauguggagaccuaguugccccagaaucauuuguuuaaaagguuuuuaccaugaauugucuuggcagcacuuuugaaaaucaguugauaguaaaugugaguuuauuucuggaaucucaguucuaugccauugaucuuuauuguuaugucagcacuacacucucuugaucacuguagaguugucaugaguuccgaaaccaggaaauccuccaaguucgcacuuuuuuucaagacuguuucagcuauucucaggaucccuugaauuucuguaugauuuuaggauuauccugucaaguuuuacaacaauaucugcugagauuuugauaggaguugcauugaaucuuuauggcacucaacaauuuuuggcacuuuuaacaauaacucuuccaauccccaaacauaaaaagucuugccuuguauuuagauauucuucaacuuauuucaaauauacauaaauucagaguuuauauuuuuuguugcuuuuaauuuauucccaaguauuuauucuuuuugaugcccucauaaauggaauuuucucaguuucauuuucugauugucuaucacaagugaauagagagaaugaguuuguguauauuguucuuguauccuaaaaacuugcucaacuuguuuauuucugauagguuuuuuaguggauuuaagaucuucuauauauaagauuaugccauuuauaauaaaguuuuucuucuuuucaaauaugaaugcaguuucuuuuucuugccuaauuucccugguuagaacuguuagacaauguugaauggaaauggcaagaggggauaucugugccuucuuccuuaucuuaggggaaaacacucuuuuuuuuuuuuuuuuuuacguuaaguaugauaugagcugugaauuuuuaauaaugcuuuuuaucagguugagaaaguuucauacuauucuauuuccuugaguguuuuuaucaugaaaggguguuaaauguuuuucaaauauuuuuucuaugucuauugauauaaucauguugcuuuuauccuuuauucuauugauaugcuauauuacauuuauuaguuuucauauguuaaaaugaucuugcauuucugggauaaauuccacauggccaugguacaaaauauguugcuggauccaguuugcuugucuuccacugaggauuuuuacaucuguauugauaagauauuggucuguaguuuccuugcauugugaugucugucuguuuugguuaacaggaugcuauuggccucauagaauguagugauaauuuuuggaagaguuucugaaaaacugauauuaauuuuuuaaauguuugguagaauuggccagugaagucaucugaacuuggacuuuuauuuguggguaguuuuuuauuauaaaaaauauauauucagucuuuuuacuuuugauggguuauucaggcuuuauauuuguagaaucaguuuuguuuguaucuguuuaggaauuuguucauuucauccaaguuauccaauucauagucauacauuuauucauuguuuucccuuguaauccuuuuucuuucugcaaggugaguaguaagguccccuuuuuuaauuuuugagauggagucucgcucugccacccaggcuggagugcagugacaggcuggagugcaguggcgggaucuaggcucacugaaaccucugccucccagguucaagcaauucuucugccucagcuucccgaguagcugggacuacaggcaugugccaccacacccggcuaauuuucguauuuuuaguagagacggggugucaccauauuggccaggcuagucacauacuccugaccacgugauccgcccaccucagccucccaaagggcuggaauuauaggcgugagccacugcgccuggccaggucccacuuuuuauuccugauuuuaauaauuugagucuucuuucuuuccugcuuagucagucuagguaaaguuuucucugguuuguucaucuuuugaaccaacucugguuacauugauucuauuuuucuauucucuauuucauuaauuucuguuccaaccuuuauuauuuucuucugcuuugugugguuuacucauuuuauaguuuauuaaggugaaacauagguuacugauuugagauuuuuuaaaaauacagguacuuaagcuauauguuucccucaaagcccuguuuuaguugcauucuaucagcuguuauguuacaucuucauuuucaucaaugacauaaaauuguuucucauuuucauugugauuuuuuaaauugacucauuggauauuuaggaguguguuguuuaaguucuguguauuugcaaguuuccaaaaauauguuagauuucuaauuucaccuuauuguagcuagagaauauacuuuauaugauuucaaucauuugaauauauugaggcuuuuauggcuuagcaugugguauauuuggaaaauguuccauguacacuugagaacaaugaauauugaagguuuuaucucuuucucugauauuucuguugucugccucaauuggccucacacccagcuguuaugcuucacuaauuacuggauaaucauucuauuguuuugaaaaauacccuagaggcauaaauuucuccacagucugacccaauuaaauucaagggccuuugggaguuagaucuucaggccaauuuuucguuacuccaggagggcucucuuaccuuuaccuuucuuugauucucucugaucaucuagguaaucgauggguuagcuuguagauuuuauagagcuaccagccuccuuuuaauggcuuaucaccacaaugucuauugcuuuggacaaugaccuuaguuaggcuugacauuccccccacuguuucaaaugaaaucaauuccuaugagcuucagaguucuuauggacugcuucuaccccuagcaaaaucugagccuggagcuccagagcuggcaggcagaguaacaccuauacuuucugaguaggggacuuguuggggguggcagccucuggcuuucuuagcuugccucucucagcuugccucucucagcauagaaucugccuaugaguaagcugaggcaagggggacuggggccucaauauucucagccucccauacccgggguagaacauccaccuaauuaguuggggguagguggaagaagguaauuccuaaacuuuccgccacucucaccaagaacuuagccucugcaguuuagggcagagggaaugagaaauucuagugaccuguuccucagugagauaccauaucccuugacuggaagcugaggggaaaggcagcaccaucucuuuggccacaucugcccagaguggaggcuccaucucacagagcuacaugaaagggauagauagcaggcugugucugacaugcuacagacucucauguucuuagggagauucuucagauuugcucacauaagugcuuuugauuugucauauuccauuacaauaauuuccagagacuuuaaaugaguuucuuuauauuuuucaucaguuauggauguuuucugggaaaugguccauggaacaccuuauucugccauucuggaaauaaaacuccaagaaacuucucuuuaagccucugagacuuagagguugcuuauuacugcaggaaagccuaguuuagcaugaugaaagccgugucuaguauuaaagcagaauuaaagucaacucaaggaaaguaaaaugauuuuccaacucuaucuuucucugauagguucuugucccuuaaagcugaguagccgucacuggccagauucuagaauaaugcccuuccuguuuuucuuuuguucuguuguccccacuugauugcuuuaauguaucuagguagacugccucuauuaagaagucccaaguuaauguaggcuacuugcagucuuugaaacacagugcccauuuaaagaugacaauccuagaaucauaagagcagggauacaaacuauuuuauucacucuaguauucucagagccuaaaacagugucuggcuagccugacacuugauagcugcucccaaaagguauuuuuugaaugacagugucaggaccuugcuccuguuccuuuguuacacuggcugcccuggggaucaaagcguaugggagggcuauuugucuuauguuaucuuucugaaaguauccucccagagacugguucaaacaggaacccuaccugacuccuauguccuaaaggacucuaucaauaaaguauuccaagauucuucuagccaggaggucuggcuucauuuucgaaguuaucucagaaaccuaaaguguguacucugguaucauuaacugaugugacacaacuagugugauuccaucaguuuuauaaaugacaaccagugugaggaagucgacaccaaaagaagacacuacuggacagaaggcaaaugauuuugaauaaucagccucuacccuauucccccagggagacuaaaaugccuaagcaaugcucucguugaucacaaaggauacauguuuguccucuuguuuagaguugcaagaacccacucuuuccaaagcaaucaaaauccuauauuaaggggaccaugucuagaagcucuggaaaauuccuggaauaguaacacaaaaaaggagucacuguaccaccaccacaagccucucugggaacuaauuguguucuagaugcaagagacacuuaacccagcauuugucuuagcagugucugccuacuaugugagccuuacgccaucccugagacucugccaggccccugcccauccacucaacacuuacaguugaacuuugccaggaaaucuagcucaucuaguucuccagcuuucuaauccuuccucucacccaagacugacccacuccuuguccuaucuugacgucccucugguuuauacagaguaauuaaaucacugguuaauugaugaauucaauuaaaucaaugucuuaccugagucccuguuaggauucuuuaaccuuuuuuggaaaauagccacaugucaaauuuacucacuucuucccaggucauuaaaaaaaaaaaaaaaaaaaaaacacacagaaauaacugaguaaaaaacacucucaaucuuugcccucuugguaucagcuuugagacaccuggccaaguacagccugugcuaaguuucaaagaggaggcagauaacuuugaagauuuuauuucacaggggacaacagauaaaagucucugucaaguugucauuagaugcuuaaugcuauucuugguggggagcuugaggcgccccuccuccucuguagacuucuagcagauuagguuucagagcuuuaauuugaggaaggauuuacagcugugaagagguauaauaucauuuugauuuggguuguacuaggcuggggaagccagauuacauuuguaugaaacuguauuagaccauaugacugaaaccaccaaaaucaaauaaagggaaaauuuuccagagagccuaaaaacaagagccugucuuuccagcaccugagcauuguuucacuaacuauuauucugauuuacaucuaggggauccaugcagaaaugcggagggagauggcaacaaugccugugcuugcuggaccuauccauucauuaaucugucaucaaccuaauccaggggcccauccccuagaacaagaggaaaaaaauuaacacuuagagaagaggggaaguuggcagggggaggggagauaacuuuaugaaaaauagccuucuuucaucuccggaggcacugucuaauucagagucucaaagaaauccaucaaauugucucucugggccucaguccauccaccgccaccauaugcuaccaugugcgugugucgcacggcauccccagauaaugacuuacgugggcaccgugccuuuccucuagaaccaucuuaaugcuauuuuaaaauccgacucucauuugcauggaaaacaauaaaucacuuuggguaacacagaaaacccaguuucuucugagaugaaacaugaaaaaaagaguuagcuguuguuuguaccacacagcuacacagaacugggcagacuaccagcaucuucuacugggauuuagagauggacgcaagaaacaccacggguaggacucugaaaauugaaauuauuuuugugccagucucuagauucaacuagaaugugcucuuggcuggggagaauuugggaaagaaguguuuuuuuuuuguuuuuuguuuuuuuuuaauugcaacuacuaaguuucaaaaaugggggaaaaucaugaagacagccacagacaucuucaggggcugacuaauucuuaaaugauugguuccucuaagagugguuaguggugaaagaguaaaugauguaugagaacgauuucucugauuucugccaggaguucuacucacucaguaaccacagggaauagaaggaucagguuuuccacagaaacuacuuuuagcacaugcuguguuucuacaccuguacuucucuuccgaacaacuaucuuagcuccaaguugacauggcccguuaccaaggggcuccaugucuuuuguuuuuguaguaaagaugacuugaauacagaagagguguuguaggagagcgcgucuucuccaaaugcuggcagaugacaguuuccgcagggacguaaagaggugacaaaggcacagaauauaauuuaguccugauuuccaggucuggcucacaaaacuaaucggaugaaaauguggccaaaagaauaccucggagauaaacuuucuagaacaagcuaacgccauaauuugacccuaauuccaaaaaucaugggaaggacauacuucuuaguaucuuuaucuuauucucaauuaaucaacaaaccuuaauguaaauaaauuuucuaaaauucauugucaccgaggaaaggguuaaaaaaaacuaaaguucucuuuugagaauggauuucuuucccucacuaccuucuuagacaauacaacagagguuauuucuagacccagaggagacaaugcaacauagcuucuccagccuuuggacacuaagcaaguuaucaauaaugcagaaucuugaaaccugacacuaaacuccuucagagguagguaucuugugagcaaaagagaacagaguaaaaggggcaaggaugggagaguguaagaagaaccaugcuguggacauuuuacuucuugggguguuaguuuccuucuaugcaaaauacaacuguagauugccacaagccuaaacaaaaucuguaagaaauaaauaaccuucaaagcaauuuaauaaaaagaaaugugcccaaaauauccucaaagacuuuauuaaucuagggaggcaauaguuaggaauaugagacaugagucaaaccaccugauuccacaucccgauugcacgaugaacuagcugugugauauugagcaagugacuuaacccccagauuuccuaccuguauaagaggaauaaugaaagcuccacaacuacugcaaaagcuaaaucaaauaauauguguaaagcuguuaguacaauaccugcccccacaguaaacacacaauaaguauuagaaauacaacaaauuauuauauuuaaguauaaagcgguaaucuguacauacuuggaacauuucugacuugagaagcuauaaaaucauggaucaaaacaguuguacaaaagaugguguuaugugagguccuuuggauuuaauauaaggagccaaauaaaagcaguccaaauuuagaaaaaucuuucaagcuauuccgcgaugacugugucugucaucacuugggaaaggaaacuguaugcuacucgcauucuagagagcuguuaggaaaugcuagcugacccucaacaaaccuucagccuccccaggaacacaguuaggcagcuuaauuugggcaagcgaggagaaagcaugagcccguacccaagcacugccugguuuccaucugcgcgauuuaaccacaagccacagagcgccucugcggacaccaaguccagcugccagggaaagguuucagacccacgguggugucccaacaauuuccaguucaguggaaaucuggggaacgcacaggcucauagcauaugauuucuucauguuucauuaguuuccagguuuuaaacaauuuuaaccuucucucuggcacagagcugcuguacuguaaguagaaaucacuggacuuugaguaacaugagccuguuucacguuuguggguggacauccaauuggcacagugaccuuggccauguccugacuccucugagcuucacuuuccucaucuguaaaaugggugaaagccaacuucagugaguucuggggacacaaacauguuucacaugugccuagauagaugcuguuagucucaacucauuugcuauccugaacuuaaacggguugccaaucuacucucacaccacucuaaaacaacaaaaaaaaaaucuuuucaaaagcuaacaaacugaacuaggagacgaagaaagaaaauucaccgcuacauaaauuagccaggagcaaagcaagaagcugcccgaguagggcaguuggcuucccacaauugauucuuuaauaacuucuguaauauuucugaggcacaucaaaggacaguaacagcccaguguugguaaucccucucacauauaaaaacuuucauuacagaguguuaaaggcaucacucugcuugagaaaucgcaaucaauagacguuggccuuuuuucuucuuuucuauccugggguaacggcaccagcauuuucucuccaguaaugcagugcuguguggccagaguuuccucugaugcugcagacgagcaccaagaugaaaaaaucuuugugauaaaugagaaagaggagaagaaguuugggagaauaccucucuguguuagaaacccgaaguguuccaugcuaauucacccuaaaugcuguuugcaaauauuggcuuagacaugcauuuaaaagucacagggauuuguuuuaacaugauuucuuuugcauucccauguggaaaauaccuuauuuuagagugagacgccaucucuauuucccaggcuggagugcaguggcuauucacagguacuauccucaacccacaacagccucaaacaccugggcucaagcaauccucgcaccucagccuccugaguagcuagagcuacugcaugccccacugcgcccagccuauaaaagauuucaauugaaaaauguuuccaauuagcacccuaagagcaggauaauuuuggaauacugcagcagaucuuagggacacaaacuaaaaggacagcaggcagucauuaauuucuuuguuccuuauuaucuauaauacaauuguuagagucagaaauauaaaauuacuugcagaaguuuuuuuaaauucagccuauuuguuuccuuugaaagauuacuccagguucuuuaaaaagccagaaucacauuuuucuuuuuauuaugaaugcauaaaggccaaaggccacucauagcaucucccucguaaaccgcaucuugccaaagcccguggccaauuucuggccucccuuuacugaaccacuuaguggcauuuggccaguugaccacuccccuccuucauaagccguuuucuugcacauaaaccccccaaccacacuacccuuuccccaccucuacuaccuggcuccauuugucuucauaguuuuauaggaauuuaagucaucuauuuguguguauguuuauuaucuuacuccaugucccaugccuagaaaucccugguaaguuguagauacuccauaaauauuugcugccuggcugacucuuaguauuuucuuuugacagauuaaaagcucagaggagugaagccacuugccuaagacugcauaguaaguggccgagucagaauuggaacucugagcccauacucaugaccuuuauauaauagaaaaagcagccucgggauaaauguccaagagcaggguuggcaaacuuuucccuuaaacgggcagacagcaaguauuuuugccuuugugagccacauauauauauagucucuugcauuuuuaaaaaagaauacuuuaaauacauaaaucuauuauuagcucaaagggucauacacacaggccacagcugaauuuggucuuaguuugucaaccccugcucaggagaauaggagcauuuucuacuggauucaugacuuuaacccaggcccaagaauccugugcagaaucaauuaagcuuuguacaaugauuuuuuuuuuuugagacagagucuugcucucucgcccagacuggagugcaguggcgccaucucaaucucggcucacugcaaccuccaccucucagguucaagugagucuccugcuucagccuccagaguagcuggaacuacaggcaugcaccaccacgccuagcuaauuuuuauauuuuuaguagagaugggguuucaccauguuggucaggauggucucgaucucuugaccucaugauccacccgccuuggccucccaaagugcugggauuacaggcaugagccaucacgccuggccagaaugaaugaauuuuaccuucauccucuagacaacaagauccucaagguuaccagacuugggcauguccuacaguuaaaaaacaguucacuuuccacaaaagggagcuggauaaauuccuauggauggacacaaugaucaagaggaggaagaauccugauaaauuccuauguaguaagagaaaauaacgcaagaucaagaguggcaaaaugcugaaaauuuuguguuauucuuuuuccaauuaagaggcuuucccccgcuaugaaguaagcaggcaucaccagaagugagaggaggaaaauaaccgcucucaccucuccagcguccugugcuccuauccugcugagacugucuuuuggcuacuacauaaaaagccaaaaaagugaguccuucacagcaugaggauacuuuuagcuguuggacacggagaagguuuucucuuggucuuuuauucaaucauucacagaaagggacauccugugaccucauuuucacucuaaaguaacagagaaagccaaguggcuuccugacucuggguucuauagaaacccuugcuuugauggugccuuucuccuccucugaggccaagucauggugggggcugguggggcuuccuuccauuuccaagacagguggaucuccuugggaaacagcugcugucugggaauccuggcagcaccagggauagagagagaagagaagcuccaguuucaacccucugagucacugcaaaagaauccccuucauuaaaacuaguucucaagggaaaggugcuuagagaaaaaaaaagacucagcaaaaugcauaggacacuuggguaggagacauuucauuauggccacuuugauagcaccacuuugaagcagucauuuugauuuugguaugaaacuucuuggaauuuuaguagaaguuagagaauuaccuaaguaaaugcuuuuugaucaaaaauaauuuauauuugccaguuugucuuucauuucuccccuuaaagauaagggcuaugccugucucguuuaccauuccaucucuaguacucaauaugguaccucacauauaggaaggguauauuuauuuaaaaaauaacuacuaugaccaucacuacuacugccuauguccagugcuuacauuagauacauaauaauuuguugaaaaaaugaacugcuaccaucacuacuaccauuauugccacauaauuacuauugucaccaucauuauuccuauuggcugucuauuguaaagccaaugggacaagcauuaugcuuagauuauuucaauuaucauucccauuucauagaugugaacacugaagugcagagaaguauccuaaaacauauauacaguaugugguaaaaaauugaauuagguuauuauuaugauuagucuugucaaguaaauugggagaaaugaauaggcugagagauaaggauaagguuguacuuagugccucuauuuuggacuuuuaagcauuucuuuucacggaaagggaccagggauucuuaaagaaaugacugauuccagaucugcuccaggaaauagacaugaugaauuggcaaauuuuguuguggaaagcuaucaaaaccuacuagaguaaugucaaaaggacuuggagcuaacuugaaaggggcucccacuggccaagacaaaucaacuucaauaaaaacaaugaaagugguagaaugaaauagaucaaauacacaaacauucaaacauuucuuaagaguaaaaaucaauggucacccuuagaaguugccaggacaccaacuuaugauuuagaaaauauuaacaaaaagaaacuaagggaaauuaaacacuuacccugccuuuccuguauggacaaccuuucaaaguaacaacacgacauggagggaacguuuuuccucauagaggaaucacaguuaauaaaagcaggaggaaugacagauuuagaaaaucaccauuucacagcucuuaaugaaauaaugggucuagacaaccaccauucauagcugcaaaaccuuugccuuaaagcuuaauuggaaacuugauauuuaaggcaucacacugacaacaugugaaucuaggaucaauccuaacuuaacuaaaugugggauaauaguacauuacaucagugguucccauacuuugaagcacauuagaaucacuuggggaacucuuaaaaaucuuaauguucaggucguguaccagaucaaucaaaucacaaugucugggguaagaguaucaguaauuuuaauuugagauguuuuaggugauuccacuguggagcaaaguucaggaaucuuuucauuuuauggcucauggugugaugcucccuaugauauauuaauguuacuaucauagggagauauauuaacauccuaugauauauaaccaaauauuuaccagaaacagaagaaacguguuuaagaaugacuacaaaaaugcaaaucagaaaucaaaugugugaaaaauucaaagagggugugaauggcauaucuucucaacaaacaaaugucauuuuaaaaaaugguguguugggggugggaauggagggcuuuccuuaaaacaugacuggaaaaguuaugcuucuggcuaugaaugaauaacuucauacaucagacuaauccuccugcagaaaguaauugugauagaugcauaaauuaaaaaaaaaaaaaaagcuguucaaaagcaucagagcacaaccaaggcaugcaagauucaagcauccuagaugauguaggcaaagaaagcccacugaggugagcucuauaguuaaagcaacuuuguguccuaagggcauuugcgaauuugcaucgugagggaauaaaccaaguagaaagcagcagcuagagcuugaugcaguuucugagcuagagagagaaguuuggaaguuaagggcuauagaagcagcagcuaggacuugagggacuaagauuugugagaacggugaaccaaagaaaagugaucccaauacuccuaacguaauuuccccuugagauauuugcaaauuccuaaacugcaaacauaugaagagaccaauuaacuaagcaaaaaucaaugcuaaaagaccaaaaacgaaggagccauuuugucagucuaaaaggguuggggagacaaaauugcaauuuagaagacacuaaggagaaagggccaucguaaaugccccaaaauuucauuugagaaacucaaaaggcuugaauuguuaggacaaacuagaaauagaccacagaauuugaaaaauaucauuucuggauuaaaucaauauaacuugcuuauacuguauccaccugccagaauguuaacauaucucugcaagaagauaaaauccacauuaaaggaaacacuaaaaggaacuaaaggggguuauuugggcagauuaaaaauuucccagaugaaagcauagaauguaggauggaagaaagaguacuagguaaauugggguaaguaccacucuaacaauuuaaucaagagaaaugaauacauguccacacaaauaucuauacauaagcagcuucauucacaauaauccaaacuuguaaacaaccccuaugugaaccaagugaauggauacacaaaaugucgaauaaccauacaauggaauacuauucugcaauaaaaaggaacauuaacacaugcaaccacuauucuccaagucauuauguucacuaaaggaagcgagacacaagggaguucauauuauggguuaauucauuaaaaauccuagaaaaugcaaaaucaccgcuagugacagaaaauaaaaucaacgguugccugagagcugggagugacagaaggaaauguccacaguguggcacaaggaaaguuuuagggguggcagaaauguucugcaccuugauuuugguggacucauggguguaucccucuuuuaaagcucaaugaaugaauuuuacaugggcacaguuuauuauauacacacuauaccccaauaagcuuuuuuuuuccuaaaagacaguugaaauuccccaaagacagaucaaaaagauaaguugcuguauuauucuauugaaguuuaaaaacagauaaaaucaauccaugauuauuaaaaugguguauaucuugcagagcagguguucacuuagugaacaggaaauuucuggguacuagugcuagugagugguauuuucuacaucuuugagaaauaguuacaugggauguuuauuuugaaaauauuuauugagcuaaacacuuaaaaugugugcacuuuugcuguuuuugucauacuucaauaagaaaauuuaaagguggaggauugagagaaauuaaagaaaauccaagagacaaagcaaccaaaggcaaugcauggaugucauauggcuuaugauuuuaaaaacucaacugaaaaaaaugugaggaaaugaaugaaaaucaaacauggacuauuuaucauauauuaaagaaugcuugcucauuuuauugcaugcuacugugauuacauuuaaaguccuuaucugcuaaauaaacauacuaaaguauuuauaggugaaauaauugaguaggauuugcuuuaaacaucagcaaaaaagaaacacacaggccaggugugguggcucaugccuguaaucccagcacuuuggguggcugaggcaggaggaucaccugaggucaggaguucaagaccagccugaccaacauggugaaacccugucuuuaccaaaaauacaaaauuuagccagguauggugguggguaccuguaaucccagcuacuugggaggcugaggcaggagaauugcuugaaacugggagguggagguuguaguaagccaagauuaugccauugcacuccggccugggcaacaggagugaaacucugucucaaaaaaaagaaaagaaaaggaaaaaauacaugugcucaaguauagguugaucaucauggaaguuggaugacagaugcaugagaauccauacuauucucuugaguuuugcauauauguaagaauauuuuuacaaaguaaaaauacaauucaagugaagaugagguacaaggaugaggcagagggcccaggagggugugaagaugucuauugugccuaugaccuauauucuauucuuugcacuuugaagauuaaaauacccacagcaucaaaauggcuaugucaaaaugucuugcuucagaauuugcauggcaagaauuuucucaggggcccagaaacaugacaagcaugaaaagaaugaaauuuacgagaguccaauuagguccugaaugacagccaggcagauauaugaugacaaacaguguccuucguuucuccagagacugaucuacuuugggcccaaagagaggaaagugagcuuguauaauccugggaauuucaccauccuucuucuggucccuaguuaucuccaucugaagccuauucagguuuuggaagggagagaauaaaaugggcagccaaaaaccagauucugauggcaucagucagaauccugacaggacacagaugucauacuccucugcaacuuugaagagaaauaaacuauuuucagagguggagguuggguuacaagguaaggauuugaagccccugguacuagcuacagcagaaugccuuuaguauccugggccuaaaaaagcaaagaaagagaacauguuaucagagccuggugagguaaagguggguggguuagggguaggggguggggagugggacgacuaucaucacugcuacagccuugaagggacacagacccugaaaaacaugaugagaaagacuuccaugggaguaaacaucccccaucucucucucucugcccauugccuggucucuuuccaguaccucccauugaccaagcccaaacuggaagacagagacauggaagcccaggugacacagucaaccuccugggucaacaagcagggcagacaaggucgccuaauaggcuaggaaggcgggggauggagaauuaccagcacaugcccccaaaggguaauuuacaccacacuggaauacauaagaucuucaaagccacaguuaguuagaaaugauggccauuuggcaaaagcuaauucagucagacccaggguugcagauccuuaauuuaaauggaacugaguauuucuaagcauuucacaagaggcccaaagacaaugaaugauaacagauucuuuacccacacacacacacccuccccaugggggaaacgguaaggagcuacucaugcucauucucaaguuuguaaaacaaaaaucuuuucuucuauauuagaaauuuccaaaguaaaugcacaaaaaaggggagaaaugugguugcauuuuccauugggcuuuaaccaucacucugcgaaagagaagaguucagagcaaagucaucacagguggaaacaaucucaagaucagaugggagaggaguauccucuuccccccaccucccccgcuccagggguaugugguccucucuugguuggugaugccaacccugcuuccucuggcccuggguuuuguaccugcugcuuucucugcccuuaaugugcuuuccucccuuccuucacuuguuaacuccuauuccuaucuuagcucaauugucacuuuccagaggaaacuuucccauguucacuaaugaggucaaagccccuaagacauacugucauagcaucuggaacuuuuccuucaugaaagcacuuucacaguuuuugguauggcuguuugauauugucuaucuccccagcugaacugguaguuccacguggcaaggacuauguguaucuuugaguaccauugcauuuccagggccucacauauaaucuggcucauaguaggcacccaacuauugucgaaugaaugagucuucacugcaagauaaagugacaacaguuuuccacucuagagaccaucuacguuuuucccuuucaauguacaacaugauuuuguuuucuuucccccaccccccacagcauuaaauuacuggaaacacauccuaugcucauagauggguagaaucaauauugugaaaaugaccauauuuccaagagcaaccuacagauuccaugcaauucccaucaaaauaccaucaucauucuucacagaacuagaaaaaacaauccuaaaauucauauggaaccaaaaaagaaccugcauagacaaagcaagacuaagcaaaaagaacaaaucuuaaggcauauuacccgacuucagacuauacuacgaggcagagugaucuuaacuguaccaagcuaaauccuacaucuagauucacagaugcaaaaguguuuaauaaaaccaaguuacuugcauucuuaggcucauguagaugcuguacgcagauggucuucuaaauagguuuuagauaugucaaaacuuucuccagccacaaagucaagaaugaucaccuuaggguugcaguauacucaauuauuuauacuccuucuaugaucaaggguaguaguaucugcauuaaguaguuuccuccaaaccagaaaggaacgaauuggcagaauauauuuccuugccuccagaaauaacuuaucaucauuagaaucaucugauauuuuugggaucuggaaucuauguucuguauuugugaggguaacuaugagacuugaacaguccaccagggaucuuaaaggcauguuuucaaaacacagcccccaucaaaacagugugcuguuaccaaauauguuugggcaaugccacugugaaauuuacaacauacacuaacagagaguuugagaaaucccauggcugguagagcuuggcaaagggaaauguguuucccucacauaucuaacuaggaaaccgucauuucaaauacuuccucuuacuauccugaaggccauauuuuaggaaaugcugcacuggaggaaagauguucuagaauagacagguacuacaagacugaaaaagagaaaauuuaacaugcuuuccugcuacugaaucuauucuauauauccuguuuuucuucauagguguuugccccacaauauuuuuguuuucucauuaucucuaauauuaaaaugggagaaaacaguaauacaagcauguugaaaaacugauaccgugaaauauugaaaauuugaaauugauuaauguugguuccuaaagcaaauuauuuuacugaaaaaaaugguucuauuaaucuaaauagauacauuuauuaauauguguugaauacauagguauguaccuaggaguuuuguagagagcaugucuguuuagaaauaagcauacaaauacauaacuucauguaacgaguaugcugaacaagcaugauccauugcauaaaacacaacauuuuacucuccuugccccucuaaauuugauuaggugguaauaaucuuccuuugcccuuggauaaaaacuacagcaggcccacgaguuugcuguucacagguaaugggcaguucuaaaacaacuucagguuacacauacagucccaggugagaaaacaaacuccacaaccauguugcuuuuguauggaaucuuuccccuucucagcuuggcccugcuucagacugaaagccuccagaucacccuguggccccuccaccuuauuagccagcauucugccuuucucaagguugaagaaacuaagagacagaagggcuccuccuugugcuaguucuguuauaaucuagcuuggcugucucugggccuggcagauaguuagggcugacacuuucucuuuugauaagcuuuuauggauucugcagagguuuccuguuggguucuuuucucaaacagcucacuagaucccagguggguggccagggaucccccaucccaagccccaggucaucuaggcaucugccuuggacuucauaugcuacuuuuccaugacuccuucaguuacuguauugaaguauaucaaaaacaaccccacguuggcccucuccuuugcacaguccagaacugauccccaggaaacacacacaucucaugccuugacaaaaacugggaaauauuggccacuucgcaagcaggagcauuccuacccuaccacccaagcaguuggccagccccucuucuccuggccuuccagaguuucagggugagucucaaaugcaugggcccucuaaacuucccaggcuugaugcaggcacaagccucugguuuuccaacugcaagaaauaauucagagcuuucugauuaguccucuuaaugccuccuauugggguuuuggguuacaagauaguacacucuacuuuuucucccaagaggguaaugaugacucaauacauggccacaguugucucuaaagagacaucuucucuugucuccucuggacucauauauacaaaagccauggaccaggaucaugacuuucuauaugaggcagcugucuuuuggucgcuguauuauggguggcucugugaaacugagacaauagacaauacaaccauucuaacauccuacuaccuacgucguacacauauauauguguguacgucauauuuuacuauacgguuucuauaacaacuucaaauaguuaacgcuauaagagccucaacacuccccaauucaauuauaaucuccagcuuucacugaucacugcugauuugguuauaaaugacuucacaaccaaaagcuuaccuugagaauuuuucaaucccuauguucccagauucaaauaaauaaaaccuacuugaaauauguggacuuaaaauagucuuccaacgcauuccucacacaugaaauuacucucgaauaacuagcuauuggugacauuccugauagugcccuagauuucucaacuuuugcaagagcccagauggucagaaagaacuuuaccaaauuugguuacuuguuuuuaauggaaggauuuuaaauguucuuuuaacaaucaucucagcugcauuuaaaggcuacuuagcaguguuugcagcuaggagaacagauaauuaccggagugaacuagcaaauuccuacugguuauaaccugaaaugggaaguaauacauggucaagaauguaaaaaauuacuuauauauauauacauuuacgcacacauuuuuuaauaucaagugagcaaaaugguauuaaaucugguuaauucugcccauguccauuugaaaaacaaccguguaauuugccuaagaaaaaaauucucucauaguuaagucagaugccuaauuauaucauccuuuaucugggacugucaaaaauaaaacauuuuggaucuauucacaauaaaaugacauuuucagauucaauuucauacaaguuuuuuauccauuaugcucacagaucaaaagugacuggauucaucagccaaaaagaauauuuuaaagagcugcugagaacuuuauaaaaauaauucugauuuucuuuugugggggaaacaauuucuuuuagaggaguuagaaaaaagugagaaaaaauuuuuugaaagaaaaagaaccaccaauguuacuagagagcagaguugacauggcguuacucacagugacugguuaaggguaaaagugggggaaaaaagcaaaacuguaaaguaacugauuauuucacugucuucaccuggccuuaauucaaaucagaacacuucucccaccugcauuacuucaaacaauuuaccagaaaagaagagaaaauguggauuacauaacccagagcauauagagcgaaacugcaaugcuaucauucagcaaucacagugcucuaguuuauuuuuaaaauagcucagaauuggccaugcucaagaagugguccuacauacagcaagagagcucuucguuuaauacaauacagauuuuuccuaacagcuuccucuacuacuucacauauuucuuccauaucccuacauggcccuccuaagaaauauaccuuuagcaaugaacacuaggaaaacauaucguuguggaaaggcaugggagagagucuacucucuuuacuugcuuuagcgugaggcagaaaauauuucuuacaggguagccauccaauaccugagcacuuucaaauacucugcagcagguaauuuguuuuucagaagggugggaguuaaaaguaacacagaaagucauaauggggugagagauuagacuuuucuccaaaguuacagccuuuagauuuagcuccugcaauucugaagggccucagagauaaggaaaucauguugcaaaugugagaagugagauuuagagaggugaagggaccugcccaaggccuccuagaaagaagaagagacucugguacucgaggcccucaaguccaggguucuuuccacuugcccagguuuaucccugguuguccucuccucugccccuugaucugacaaauguucaaaggauuacuuaaaauaguccccugcucaaaauaacaagggcuugccaaaagaagaaaaacaccuugaaauagagauuccaauuaacugccucugauugcuggauaacucuucaagacucccagaaaccgauucuagcaguauguguuauuuguuuauagccaaccuuuguuccaaaaauaacuugauauguuuuacagaaauauguagaauacauacaaugcagaaaauuauugcaaaggaggaaaaaggaugggaaaagcuaguaaucuuggggaugaauugucauacaccaagaaagcaauuuauauaccugguggcuuaacagcaaauauuauaaucaaugcaauaauagugacccagcagaaauacacugugaguugaaauaaaauguuaacaagaguuuguggggaagaauaagacacaaaaguccugauaaugucucaauaugcaggguuuggacuucugaagcaggucacuccuaagccuucaagcuuaggaaaaaagggaaaaaugagaggacagaggauagaugggacgacaaugggguggggagucagggaguggguagagggaaccacaacagguugacguccaccuagguaucacuuaucaaugaacugaaaauuuaucagguaauuggaagcucaaauucauacgucaccuggacugaacugcgcuuuuguuauuuauaaugcaauaugguauaaaucaauuggcuuggauuuuaaaauuagagcccaauuaccuguguaagggaaucauaaauccaacuuguauuuuucuaacaggguuaacaacucaugaugccagcuuaaacucaggaaaaucaauggucugggcuuaagaacaauugugcgugguacuuuaucucccuggucuaguguagcaggugggcagucuaggaguugggggugaaggauuugggggaggguagaagccuaaagcaaaggaaacaaacagaaaacauugaauauugcuaaaaacaccacaugccagguaaacaggaaggggggcacuuacauauaguagacagugaaaaucuggacaccuguuacuugaugaagcaucgcaggagcaaaggcaaaacacuccuguugcuuuucuuguucugcaaaacucuccagagcuaagagagcuaaugugagaugaaaagcuaaaaaaggagcgagucagaacucccacugacagcucccaaaucuggcccuuccuaaaggcguuugcgccugccuuaagccagagacucccuucucaggugcaguuuguugacccucucuucaauuggaaacaucugagguucacucagugauaaggggcacguggaggaauaaagcuguggcagugguggaggaauuaauaguccaacuuuuauggagggcaguuaacauuguguaugccuguguuuauguaaguauauauaccuacauauacacacauauauguuauauauuauugacauagaaauuccauuuucauaaaauucuccuugagaaaugguugaagaacagugcaaagauauacauacaaaauucuucauugcggccgggcgcgguggcucacgccuguaaucccagcacuuugggaggccgagacggguggaucaccaggucaggagaucgagaccauucuggcuaacacggugaaaccccgucucuacuaaaaauacaaaaagaaauuagccgggcgugguggcgggcaccuguagucccagcuacucaggagucugaggcaggaggcugaggcguuaaccugggaggcagagcuugcagcuagccgagauggcaccacugcacuccagccugggugacagagcgagaguccaucucaaaaaaacaaaacaaaacaaaaaauucuucauugcagcauugcuucuaagaaccaaaguugcacacaaacuagaagucauucaaagggggugauccaagccaaguguauuauauuucacucauacaauguaauacuauacugaaauuauaaaugacgauauaaaauucuauggacaugauacgugguaaaauaaaacaacaaaauaguauuacuggaugugucaauugugugaguguguguaugugugugaauaagaacgugugggagaaaauccugcauauuaaucaagcuuauugcuguuguaggauaacugauauuuuuuaauauuuuucuguuguguuggauuuuuaaauuuuaauuguuauaaaauagucagguauuacuuuuauaaucuggaaaaaaaaacccagcaauuuccauuuuggaucuugaauacaguaggaaggauagcaggguagcagcaguuacugggcaaagcagacgucaaccagggccuaacaacaaggcucucacugcacaaagcaccagcaccugucccauaauggcuucuguuuucacacaaaauuccgccaacuggguacaucuucucaaagaggggaaacaaaugcaccaaaauuaauuguagaacuuaucuuuauguucugggggccagaaaacucagucuauacugugcuucugagagcaaauaauccuuucuaggccuaaaauacagucugucuucuauuuugggcuugugguaccucuguugucucauuguucaaguggauguaaaaguauuaauucaaaaaacccauguucucugcuuaaagcacagaauugucaacaaaacauacuacagaacacaugccucucacucagucauuucuuugucuuaguuucuuguggucuauuccauaguaaggaauuugcaauguuggaguaagagaccuaagaggaccuuagagaucaccccauucagcauccucauuuuucacaagagaaagcccagacuagucaucaagugagcuagccaggacuaaagccgagggucugguagucaguccacuguuuaucacuucagcucuaauuccauucaagacacagcuauagcuucccccuucuggacaaucugaauauuccuuuagcuaauguugaaauaaaucagacuuucgacaucugaugugacauacagagagaaaaaggcaggaaaucuaacauaauguacuaguuagcuuuuccaaaugcaugagaaauacuuucaauaauggaaaacacuacauauacuacuuuaugcagucgacuuuugcuucugugauagaaaagggaaaaaguucaggggaagaaaacuacgcgggucauuuggugacguuuuuaagauuuuuacuuucagaggcacauaauuuaaaguguuuuucuuuuucuucuaucaaaaccaaacauaguuacuagaaaacaucugaaaaaugcaacaaaauuuuaagaagcaaaaaaagaaaacaugucacacaauucagccaacaaaaaaaccacaguuaaaauguuaguauaguuccuucuagguuuuuuuccuuuuugaaugguugagcacuucauauauauaccauuuccaaguuuuguuuuguuuuuuaccuaaauuauaccuaagcauuuuaugaauucauuaaaaacuauuuauaaacauuauuuaauguaugaauaauauuccaugguauagagugccaaauuuuauuuuuucuuuauuuaugucauuuaggguuuuucuauuauacauuauucuaugaugagcauuguaagaaauccaucuugaucuuaauuucugauuauuuucuugucuuaaauuccuaaaauggggaauugccagauuaaauacuaugagcauuuuaaauuaccaggaaguuuauaacaaauuuuguuguuccuaccaaaaguacauagaaguacccauuuuauaauccuuuuucaguaaaacauauuuucaaaccuuuguuaauuuuacagguggcaaaauuaaaauuaaaauuuauuuuaacuugaaucuuuauuauugaaaaauuugguauacccauuggccauuguggccauccuuuggcagaucuacucuugaggucuuggcccauuuauuuacugagaaaaaaggaaagcauuuugauagauccaaucuuuuuuuuuuucaauaaauaaauaaugaauuuuuaaaauaaauuaauaaacuuauuuaauucacuaaagcuuaagaaacacaaacuucugggcugaucaguuggaggcuguagaaaaaugaacggaacacacuuuuuuuccaaguauauuuuguauaagcucuaucuaauuaaugaaaccuuccugcaacuuucugcaucugcucauuccaagcauuagauuaacaaacgguugacauaaaaugaagagcuacaugguauuucuuugacauguggcauauaaaaaucacaaacucugucuuuaaaaauagaguguucugguucacacugguccacugagcaaaccuauuuacugccuuucccacccaaaauacuuucuaaaugauacuaaagaaaugcaaaagugcaaacucauaaccacaaagagaaugggaagaagccauuagaagauaaaugauuugaauaaaagucuguuggcuucugaaccacacagcaaaggaaaccacagccuaaaaagggauugcggcaaaggagggccgaccugccugguuauuccagaaagaaucgagccucagaaauagcagguacaacacaggauggaagagauugguggggcugaaaagggggguuaauuacaggccaggcugaauauguaacauugaccacccuuccuccuggcucuccauguggacuagccugaggccaagcaccagcuucaaggcaauaaaaaaguggggagaaccaucacaguuaucauuaguguuaaaaccucacucuaggccaggcgugguaguucacgucuguaaucccagcacuuugggaggccaaggcaggggggaucacuugagguugggaguucgagaccagccuggucaacacggugaaaucccaucucuacuaaaauacaaaaaguagggccaggcgcggucacgccuguaaucccagcacuuugggaggcccaggagggcggaucaugaggucaggauaucgagaccauccuggcuaauauggugaaaccccaucucuacuaaaaauacaauuagucaggugugguggcaggcaccuguagucucagcuacuugggaggcugaagcaggagaauggcgugaacccgggagcggagcuugcagugagcugagauugugccacugcacuccagccugggcaaaagagagagacuccaucucaaaaaaaaaaaaaaaaaaaaaaaaauucaaaaaguaccucagcaugguggcaggugccuguaauccuagcuacucaggaggcugaggcaggagaauugcuugaaccugggaggcagagguugcagugagccaagaucacagcauugcacuccagccugggcaacagagugaaaguucaucucaaacaaaacaaaacaaaacaaaacaaaacaaaacaaaacaaaacaaaaccuuacucuagcacauugcgauuccccaguucccaugcacacacccuaaacugaaacucuucaagcuugcuauucacaagacccacccacuuaaaaauagaccgcaacaauagccuucuuauugccucauucuuucacacacaccacagaucaccagaaauuuaauaugacaagaaagucuaccacagaaaagaaaaugagcaaguaaaacaacagaaaacaugacacuggagaaaacaguuuaggggaaagacacaaacuuuaaaaauaaaaucuaguuaauaucgucaagaaagauuugaggagauuugguaacuacaaaacaaaaacaggguucuauugaaaaggaauaaucagauaagaaagagcucuuuggaauuuuauaaaugcguaaguaaaaaauucaauagaaaguuuguaggcaacguuggaaaaaaucuccuagacuauagaccaaguacagaaguaagugagaaaaaaauaaaauauauagaugaacaauucaggaggucuaaggaugacuaaccaaauuuucacaauaagaaaaaaagaaacuggaguggagggaauuaucaaagagauugcaugguaaaauuccccagaguuaaagagaaagaugaauguucaaaguauaggaaucuacuugauaccaagaauaauuaacuguaaagugguagaaaaaugaaauuccuaacaauuuccugaaaaguaaaaaaaaaaagaagguggccuacaaaauaagaaucagaguagcaucagacuuagcagcagcaggauugcauacuaaaagacaggaaaaaggauuuucaacagagaagucuacacccaaacuaucaauugucuuuugagggcaaaauaaaaaauucuaaaccugcaagcaugcagaaaguuuaccucccauucacccugauauggcuuggauauuuguuccugcccaaaucucuucaaaauguaauccccggugcuggagguggggccuggugggagguguuuggaucauggggacagaucccucauaaauggcuugggcuauuuccuuggugacaagugagcuauugcucugaguucacaugagaucuggugguuuaaaauuguguagcaccucgcuuccccacucucucucccucuugcuccugucuucgucacauuaugugccuacuuccccuuccgccauaauuguaagcuuccugaggccucccuagaagccgagccagcaccgugcuuccuguaaagccugcagaaccaugagccaauuaaaccucuuuucuuuauaaauuauccagucucagguauuuauagcaaugcaaaaauggccuaauacacacccuuucuuaggaaguuaauagcaaaaucagaaggcaaauuagaaaagaaagaaaacccauucaauccagcaaacagugacuccaacccuggagagcaauggggacaucucaggaugauucuacacagcaugucuacagagccaccuguccaaaugggagcaaaauggaggucuguaagagacaggaccaauagaacaaagaguguaauuaugagcuugaaaaaacuugaagauauuauugagguauauacucagaaaaggcaauaggacaucagaaauuccagcaaaaacaaacaaaaauaacuuuauaagaaaaacuugaaauauauauuacagaaacuaaaagguggaaugauuuugauaaaaugauuuaaaggaagagaauccauuugcaccugauucuagacacaaugucuuugaguaucacaggaauugugacagagaccauguggggcugcacuaaauaauuuagcaaaucuuaauugugcaaauauuuucauuauuuccaacuuuggaaaaaucacaaaaaaagacuacucuggugacagagcaaaugucaauuaaauuugacaaugcaaaaauaaugguauauagcugaccgagaauggaaaguggaaggaaaagaaaagcagugaagaaaaggguauugagugcccauaucucauccugugauguguggaggcaagagacacaggcuagauugauggaccaaucaggggagguauaaauacaauuuagaaguggcaagcccaauagaaguugagaauaaugucauguuauggugggagcaugugaaaaguuuaguguaaguuaguguaaggcaaauacuucuugucuuuagaagaaaaucaguagauaacauaaaaaauaaauaaguguuaacuagcaauauggaaguaagaccaggaauguugaaaagugauugcauuuagggagcucagcuggaggugggaagggugggacugggaacuguuacuuugcacuacagguguuucaaaaccauuugauuuuuaacuacgugcuuauuuuugcuuucauaaaaaacaauuccaaauuaugauuauaaaaagcaaguacauuguuacaagcucuuuuacuaaaaacaacaacgcauaauugagccuguaugaaaugcugucuucuaagccacuggacacgcuggaggaauagcgaauaaaguauaacuggauuuauuuauaacgaggagagagcaaaugcaguguacggaaaugagacacaucauuuuaucucgacagaacaauuaagcuuucauuagggcuuaaugacaggaugacauucggggguuuggaggguaagcacaucaccuucauuaucaaaucaaagauuauccaguaucaagaggaacaguuuuauuuauucuguauucuccucgaacuccccaccccaagcucugucaugacccuagauaagaugggaauugaacaaaaguccccaagugcuaauugcauauucucucacauccccaagauugcugucuccuagccauuugauguuaauaucacagaaagcagacagcaaguguauauuuggaugcacagcuagguacauuucccagaauguauuuuggaagggguuaguuguuggaagguuggcaagacacuagugacuccacguuuuggcuacuacgccuuucuguccugaaagccugguguccauguuauuuagaacagccuggguaaacuuauuacugcacccuguguucacagaaaagguugguucugaguucaauuacaaucccuagcaguuuaaacgauagcugcugugcuauaaucuaaaauaaauugcuuuucucaagaagccauguaagccuuugcacugcaucuuagcagagcugcugguuuuaucucaucugaaacucaagaaggguacaaaagcaggaccucugaacuccuguuguuaccucaaaugucauucuucuacacuucuggggcucucucuucaccccaaauuccuaucccagaacuagauuuaugggaaagcaacaguguuuucauuuuuuaaugcaaaucaucauuuuguguuuauuguuuucuauauaagcugcauacuuugccuggggucuuuugaaagaacucuauuacugggggcaagauuuguuuuuccucuucccacagcuagaaggcuaaccugcuaccaugggccaagauagcaaguaugaggacgcccgcacccaaaugaauuggggcaccucuacagacucuccauucaaacgcacauccuccuccucucuccaaagggaauggaggaaaaggaaacaaacuugucaagcgcucaauacgugaaaugauaauucuggcuuucuccacccuccaccuccccaggaguuuuucccaaaggucccauuggcccaagcucaagccucagcacuucucuaaacaagaugcuuguagaucccuuugaugucuuuccacaaaggcaauuagaaggguuuccaacguuaacuauguacauucuuucagauuuaacaaggcaacuuaauuaacacugcuguguuucugcuagucaacaagagaaaauuguccuuucaagagauuuugcacauugacaaaaauaauccaguaauacuuuucccuuucaaauauuuuucuucuauugagauugaaagaggugguuugcagagugcuauaugguaugugcucagcagcauuuuucugaaagggaauuuuuuuauguccacacaaaaaaaaacauccaggacaaauaaaagccaaaugaauacuuuagacaaauucaaacucaaacuuagagccacucagaaggcaaggaaguccuauuucuuuuuauaacauacaugcaaccaugccacgggaggauaugaaauguagcucaugaauuauguuuauccuuaaguucucuuggagcuauaauaauuagaaagagacaaagugcugauucucaaccaguaucccuaggaggcacuaggaaauggaggaggugaggacauuucuuugaugucucagcaauuggagggcaaaacugacauuuggagaguucucaaaauguugcuaaaaguucuguaguguguuagcaccacagagcgaagacuuuuccugcccagaaugccaauagaucccccuugggaaacacugaccucaaaugggagguugucaaugcugcacuaaggcaaaaugagcuccuuguccuggguccuuugauuucucauuuugcaaacuuaggugucuggcagauagucaaugacuaaaggaaucaucuaguggugaaaugaugguaagucacuuauccauucaauaaauauguauuauguaccaucuguguacagugaaaguacugcuauugaccaagagucucuccuugaccaaacguuaaucaggcuccucugauucucucccuaaucaggccuuaacuuuuggacuucugugucuuucucuguauugcccaauuuuagcaagaauccucuuagacugguuuauccagaacccuucaucuucaauauuggauuacccucaauaucugaucagauuccauauccaccaccaucccuuaggugguuuaaucacauggccugccuuuagguacauuucauaacaauguauccaauuuuccugauccaauuuuucugcauccuugccagcauuuggcguuauuauuauuuuuuuccaauuuuuuugugguaaaacauacauaacauaaaauuuagcaucuuaacaauuuuaaguguauauuucaguaguauuaaguacauucauauuguuacaaccaucaccaccuaucuaucuccagaacucuucaucuugcaaaacugaaacucuauaccauuuaacaacucucaauuccuacuucuccucagccccuagccaccauucuacuuucugucucuacgauuuugaauacucaaagcaccacaaauagaugaaaucauacaguauuugucuuugcgugacugucuuauuucacuuagcauaauguccucaaguuucaaucauguuguagcauaugucagaauuuacuuccuuuuuaaggccaacugauaaggagggacuuccuucugucccauuuugcuauugauuuucuacacaccuuacaguuuuuuucugucccucauuuccugcaucacugucuucuugugugguuaguuuauuuuuuguagugaaacauuuaaauuccuuucucauuuccccuuguguauaucuauuuucuuuguaguuaccacagggauuauauuuaauauccuaaaguuaucgauucuaauuuggaauuauaccagcuuaacuuuaauaacauacaaaaacauugcuccucuacuucucuguccccacuucuuuaaauuauugaugacaaaaaauuaacaucuucaugcaauaugcucuaaaauauaaacugauauuuuaaaagauguauuagcuucucaaauuauguagaaaacaaaauguggaguuacaaaccaaaguuacaauaauacuagcuuuuagacuaauaauuuaaaaaaauuagucucauaucauguagaaaaaaaauggaguuaacaaagcauuauuacaauaauacuagcuuuuauaauugcccacauuuuuaccuuuacggagaacuuuauuucuuaacuaagauucaaguuacuauuaguguccuuucauuucaaccuguagaacucauuuuagcauuucuuacagagcauguguagugguaauaaacuuccucagcuuuuuuuuuuuuuuuaauaugagaaugccuuaauuucuuacucacuuuugaaggacaauuugcugaauguaggauucuugguuggcaguuuuuuuuguuuuguuuuguucuuucuguagcccuuugacuaugucagcccauugcauucuggacuccuacauuucugacaauaauucugauaaucguauugaugauuccuucuacauaaugaguugcuucucucauguuguuuucaagauucucucuuugucuuucaacaguuugaguauacugugucuugugucuugggguggaucucuuugaguucauccuauuuggaauucauugagcuucuuggauuuuuauguuuaugucuugcaucagauuugggaagcuuuuggccauuaugucuccaaauaaucucucuauucuuucucucucuucuuaagcuucugaacucucacaauggguauguuggucugcuucaugguguccagcagcucuguuccuucuucuucaauauuuuuucuuucuguuccuaagacucauaauuuccuuguccuaucuucaaguuuacugacucuuucuucuaccuguucaaauaugccuuugaauaucuccagugaauuuuucauuucaguuauuauacuuuucaacugaaaaauuucucguucuauuuuuacuuuuucugaaucucuguauugauguugcuaguuaguucauacaucauuuauuuuuuacuuuuuccauaucuuuuaguuuuuugagcaucuuuaagauacuuguuuuagacucuuugucuaguagauccacaauuauaacuuuuucagggacagaccucguugguucauuuucuuuccuuugaaugugccauacuugccuguuucuuuuuaugugcugugauuuuguuguuguuguugaaaaccggacauugaaauaaaauaaugugauaacugugaaaaucagauucuccuuccccuuccccaggguuugcuuuuucauucugaauuguuguagguugucucugugcugaggauaagccugagauguaaaguuaaguccuucucacaucuuuugugagccugcaucuuucucuagguaugagcggugacuuucuaauuucccauguauauguggcugcuuuaaaauguacuagucuuuaaugucuggcuccaaacacaaaaggggaaaagaaaaaaaaugaaaacaaaaggaaaagagugcuagcccuuuaaauccccuggaagucacuucagcuggagaaagaagggcuugcaacaauggaaggaaaugcaacaacaauggccccuggcucugucugcaccuuuguaaucagaagcaacaauuagcuaucagagaacagauuccugauuuuugaaugacaguggccuuuuugcacacccuggcucccauaaacugugugcaggcuacuccuggaaucugugcaaggaugccugcgagugggguaugaguagcugauauuauucuaagagcuaaagucaaccacaguuaagggcaauuuacugcccaagccuucucuuggaaauuaaaagccuucaauagacucuagaguucuaaaauaguuacaucagacagauuaugccaugcaguuguucucuaggugaggagauacauuccuggugcuuucuacuuuuugaucuucccagaauccccuccuuaucaauuuuuuuuauuuagccauuuuaauagauggguaaugauaucucauuaugguuuauauuugcauuucucugauggcuaaugauguggaauaucuuuuauugugcucuuuuuuuuuuuuuuuuuuuuugccaucugccauucucuucagugaaaugucucuucauguuuuuugcccauuuucuaauuggacuguuuggguuuuuuuacucuugacuuuucagaguucuuuauauauuguaaauacuaguucuuuguguaauaugugguuugcagauauuuccaaccagccuguaaauugacuuuucauuccuuguaguugggcuuucacaaagcaaaaguuuuaauguugaugaaguugaaucuagcaauucuccuuuuguggauuaugccuuugguguuaaaucuaaggacacuuugguuuguuuuuuuauuuuuauuuuuuauuucuauagguuuuggaaaaauaggugguguuugguuacaugaauagguucuuuagccaugguuucugagauuuuggugcacccaauacccaaacaguauacacuguacccaauuugucgucucucauccuucaccucccuccucccucacuugaaucuccaaaguccauuguaucauucuuaugccuuugcauccucauagcuuagcucccacuuaugagugagaacauagaauauuugcuuuuccauuccugaguuacucuacuuagaauaaugaucuccaauuccacccauguaacugugaauaucauuauuucauuucuuuuuuacggcugaauaguauuccaugguauauauguuccacaauuucuuuauccacucauuaacuguugggcauuugggaugguuccauaguuuugcaauuggaaauugugcugcuauaaacaugugugugcaaguaucuuuuuuguauaauagcuuauuuuccucuggguagauacccaauagugggauuguuggaucaaaugguaguuuuacuuuuagugcuuuaaggaaucuccacgcuguuuuccauaguggcugcacuaauuuacauucccaccagcaguguaaaaguguuccuuuucaccacauccccaccaacaucuauuauuuuuugauuuuuugauuauggccauucuugcagcuguaagguaguauuacauugugguuuugacucgcauguuccuaauaauuagugaugucaagcaguuuuucauauguuuguugguuauuuguauaucuucuucugacaauugucuauucaugucuuuagcccaguuuuugaugggauuguuuguuuuuuuucuugcuaauuuguuugaguuccuuauagauucuggauauugguccucugucagauguauaaauggugaagauuuucucccacucuguggguugucuguuuacugacuguuucuuuugcugugcagaagcuuuuuaguuuaauuaagucccaucuauuuaucuuuguuuuugcuuuucguuucguagucaugaagucuuugccuaagccaauaucuagaagaguuuuccaauguuaucuucuagaaauuguaugguuucaggucuuagauuuaagucuuugaaccaucuugaguugauuuuugugcaaagugagagaugaggauccaguuucauucuucuacauguggcuugccaguuaucccagcaccauuuguggaauagggugucuguuccccacuuuguguuuuuguuugcuuuguugacgauugguuggcuguaaguauuuggcuuuauuucuggguucucuauucugcuccauucgucuccgugccuauguuuauaccaguaccaugcuguuuuggugacuauggucuuauaguauaguuugaaguuggguaaugagaugccuccagauuuguucuuuuugcuuagucuugcuuuggcuuugugggcucuuuuuugguuccauaugaauuuuuggauuguuuuuuucuaguucuaugaagaaugauggugguauuuugaugaaaauugacuugaauuugaaagaaaaagauuucuuuaggcaauauaggcauuuucacaauauugauucuauccaucccugaacaugggauauguuuccauuuguuugcgucaucuaugauuuccuuaaguaguguuuuguaguuuuccuuguaguggucuuucaccuccuugguuagguauauuucuaacuauuuuauauaagaacauuuugccuugccuuacauacagagauuuucucccacauuuauuuuuuaaaauuguuauuauuuuacauuuaauucuaugauccacuuugaguuaauuuuuguaugaagguaugagauuuagaucaauguucauuuuuuuucccaauggaugucuaaugcucuagcaucauuuguugaaaggcuggacuuccuucauuaaguugcuuuugcaucuuugucaaaaaucauuugagccuauuuauggaagucuauuucuggguccucuauucuguuccauuuuguauauucuucugccaaaaccauguugguuugauuacuauagcuauauagcccuaauauuggguggagauauauaucucuuuaauguuggguugguugauucuucccacuuuauuuuaugucaacauuguuuuagcuauuguagguccugugcauuuccauauaaauggagaucaaauaaguuugcuagaauuuuguuagaaauuuaauuucucaaagaucaauuugggcagaacugacaucuuuaccaugcugagccuuccaagucucuacucauuuaagucuuuaauuucuuucaucagcauuuuguaauuucauuauauaaacucuguaccuguuuuuauuuacuuauuuauuuauuuauuucugagacggaauuucacucuuguugcccaggcuggagugcaguggugcaaucucggcucacugcaaccuccaucuccuagguucaagugauucuccagccucaggcuccugaguagcugggauuacaggcacccaccaccaugcccggcuaauuuuuuguauuuuuacaagagaggggguuucaucauguuggccaggcuggucucaaacucuugaccucagccucucaaagugcagggauuacaggcaugagccacugcacccggccucuguaccuguuuuauuaaguguauaccugaaucuuuuauuuucuuuggaacuauuguaauugauacacuguuuuugauauugguuccuacacauucuuuguuagcauguaaaaauacgauuaacuguuguaugcauccugcacccuugcugaacucacuuguucuaggauuuuuguuguuguagauuucuagggauuauauauguagacaaucauaucaucuacaaagagagauuuauuucauuuauuuccaaacugcaugccuucuauuuucuuuucuugccuuauuguuuuggcuagacuuuccaguacugguugaauaaaagucaugagagugaaccuccuggccuuguuucuaaucucagggaugcucuuuagcaagucgagauaauucaucacuauuucuaaauugcugagaauuuuuauuauaaauagauguuggauuuugucagacgccuuuuuauaugaugauauuauuuacuuuuuuuauuuuuaauuucuuccaguguuuccucaaugaauuuucuucuguagcuuauuucuaugguauauuacauuaauuaauuuuaaaauguugaaccaaccuuacauaccuggcauauaauaaauccuacuucaucauauuacauaauucuuuuuauucuuugcuauuauuucauuaagaauuucugagucaaaauuuacaaaagacauugaacuauagucuucuuuccucccucccccuucuuccucuuccuccuucuucuucuuugccugguuuugguaucaggguaauaaugaguugaaaaguguuccugccucuucuauuuucuagaaaagauaauauaaaauuggcauuauuuuuuuuuaacauuugguauaauucuccagugaaacaauguaguccuagagauuucuuuuuugggauauuuuuaauuauuaauucaauuuuuuaaauagcuauaggacuaggcuagggcuguucauuucauguuggcugaguuuagcuaguuuuuuuuuuuuuuuuagaaauuggucuauuucuucuauguucguugaauauaugaguguaaaguuguucauaguauuuuuauuguguuuuagugaccacaggaucuguauuuauauuuccuauuuccuuccugguauugguaauuuuguuauugucaauuuugcuaguaguuuaucaauuguauuaauuuuuuagaagaaccuguucuuugucucauugacuaccuuuuucuuauuuuuaauuccauugauuuauucuuuuauccuuauuauuuccucugucuacuugcuuuuacuuuauuuuucucguuucucaaaauaggaacuuagguuauugaugugaggccuuuaaagacuuacucuuugaccuguugauaacuuagaaguguguuauaaauuuucauguuuuagagauuuuucugcuauuuuuuuguuauggauaacacauucuguaaaaauuugcuaagcauuuuuuauggccuaugauaugaucuauuuuggugaauguucuucgguugcuugagauaaaaaguauauucugcuguuguuggauggaguauucuauauauuucaauuagauucuauuugcugauugugauggcgcaaucuucuauauucuugaugauuuucuguauaguaguucuauuuguuguugagagaggacauugaaguccugaaauauaauugaugauuuauuuguuucucuuucaguucuaucaguuuuugcuuuguguauuuugaggcucuguuauuugguauguacauaagaucauuuugucuuccagguggauccauucuuuuaucauuauauaauguuccuucuuguuuccagauauuuucuuuguuccaaaguccacuuuuaucagauacuaguauaagcacuccuguuuuuuuaaaaauuaauauuuguaugauauauguuuuuccacccuuuuacuuucaacuuaacuaaucauagaauuugaagugaguuucuuguaggcagcauacaguuagauuauguucuauuauucacuuuguuuaucucugucuuuugaugguguuuagaugauuuaccuucaagguaacuauugauaaguuagcauuucacuauaccauuucauuacuuguuuucuauuugauuccucugguucucauuccucuguuucucuuuucuugccuuccuguguguaaccuaaacauuuuuuaggauuucauuuugauauacaguguuuugggaaguacuucuuuguauaguuuucacugugguuucccugaguacuaaaaccuaauaugugacuuguuacaggcuacauuaucaacauuuaacuaguuugaaacuucacucccauuuaaaucucuuguccuucccauuuuucaauaacauugaauugaguaucagaugguauuauaauuuuuguuuuaaucaucaaacaugauuuauaaaacucaaagagaaaagaacaguuuauuguauguacccacaaaugucuuuccaauguucuuucuuccuuccuaauccucuaagauuucaucuuguauuguuuccuuucuguuuaaagaacuuucuuuagccaaucuuuaagaguaggucugcuagcaacaaauucauuuacuuuuccuucaucugagaauguuuuuauuuccucuucacucuggaaguauaguuuuuccagacauagaauuuacaguugauaauucuuucaguacuugaaaaauauuguggcauuuccuucucaucuccauuuuaugagaaaucugcugucauuugaauugguauuccucuauagguaaugugucauuucucuuacugcuuucaagauuucuucaguauauuuuauuuuuaaaagauuaauuaugauauaucauagcacagauuucauugggauuacgugugggguucauucagcuucuugaagcuguagguuucugucuuucaccaaauuaguuaaguuuucagucaucauuucuucaaauacucguguuuauuuguuuguuugagacaggaucucccucuaucacccaggcuggaguauaguggcacaaucacagcucacugcaugcagccuugaccucauaggugcaagaaauccuccugccucagccuccugaguagcugggaccacaggugugcaucaccaugcccaauuuaucuuuuucuuuuuucuuuucuuuucuuuuuuuuuuuuuuugagacagagucucacuuuauuauacagggcagugacauaaucaaggcucacugcaaccucugccuccugggcucaaccaauccucucaccucagccuccugaguagcugggacuacaggugugcaccaccaugccugguuaauuuuuuuuuuuuuuuuuuuuuuuuuuuuugguagagacaggguuuuaccauuuugccuaggcuggucuugaacuccugagcucaagcaauauggccaccucagccucccaaaaugcugagauuacaggcaugagccaccaugucuggcugucagcuaaucaaauacucuuucagucccauuaucuuuauccucuucugggacuccaaugacaugaauguugggccauuugucauugucucacagaucucugggguccuguucauuuuuucagucuauuuuuggucuauugcucugauuggguggauuccauuguuuuguccucaaauuuaguaauucuacccucucuuaucucuaauuaacaguagauagucuaaccuaucguuaauacuauccagcacuauuuuuauuucuguuauuuuuuauuucuagaauuuuuauucaguuguuuuauaacuucuauuucuuuucuaauauuuucuauuuuaaaaaauuguaucaaaaauuugcagcugcuuuauaggucauuuauaugacagaugcuuuaaaauuauugucagauaauuccaauaucugauucaucuugguguuugugucaguugauugucuuuucucauucaauuugugauuuucuugguucuugguaugaaggauaauuuuuuauugaauccugggcauuuugccuauuaugauaggagagacuagguccuauuuaagucuuucguuguaagucaguaacccuguuaaauuaaucaugugggucuuggcuacuuuuaucagcuguggcuccaguggcacucuaauuuucacagacuuugagguguuauuuuguucugcuugauuaaucugguugcaagaggccacugguuccugccucuaccccacugccuuguggggcagaacagauuuccccacacugggccucagguaucucucagugggagaggaauacgguggggucugccaucugccucagugucuuugggcagggaaggagagucucaggcaugugagaacaaagaggcuuccuagaauuggccacuuuuugugguugcauccuuguugcugguuaugucuucuugccccagugacucuagacaggggaggaucauuugaggcacacagagaaaaagaggcuucccugacaguauuauuugcuauaguucauucuuuuuuuacguguucugccugcccacuucaguauuucuugguggaaagggagagucucagggcugagggagagcagaguccuuccucuggccaauuauuuuuggcgaggcuuccaauuaaucucuuuggcugguagcguugaacuugucugauaguuccagagggacauccgcucaaucaggaaaaaaaaaaaaaaaaaaaaaaaaaaucagccucccugagcugcuucuuguugccaggcuuggacuuaggaaacacucaguuaggaaacacucggucuaggugaccaucuucuguuggguugggacacucuaaacacucugcuacugugcuguuccuccaggccuagggaggccagcucauucuuuuuuuuuuuuuuuuuuuuuuuuugagacggaaucucgcucugucgcccaggcuggagugcaguggcacgaucgcuucucacugcaagcuccgccucccagguucacgccauucuccugccucagccucccaaguagcugggacuacaagugcccaccacuacgccuggcuaauuuuguuuuuguauuuuuaguagagacgggguuccaccguguuagccaggauggucucgcucuccugaccucaugauccaccugccucgcccucccaaagugcugggcuuacaggcgugagcaaaccagcucauucuuacugucuuucagcgcucucauuugguugucucuuguaccauuaccagaguugguaguuguucuuagcaggaaaaagcaggggaaaaugggucuacaucaucuuuucuggaccagaaaucuguuuauuauauuuuaauugcauauuuccauucauuuuuuggcaauuaacccuuuuagaucuuauuauaauuauuuguguacauccacggauuugaaacaucuugguaauuuaucuuuguguauuuuacagugccuugaacaaagcagauucuuccuuaaagguacuuauacaugaaugaauguucaugcauauuuucucuggggcuguacaauggaacaagaccuaccuguuaaaagagugguuguugguagaauguaaacaugacuuauaaguguucauccuugcaaauggacauaggaguaacagggagaaacuugcuuaaugugauuuacagaaaccugguucagaacauaggcucacuuggucaucacuucccucuggucaucacaaucucacaaucauuuuucugcuuucagcagaugggaacaugugauaaugcugugacagauuuccccaccauuacuuccuaaagccauuacccgcuucuagcuuaaaaccuugaacacacaaacacacacauauauacacacuaacauacacauacauguauguuucaagcauccaagauaggaaguaggggaacaugaugaauuuucuuuucuagaaauaaaacaaucauuuguccaaugaaagaugagcauaaaacacccauaccuaauaacaaauggcacagaacaacauugcugggaauccccaaauagaccucacgaaaacaucacugaagauugcaugugagagcuagaaggccucaggcagggaaugccauggaauguaagaccaggccccugcuggggcucagaaauaggaaugauagaaaagcaagcaggaagagacccugggcaauugaguucucccacugagcaagaaagaauugaaaauaacagcauuaggcaggaaaacaauggaugccugaccucccauuuaaccauuguaaucaugcauuguuaucaauuggcuuggucuuuuaagauuccuagucacuugucccucauaucuguggcacauacuuaucacuguguggauuugcuuuuuggcaaacagaaguuuuaauuuuuaauggagucaaaucuauuacucuuuucagaaacgaucuuucucuuugucuucaaguuuaugaaguccccucucacuccaguagggauaaauacucauuucuauucuggguuucuaaugauugauuuuauacauuuauuuauugcuuuaauccagcuggaauuaacauuagcauaugguguaggaagacuguaauucuuccaacucuaaugcauucuugauaaguaaaaaauaggauuuccuacaguagaaaacucagccuagaaaccugccuuucaguauccugaggcaggaauggagugaaugaggcacuuuccucaaaccuaaaaaccucauccuguuuuacuggggacuugggauaaccuucuuuauuucucagugucuccuccuuuguguacaguagcgacacaaauauccacuguguuuccaaagagaagucaagugcuuaagcuccucaaauuuucugaguacauucuauguagaggauuuuccauuacugguuacacuuaauacacagggccuugcuggagaaugugaccaggagaacuagaacuucagaaaacacaaaaugagcuaucaaaggcuuggcacuuuguagggguguaaucagaagaaaaacgaguccuaauauuuagaacacauuagauguaaccucuuaaacuccaaaguucucuucaaaucuuaccuauuuaauuugaaagcaagcaauguuccaguguuaacauuucugauuugggggaugccagauagugaaauuuggauuaaacagagggaauuuauagucuuauucuaauuaauaaauggacuuaacgggguucugaaaauaaaacaaccucauaauuaguugguaauuaacauagcuaagagccagguagaacuguccaaccugugucauauucucacaggugugcccacaaaauacaauauuauauagaauaaauacauugcccaccuucauucauccagcaagauguacugacuuuucacuguaggcaugaaccugaagggaauuaaaaaugaaggaugguccuugcucucacaaaagcugccaaauuggguacacucacucagugucuucaaggaacacauggucagguuucuagauuaugcuuaacuagauugggagaguggauuacccucagaauacccuugauaaaagcuuucaaaauuuuccuuuacucacaaaaccauguuuucagggaaccuaaacagaaguccaauauauaagauagaauaauagauaaaaguauaaauuauuuggucaaaugaggacuacuaguguucucaaaacacuaccccacuuccaaaauacacacauacacacacacacacaauuccuggaacuuuacagaguagaguuucaaaaucacugcagcugaugaauugacaaauagaaagaagggguaacagauagguacaaauguaauauaauaaacacaauagaauguuaauguuagacaccaagcggugguuacacaggguguucacuauaaaauuacuucaguuuucauauacguuuaauuuuuucauaauacaauauugaaaaaaaaaucccgcucuugauuccuauaucugaaaguucuuaaaguuuuaguugaguaaacauuuagaauuauuggccgggugcaguggcucaugccuguaaucccagcauuuugggaggcugaggcaaguggaucaccugaggucaggaguucgugaccagccugaccaacauggugaaaccccaucucuacuaaaaaaaaaaaaaaacacaaaaauuagccggguguaguggcaggcaccuguaaucccagcuacuuggcaggcugaggcagcagaaucacuugaaaccaggagaagaagauugcagggagcugagaccaugccauugcacuccauccugggcaacaagagcaaaacucugucuugaaaaaaaaauuggaauuauuauuuguucuuaauugaccccuuuaucauuaugauaugucccucuuuaucuuugguaaaccuucuugucuuaaaguuuacuuuguguaauugauguagccacauuggcuuucuaaaaauuauuucuauaacauauauuuguauuccuuuuacuuuuaacucuuuguguuuuuguauuuaaagugcauauguuguagucagcauauuauuggguuuuauuuauuuuguaucuuucaugcacguccgugugaagagaccaccaaacaggcuuugugugagcaacauggcuguuuauuucaccugggugcaggcgggcugaguccaaaaagagaguuagcgaagggagauaaggguggggccauuuuauaggauuuggguagguaaaggaaaauuacagucaaaggggguuuguucucuggcuggcaggagugggggucgcaaggugcucagugggggugcuuuuugagccaggaugagcuaggaaaaggacuuucacaagguaaugucaucacuuaaggcaaggaccagccauuuacacuucuuuugugauggaaugucaucaguuaaggugaggcagggcauauucacuucuuuugugauucuucaguuacuucgggccaucugggcguauacgugcaagucacaggggaugcgauggcuuggcuugggcucagaggccugacaguauccauauugacaaucuaugacuauuaauugggacauuuaguccauuuauauuuaauguaaugauauaauucaguuuuaagucuaccaucugaauauuuaugccaucuuuuuuuguuuccuucuuccuucuuucuugccuucuuucuguuaaaaugcauauuucuaaaguuuccaucuuuauaccacuauuaggguuuuuaauuauaccucuuuguagcgugugugugugugugugugugugugugugugugcaugcaugcucuaggacuaacaauaugcauccuuaucuuaucaaaaucuaccuaaaauuaauauuauacuaucucauguaaaauauaagaaccugacauuuauuacuuccuuguccauuaugcugucacauguuuuacuucuauuugcauuauaauccuuucaauacauugucaugaguuuugcuuuaaauaguaaguuaccccguaagagcuuaacagaaaauaaagacgguuuaaaaauauauauauuauuccauauauuuaccauuucugugcuccucauuccuuccuguuaaucuguuuccauuugcuuucacuuucuuuuaggcugaagaauuugcuuuaacauuucuuauaaugcggguugacuagcaguacauuuucuuagguuuuguuuaucuaaaacuuagguuuuguuuaugcagccauaaaaaggaauuagaucauguccuuugcaggggcauggauagagcuggaagagaucauccucaacaagcuaacacaggaacagaaaaccaaacacugcauguucucacucauaagugggagcugaccaaugagaacacauggccacagggagggaaacaacacacacuggggccugucuggggugggauggggggcagcggugggagggagagcaucaggauaaauagcuaaugcauguguggcuuaauaccuaggugaugguuugauagguacagcaaaccaccauggcaaauguuuacauauguaacaaagcuacacauccugcacacguuucccagaauuuaaaauaaaauaaauuuaaauuuaaaaaaagaauuuaaaaaugucauucuauugucuucuggcuugaauaguuuuuauuuaggagucuaaaauaacucuuacuguuguucuccuauauguaaugucucuccacuccucccauccucagcagcuuuuuucuuuacuuuuggauuuuuaucaguuggccgucauacauccagguaugguuuucuuuguuuuuauccugcuuugguuugcuaaacaucuucaaccuguaguuugauuuuuucacuauauuugggaaaauuuguucauuuuuuuaaacuauuuuuuuuccucccucauucucucuauccucauuucuggaccucaaauuguacaaauguuagacuucucgcuuuugccccacagaucacugaagauucauauauuuuuucuauuuuuuccuccuguucuucagaucagacaauuucuacugaucugucuuaaaguuuccugaucuuuucuguaguuucuaauauguugcuaaggccauucaguaaacuuuucauuuuggaaauuauuauuugcaguucuauaauauagauuuguuucuuuuuuauaguuuacauuuguuucucugagauuucccgccucuucauuuuaugucacccauuuuaugucaaguccuugaauauacuuaucuaguuauuuuaaauuccucauuuucuaauucuaaugucugaguuauuucaaagucuguuucuauuuauugcuuuuuucugauuaauggagcuuccucuucacacauccaguaauuuuuuuguuguaugcuaaacacagggcgacacauuuagggaaucugcauuauauugucuuccuuauaggguacugaguuuuuuucuggcaggaaauuacauuucuaaaauauucucuugaaccuuucauuguuagaacuggucuaguucaaauuuguccuuaguuguagaacacagccuuaugguaguguacaggucucacuccugaggcuggccuuucugggguuucaacugaaugcccagguucucagggaaaucugcccucucagacuaagaauuccaacgucucccaucucugggcaaccacuagugucuuuguucggcucuuggucccacagugaacccucucugcuaggccucauggugucuugcccugcuuauacauagucaauccuucagacaaugaccugcaaagaaaccuccauguacacuaccuccacaugcccuaccucaugcaucucucuuauucaguacccuacucugcuaauuccagccccucagcagcaacaaaguacaaacucugccuuaucaguucauugaaacaagcauguaaugcuuggccccaccuccuuacuagccaguccagugaaugcaccccuaggcagaaagccaaggugaaugcaaggcuugccucagggguuuaccuugucucaagggucacagcccugcauugccuguuagccaauuucugaaaacaguugccgcauacauuuuaucuaauuuuauaguuauucaugaaaugaggucaagaaugauaccaguuacuucauuguggcuugaaaacuaaaaugcuuuaguaucucucuccacuaccaccaucaacacuugaacuuuacaaaugauccuauuuauucuaccaccugcuacuaaaugaugaaaaauaauuaucaagugaguugccgaggcuuccugcucuuauuucucuuaccauguucucagauaucugacugcuagcuaaugucucugcccgggaacaaaagaagccagagaaggagaaagaggaagcucaaguucucccauauucucucuuuucaaaaguuacgaagaguagaaaauaguuuaacaaggaaguuuagagauuacaugaaaauuguaaugagucugaugcaccagcuuccaauaccgucaucacaaccagcccuuccuuggugguaguuauguauugguugcaccugauaccuaagcaguagucugcucucuuuugcaauaaaucacaucugucucuaugauagacucugaccucagccuaccaacagcauguuuuuuaaugacacuggcuugcaaaugcaucugauuugaaauaaacuuucuuuguaccauuuuuagguucuguacuuuugaauaaaggugcaaucacagcaaaucaaauucucagaagacuacaauaaguaaacauuaagcaguguuccuuuuugaaagcaggagagaguauauguuuaggaauguucaaggauuagucugguucuuuuuuaaguuuuuauuuauugauuuuaucuuaacagcaaaauacaaugccuggcuagagccuuuaaauacagauaaacaauccaaacaagcugcaacuuacguauaucaaucuucuaagaucaccucagaaaagagaagguggcucccaacuugucccaaguuaaauacauuuaagagaagcaaaugggaauagcagcuaaagcugacggacagggcaauucgaggcaucagaugcucccuuucagguugcugagaugcuuccagaugguuccuguaucugcauggccaaagugguauaauuuauuuucuuagcuuuuucaaucucucugcauauuacaucacaauuuuagcucaaguuuauuuuuguuguguguauuugacaauccuuuggugguguggaacuuaaaucaucacuucccagagcaagaaaacaaaggcugacacuucugauauagaaggcugcaaucuggaaaggacgaugguuggaagggcagguggaugauugggaccaccacuagguuuauucuuuauuuguucaacauguuuucauuaaauuaggguacagagguggacaagucagaagcagucucucucauuauggaguuuacacucuaccagaggugagaauggaggacuuaaagguagacaaaaaugccuaaugugucaccuagagaacacaaccaaaaaugaguuacccaacaacuucauacagcugcuaccugcaguuaguauguacaugccagguaagcuaggaagaggccuacagccucuccuggaaaaucuugggagaccaaauagguuuugaucuugaccauucccugaaaauccucaucuauaaucuucaaaugcaagaaggaaccaggaggugccauuauguuucaccacaagaacucauuuuuuuuaauuacuguuuuuuucuuuuagugagcauaauuuuuucuuuuguuguuauuguuguuauuguuguuuuugagacagggucucauaaugucaccuaggcuggaaugccguggcgccaucuuggcucacuacaacuuccgccuccuggguucaagggauccucucaccugagccuccauaguagcugggauuacaggcauguggcaccaugcccagcuaauuuuuguauuuuuuugguagaggugguguuuugccauguugcccaggcuagucuccaacuccugggcucaauugaucugcccgccugggccucccaaaguguuuggauuacaggcaugagccacugugcccagccaauuuuuuaauuacguaaauuaaagggguacaagugcaguuuuguuauauggauauaccgcauaguggucaagucugggcuuuuaauguaaucaacaccuaaauaguguacauuguacuaccucacuccccucccaccccaucaucauucugagucuccagugacuauuauucuauacucuaugucuacauacacacauuauucagcucccacgugugaggacaugugguauuucacuauguuucugaguuuuuucacuuaagauaaugaccuccuauuccauccauguuguuguaaaagacauguuuucauucauuuucuguggcugaauaguauucuauuauguauacauauauacacacacauauacauaaauaaaaugugcuguauguauauauguguauauguauauacaugugguguguguguauauauguguauacauauguauauguguauguguguguguauauauauacauauguauacacuuauauacacacacagagcacauuuucuuuauuuaaucaucuugauuuuuuuggaagaguuucaguaggaugaguaucaguucuucuuugcacauuuuguagaauuuggcuaugaagccauccaguccugggcauuuuagggggaagguuuuaaaauuauugauucaaucuuacuauucauuauuggucuguuuaagauuucuauuucuuucugguucaaucuugggcagucauauguuuacaagaauuugucaauuuccucuacauuaucuagauugugaguguacacuucuucauaguagucucugaucaucuuuuguauuccuaugguaucauuuguaaugucuucuuuuucauuucugacuuuuauuuggaucuuuucuugguuaguacagccagaggcuuaucaauuuuguucaucuuuucaaaaaaccaacuuuuuguuuaacuuauccuugguauuguuaucuugguuuucauuuucauuuuauuuuuauuuuuaacaaccaauuuauaucauucaaacagauagaacugccuugugcuuguuucagccuuguuuucugguuauuaaaagaagaccugaaccagauacaaauucaccauauuuuccuucaaggacacuucucauaaaagcuacuaauaugcauauuuuggcauacaaaaucacauuugcuaaaacuuuuuucugcuuaaauacaauucuuuuuucauuuagcaacugcauguuauuauagaggucaauucauuggguuauaagagaaaagaaacacuuauugaagauucacaacauacauuccauuauauaucgcuguucaauagaaugcaaaauuaguaaauaucaccccuacaauuggaccauguaacugauagauuuuccuguaaggaguuaccaaaaugucaucaaaaucuagaguuugacaauuuccaggccuuauccugaccuucucaaugcaaguugcacaaaugaaaucaguuauccaagagaaaaacugggauagaaauagggguuaauagauuaugauccuaaguugaaaaauacagagcucucaguuuccaagauuuaccauuuucaagugucccuaauuuugucccaagaguggcuccagccugggcaugacagcuggcuguaauggggacagauagcucuuucuuucuaagaacaagauuuaccauuuguuuugucugcucucuccacaagcucuuccugaaacauaucaguggcauaauaaauaucaucucguuuuccaucuuaaggacuuuaguacucaaagguaacuguuuugaguccuuaaaaaaaaaaaacaagcaaaaaaaaaagugguuugcaaacuuuugucugugacauaacaccaaagccguaguaaagucaaugauaauaauaauaauagguacuuacuugggcuagggacugugcuaggcuucuuuucauucauuaucucauuuaauauucacaguuccuacauggcuuaguauuucuugcagacccuuuaaaugcuuacauauagaaaucugcccuacuauuucaaguauaggcagaaguuggcaauacaagaaaagacaaagggauaagaauccguccaacuggacaaaacaacuucaauccuuaaaaaguccuacccauuuuagaaacaggucaaugaagcuaccuguuaugauuguagaagucaugucugcuuacugcaccuaauuugagaauuacagaaaaacauuuuuaaaaaucacauauuauucuaucacucagagauaaacauugauaguguuuuuauaguucccagucuuauuuauauauuugccuucuuuuuuugcuauuuguuuaauuuuuaaaccaaauucggauuacauagcaaugcaauuuucccauauuauuagauauaauuuuugaaagauuuuaaaacacuaccuuauguuccauaauuuauuuaacaauuucacuguuuacugacagauaauuuagaguacuuaauuauucuauaaauacuauaauaccaaaguauaauaaugaauuuuugccugcaucucuauuucuuuaagaaagauuucuauaaaugagauuacuagaucaaaaaacauuaaaaaauucuuuuucuagggagaauauccccaugcccaauuccacuacauuugccaacuagcugaaaaugaugggguuuuuuuugcauguuuuaaauuguuauauaaugguauuagauugcauucuucugaaacucauuuucaaaacaucuuuacucaacauauauuuauaguuauucuuguuacuauauguuguuuuuacucauucuuuuuuugcuuuucgaaaaucgucucuuaguugaauaauaauauuuauguauuagcuauuggugaacauguacguuuuccugaauuaucaaaaagauacuauuguaaguauguugugcacauuccccuuggcaugugggccaugggaguugcaugucuucaacuauucuggaugaugccacacuauauuccacaguggcuguaccaguuugcucugugaaugauaaucuucauugcuuuacaaccucuccaacaccuagaauuguuagauuuauuuuucccuuuaauuuugacaauuggauagauguaaaaagcuauacugugcugauuuuagaaggcauuuccugauuacuuuugcaguuguacauucuuucauucauuaauuguccauuucuguugcuucuccaauuuauguuucuucagaccccuuaguuauuuuucuauugauuuuuauuucugauuacuuguuuguauuaacucuuuuuauauuucauauuaauuuucuacuaugaaacauucugcaaauacaggcauaaccugaaugauguugccucgauuaacauuuucaugguaaaaugacucuugguuuuuaaaauccaaauuucaucaucuauuuuuuuuuuuuugccaauguucauguagcaaaacuuuagauuuauaauaccaaacucugcaaaacuuucaauaaaaggaaauauaggaaaaucaucaagauauuuucaaaacauauucaguagaacaucagaauaauauauagauauuuuggaaagcaagcugagugacaacacacgaaacacccauuucagaaguugcugaugcuaaaaggccaucauaccaucagugugagccacacuuggccaccaggcacuagagcacauuucccagugccuuccccauuuuacuuuuuuugcuuauuguugaaauccccaaauuguugagaaaacacugaagacaauuguagagaagaaaacaaaacaagugagaauagcuacuacguacaaagcaaacauuuuauaacauguuaauuguagaagucaucaaggauauaauuuuuuuaaguacaagugaucgaggauauaauuuuuuuaaguacaggcauaccuuguuuuacugcacuuuguuucauugcacuucacagauaaugugguuuuacaaguugaagguuuguggcaacuuugcaucuagcaagucuauuggcaccauuuuuccaacagcacguguucauuucacgucuauguaucacaauuugguaauucucccaauauuucaaacuaauucauuauuauuaugucuguuguggugaucugugaucagugaucuuagauguuccuauuguaaguguuauggagcccaauauaagauggugaacuuuaucaguaaauguuuguguguucugacugcugcacugacuagccauuuuucccucuccucaggcuucccuauucccugagacacaacaaauugaaauuaguccaacuaauaagcagacaacagcuucuaaguguucaagugaaaggaagagucccaugucucucccuguagaucaaaaauuagaaaugauuaagcuuggcgaggaaggcaugucaaaagcugagcuaggaugaaagcuaggccucuugcaccaaauagccaaguugugaaugcaaaggaaaaguucuugaaggaaauuaaaagugcuacuccaaugaacauacaaaugauaagaaagugaaacaggcuuguugaggauaugggaaaguuugaguggucuggauagaagaucaaacuagccacaacauucccuuaacccaaggcuuaaaccagagaaaggcccuaacuauauucaauucuaugaaggcuaaaagagguaaagaagcugcagaagaaaaguuugaagauagcagaggcugauucaugagguucaaggagagaagccaucuccagaacauaaaaggcaaagcaggaagugcuuauauagaugcugcagcaaguuauccagaagaucuagcuaagauaacuaaugaagguggcuacacuaaacagcagauuuuuuuuuuuuuuuugaaacauagucucacucugucacuagggcuggagugcaauggugcgaucucagcucacugcaaccucugccucccggguucaagcaauucuccugccucagccucccaaguaccugggauuacaggugcccaccacuacgcccugcuaauuuuuuguauuuuuaguagagacaugguuuccccauguuggcuaggcuggucucgaacuccugaccucauuauuugccugccucggccucccacaaugcugggauuacagggguaagccaccacacccggccaaaggcagauuuucaagagagaugaaacagcccucuguuggaagaagaugccaucuaggauuuuccuagcuagagaggagaagucgauaccuggcuucaaaucuucaaagaacaggcugauucuuuuguuagcugcuaacgcagcuggugacuuuaaguugaagccaaugcucauugaccauucugaaaaugcuaaggcccuuaagaaugauacuacaccaacucuucauguucucugaaaagaaacaggaaagccuagaugacaguacaucuguuuauaguaugguuuacugaauauuuuaagcccucucuugagaccuauugcucagaaaaaagauuccuuucaaaauauuacugcucacugaaaauguaccuggucacccaagaguucugauggagauguaaaaggaaaugaauguuguuuucaugccugccaacacagcauccauucugcagcccaugggugaaggaguaauuuugacuuucaagucucauuauuuaagaaauacauuuguaagacuauacauagugauuuaucagauugaucugggcaaaguaaaaugaaaaccuucuggaaaggauucaccaugcuggaugucauugagaacauucaugauuuaugggaggacaacaaaauauuaacaugaaaagguguuugggagaaguugauuccaacucucauggaugacuuugagggguucaagacuucaguggaggaaggagcugaagauguggaagaaauagcgacaacuagaaucagaaguaaagcuugaagaugugacugaauuacuguaauuuuacaauaaaacuugaaugagugaggaguugcuucuuacggguaagcaaagaaaaggauuucuugagguaaaaucuacuccugaagaagauguuaugaacaucguugaaaugacaacaaaagcuuuagaauauuacauaaacuuaguugauaaagaaggguuggagaggauucacucauuuugaaaggaguuuuauuguggguaaaaugcuggcaaacagugcuguaugcaacagagaagucauucgugaaagcaagaagccacugauguugaaaacuuuacuguuuucuuacuuuaacaaauugccacagccacuucugcccucaacaaccaccagucugaucagucggcagccauaaauaucaaggcaagacccuccaccagcagaaagauuaugacuuacugaaggcucaaaugaucaccaguauuuuuagcaaaaaaaauuuuuaaauuaagauaacauauuuuuuuauaaugcuauugcauacuagacuacuauagacuguaaacacaacuuuuauauucacugggaaacaaaaaaguuugugugccuuguuuuauugcaauauucacuuuauugugauggucuggaagugaacaugcaguaucucugagauauagauaugccugcauuuuaagucucagugugacauuauuguucuacuaugguuauuuuacuguguuuuacuuacacuucaagaaauucacuagaggguugguuugacauauaacacauuuuuucccauuuaaguaauggcaaacugucucaaggaaaucauuuuuggguaauacaucugaucaucaggaaucaauuaguaacaucaaacaaggggugucuauauuuuuuucucagcauguuccuuaucuuuucuuuguuugcuuguuuguuuguuuucuauuuuacaugucucauuuaauccuggaaaaaugcuauaaaguagcuagcugauucuaucuuacagaugagggcacugagauucagagaggucaguagcuggcuuuauuaucuucuucacuguggcugcaauaaaaaauaaccacaaacuuuguggcucucacagcucuggaagccagaagcccaaaauuaagauguuuaagagcaaagaucccuccagaggcucuaggagggauuccauuccuugccacuuucagcuucuggugguuggugggacucuuguaauagcauuuaggucucccaaaauaauccaggaugauuuccucaucucaagauccucaauuuaaucauaucugcaaggaccauuuuuuuugcaaacaaggucacauucacaagcucuagaaauuugauguggauacguuugcagagccaauauucaacuuggcacacucaccgaaggccacauagcagaauacggugucaaguccagauauaggaguuccagacuccagaguucauguucuuuccacuccaugugcgguuuuccaucacauugugugaccugucgucuccaucccuccucacaccucagauucccuuagucuucccaaccucagagugagguuaauacucuguucucuccgugccagggucucuuccaaggagaguauucaagagcugugccaccccuuuacaaauuccauugcgcauccgugacuuccuuuccaauacccagacaguuuccugagucuaguucacagacuagaucaccaaagcaaccuuccugggaguaaauauuacaucuuucccauucauauuaguuucucaaaagugcucaagagccugaagaaugacagaagagaaaugcuaaagauugaaggaguucagaacacaauacuccaaaauauguugcucuaguauauugacuauuuugagcuuaaagacacuuggaaaaacagcagauacaaaaaauauacucugagcuuucuucuuuuccuuagaaacaggagauaacuuguccucccuacgccagagggaaaguagcguucuuaucaucaaagacgagaaguugaugcugagagaaaucugaacaaacacaccuuauuaaaguaacccuuaucuuccuaguuacuucucuacccaauuaaccucccuagcccaagcccguuggcuuugucacauacucacaauuuucuauuccuuucccaauucaguacauagguguucaacuuucaacucugucuuuggguuucauuuccuuaagagggcucuugugcucacauaaaaauugaaugaauuaaauuuguaugcuuuucucccgcugaucugccuuaugucaauucaauccucaggcccagcuaaaaaacccuaagagagaaaauuuggccuccccuacaaugucauccucuuucuuuuuucuggaccuucuaucugcugguacuuaagauacuaaaauggacgggagaaagaaagcaaaccauguuaugucuucugcauuggccugguacacuccguuugaagguuacucgaagccagcuugcuuuuugucaagagauugcuugaucuggagccauauagaaaauggugacaucuccaccccgugacauaugggccaguaagggcuugcaaaguuccauucugcacacuucucuucauucuaagaacgaguauucauuccauuuaaacacauauuaccaggaauucaauccaaccucucuuuuuacagucuaccuagaauuacuauuauacuauuuacauacaauauggaaaccucacacauguaugaaucuauuuacaaacucccucuaaauucaaguugucauugaaauuacaucuaccuguauuauaaaucccauaaaaaugaugcuauaguuuuuacuuaaacaaacauacauauucuuaaaacauuaggaggaaaaaauugauuuuuauauuuaucuuacuauuuaugauuucuuuauuuuuacauaaggaucugaguuuucaucuauuuuuucuugucaucccaaagaacaaagcauuuuuuacaguguaaguuggucugcuggcaauaaauauucuguuuuuguuuuucugaaugcaacuuuauuuugacuccguuccugaaguaugaguaucuuuggauauggacuucgggauuggauagucauaucuccuuacagcacauugaagauauuguuucauugucuucuugcuuucauaguuuuugaagguagguuggcaguauuuagcagugcaguuucauguauauaguguguuguuuuucuccggcuauuuucaagauagugucuuggguuuucagcaguuugauuacaaugugccucagcaucuugaacguguacauuuaucucucaccaauuuugggaaguguguggggccacuguuucuucaaauauuagguuggcacaaaaguaauuguggguuuuguaaugaaaaguaauugcaaaaccacgauuacuuuugcaccaaccuaauauuuuuaugacccauucucuaucaccuuuccuucuggggaaccaauuacucauauguuaaaagaauuaucccauaggaaccugaggcucugguugcuuuuuuuuuaauccuuuuuaaaaauacaaucucuguucuucauagagaaaaucuauauugauauuaucaaauucacugacugcuuuggucugccuguguauguauauuccaaaggucagccagagauuugagcagaauuuacaccaaaaauuuguaaugcuccuuuucuggcccucuuuuuaaugacauuccucccuuacuuuccaguagcugggguugcuccaaacucuguccccugguucauaaggccagaaagacugagcuuccuacaggaguuucagccacucuguguggcccuaccuguggcuugaccucaggauaauagucauaagaaauuuaaccuauacuacuuccaggugucuucaacccccuucgagaaucuugcugccuuuguucauucuucagaucccucagagaguuuuguuguugcugcuguuuguguuuugugaggguuuacagacuacaugggaagcagaaauuguucuuugggauuuaacuuuuacaaaaaucacaagcacucaucucauuuguggcagugaaaguaauauuuacaauguuaacguuaaauaacauaccuugcuacagguuuccaguaaauaucuuguauuaugcugcguaagcuccuccuauuucuagcucauuaaauaaauauuauuugcuuguuggucuuauuuaacagaaaaaaaaggagucucuauuuauuaauucauuaguuuuauuuuccacagauugauuuuguuacucuccuuuaauaaugaaaguucucagggcuauuaauuuucugcuaaauacagcuuuagccauuuaaaauauugauacauagaguucuuacucuccuaacaguuuauuauauaguuuccuuuccuguuugaaucuggaguuuuuagaaaaaaauuugguuuuuguuaucauuauuucucuuuuccaagcuacugauuuuugcauuuaaacuuuugcuauuaaugucuagcucuauuucaguguaggcagaacauggaggcuguuaacacuuuauauuucauaauuuaauaugguuucuuugagauauaauauaugaucaauuuuuuucuaaaugcuucauggcuccuuaaaaaaguguauugcuuauuucuagagaacaaaauuuaauaaauauuuauuaaaucaucuuuguuagauuauuaaaauauucuaucaauucuguguuuauuugacccaugaaagaucaauaaaaguguauuaaagugucauacaacaauucuacuuccaucaauuuuuccuuauauuucuaacagccuuuguuucauguauuuugaggcuguuaccaagucaauaaaaauucagaacugccuuaucuucauugugaagucuaucuuaaagaaaauauaaccuucuugauugcauuuaauauuuuuauagccuuugauucuauuucaucuaaauauugccaagauuacuuuuuuuuuuaauuucgcuucugccuaauaaaucuuguccauucuauuguucuuucuuuuuuaaucuaaugaguuacuuuguuuuagguauauuucuucucaguacccuacaguuagauuuugcuuuuuagcugaaauauacaguuguuguauuuuaauagacuaguuuaauaaacauuucacaaugagauucagcuuuacacaaugcuuucacauuuauauuuccucuuuucaacauaucagguacaggggaaaugucauuccuauguuaugcauaaggaaauucaaagccagauagguuagaugcauuucccaaggucauucagguaauauauggcaguggcaagacuuaaccaaaggaugauaauacuaagaaaauggcuuuuuacaaacauauacuauccccuugcugaacaucaauauucagauagacuauuuggucaaauuauguuuuguguuuuuuuuuuuguuuuuuuuuuuagacagaguuucgcucuuacugccccagcuggaaugcaauggugcaaucucagcucacugcacccuucaccuccuggguucaagugauucucccgccucagccucuugaguagcugggauuacaggcacucaccacaaggccaggcuaauuuuuguauuuuuaguagaguugggguuucuccauauuggccaggcuggucucaaacuccuggccccaggugauccacccaccucagccucccaaagugcugggauuacagguguaagccccuguguccggccauggucaaauuaucuaauuuuucuuccacugggggacuuuauacuauuuauuuuuauugccguaaaugauauguuuguaacacuguaaucuuauuucaugcuuuguguaguuuaugcuuuacucuuuuuucuuuguuuuauauacuauuggcccuccuugucuguggguuccacaucuguggauucaaccaaucauggauugaaaaugcucagugauaugguguggcucuguguccccacccaaaucucaucuuguagcucccauaauucccuuguguuguaggagggacuugguggaagacaauugaaucauggggggugggucuuucucaugcuguucuccugauagugaauaagucucacaagaucugaugguuuuaaaaacaggaguuucccugcacaagcucucucuuuuugccugcugccauccacauaagaugugacuugcuccuccuugccuuucaccuucugccaugauugugaggccuccccagccacguggaacugcaagucaaauaaacgucuuuguuugugaauugcccagucucagguaugucuuuaucagcagcaguaaaaaggacuaauacacucaggaaaaaaaaauggcaucuauacugaauauguacagacauuuuauugucauuauucccuaaacaauacaacuauuuauauagcauuuacacugcauuagguauuauaaguagucuagagauaauuuaaaguagucuguagguuacaugcaaauauuaugccauuuuauuccagggacuugagcauccacaaauuuugguaucuggaagcaauccuucacagauaccaagggacgacaguacuuggugauuuagaucaggcugcacauucuuuucucucuccauugguuuggaagucaugcauccuacuuuuguuucuaauaguggcaccugguauaucaaaaagaauauuaauauuuguugaacgaauacauuuuaaaacuuucaaauauuuagaauauuugagucuaccccuagaaaaaugagaauuugucacaaauuuauuucuggaccuuguaaauaugauccuggguuucuuauugcuuaguguuaaauauuaagguauuaaauauuuaaugcuuauuaaagcauuauuuugugugacauauuuucucuuucaaaagcauaguuuuacauuugcauucaguauuauaauuaaaguuacaaucacuuaaaucucacuuuuuguuaacuugguuuaauuauuaacaaccagccacuucucuguuacugaauucuuuuguuguuguugugguuguuauuuaguuuuuauuucauaaucauaaacuuaacucugcaauccagcuaggcauggaagggaacaaggaaaacauggaacccaaagggaacugcagugaaagcacaaagauucuaggauacugcgagcaaaugggguggaggggugcuccccugagcaacagaagaaauggucuggugguuaagauaaaacacaagucaaacuuauuagagcuguccacagucagcaauagugaccuucuugcuagucuugccauuccugaacacaaagcgcuccauggccuccacaauauccaugccuucuuucacccugccaaagaccacuugcuugccauccaaccacuuggucuuggcagggcacaugaaaaacugggaaccauuugcguuggguccagcauuugccauggacaggaugccaggaccuguaugcuucaggaugaaguucucgucaucaaauuucucccuguagauggacuugcuaccagugccauuauggcaugugaagucaccacccugacauacaaacccuggaauaauucugugaaagcaguaacccucauaaucaaauccuuuuucuccagugcucagagcaugaaaauuuucugcugucuuuggaagcuugucugcaaacagcucgaaggagacgcagcccaagggcucgcuauugacagcaaugucgaagaaaacagugggguugaccauagcugguaauacggggcucccaguggcagcaccaucugugaagucucuguuacugaauucuuaacuucaauuucucucucaguuaccugggcagugcuuccuaaauguuaguauguuuaagaaucuccuagagagacuguuaaugcacagauugcuacaguucauccagaguccuaacuguucuaagcaguagguuuuauagcaauauuuuguaccauauaguguggccaaaaaaaaaauaucugauuuuuugcuccuuuauaaggcuaacuguuuuguuugccugugugugugaaggauuuuuuuuacuuuauucuuuaaaaaauuaccaaguugaaaugauauaaaacccuuuucauuaauguugccuggaguacggaaagucccuucaauuuuuguuuuuugguaucggguuuuguuuuuguuuguucguugugcuccgaagagcuuuuauuaaucuuucacuacuauuuguguucuaauugcuucugccucaagaacaucugugauucuuacuuugguucuggguguucaaaucuaugaucucuauuuucuauauuuuuaaucaucucuuuuguuauuuuaauuuuuauugcaccuguucauuucaacagaaauuaucaauuuuuuuccccucuugauuuuuucuuuuucuucuuuuuuuuuuucuugagacagggucucugucauccaggcuggagggcaauggcacagccacagcucacuguagccuccaccuccccaggcucaggugaucuacccaccucagccuccuaaguagcugggacugcaggugugugccaccacaccuggcuaauuuuugccuuuuuugaagugacagguuuacauguugcccaggcuggucucaaacuccugggcuugagcaaucugccugcauugucucccaaagugcugagauuacaggcuugagguaccacaccuggccaugaguguuuuuuaaauagugauuucuuuucagcuuccaacacagacuucaauuguguuaugacauucuggucucuuuacaauauuuucuugacuaauccaucuccuuuuccaaauaauccuacuuuuuacaaucuaaacuuauucucucauuucacuuucuguuuccugaugcuguugaggaugacaaaaaaucccuucagauuucugugacauaucaucuugggaggucaacauuuacucugagucucugagauacuguucccuuuuccuuguccauaaugauuucuuuuuacuuuaguuuaucaugaaagagaccguguuugccaagaaaaagaugaagauugucuuuaugugucacuuaaacauaaaucucuuacagcuaaaugacauguugguuuacaaaacuuauauccuaauuuccauccucuagcagguuuuccaccuagcauaccuguugggauuggcauagacucaucuuguaucacuaccugcaucuguauuaugaaaaacaacaauccccaaggcccucguaguuucagcauagauauagugcuuuaacugugacagauccugacaaacauauuuccaaaaauauuacugcccuauuuaguaagcaggauaauggucuuccaaaggugucuacauccuagucccuaaaaucugugaauguguuagauuacauggcaaaggaaaauuaagguagcagauagaauuaaguuugcuaaucgucugaccuuaaaacagggagauuauccuccaguaccagggugggaccaauguaaucacaagggucauuaaaucucaaaaacagaaguagaauagucagagcaaugcaauaggaaaaagaguugacuggccauugcugauauugaagaugaaagggggccacaagcuaaggaaugcaggcagcuucuggaagguaggaaggacaaggaaacacauuuucccuuagagaccucagaaaggaauucagccuaacaucuuagcccacuaauauccaucuauuucaaacuucugaccucccaaacuguaaaauaauaaaucuaugucauuuugaaccucaaaguuuguguuaauuuauuacagcagccacagaaaacuaauauaugaccauuuauuugaguaaccacuauuugcauucuucacaugcauaugcaaaagaugucuucauuaaaagugaugcuucacaaaaguacuuacaugcauaguaauucuuguucacuuuucugauuagcguuugcauguuucugaagcaggggaaagauagcagccaaaugauuaaaggucuucccucuguuuggccacagcauaagggaaucaccuguugaaauuguucauucuaguuccaccaaacaucucauuaguagaauucucuacaagaaucaagacuagcuugacuauaaaaacaaauuuuuaguggcagcgacuucuuuuuggcauauaucuucuugaguauuuuuauagaaaguugaaccagguauaauagaggcuacuacuccaauaugaauuuaauuucauucauucuucaaucccuucuuggauaaggugcugauccaccuaagucacucccucauaagugaaugcaaacuuaagaaauuauaccuucauaaaaugggcauauuuuucuaacuguaaaaauguuuucuuuaaauaggcaugacuauggccugucuauuuuaauuucguauagcaguaauuucccuuggggaaggaguaaaagacaauauuuuuuaaaguuucucucuaucuagauaggaugcuaguagaagcaagauuucuauauguucugaugugaccaaguagauauuucucuacucaccagccucugaaaaucccuguguuuacccaagauuuaacuaaagaggcuaaacucguggguaaauauuaagagggaauugacaaaggcauauuaagucuaaggaguagacuauacuuuucuaaaauaaacacauaauuacagaguuaacacagcagcaccuucugccuugucagugcugaaggccccauggcagccaguacucuucacuugaccucguccugcaaacuuucuguacagcagauaaaggcccaaaguacacuauaguuuagugaauagcauaaacucauucaucuguaaguacuagauauuacaacaucaggcuucucacugguccuacuauaaaaauaauuuuaugcuugcacauuggacacaauuguucugguggcauagcucuuuagcuacaccagcacugaauagaaagaggcauccucuacuauuagucugcaacagaacccagcauuuccaccauugcaaacaucaaacuggaugaagacuuuuuauucccagcaggauuaagucaaaacauagauugaccuaggagaagaagcauuagcccuugucaaauaaguauaauuacuugaugacauugguuaguaaagcugcaaagaauacugaggaaauuaaaccagcuaauuugggaaagaccagaaaggcaauaugaacaccauaaaaacauggguaaggaacaguaagaugcugaccuuuacuguuuucucugggcaugauccugccuggcagagcuauguuuaggcuccucagaaaacccgaugcucucuuugcauuacuagccaaugugaagcaacauuaaauaaaaaaaaaaagaaaggaaagaaagaaagaaaacaaucagagaaaugcaaauuaaaaccacaaugagauaucaccucacaccaguuagaauggcgaucauuaaaaagucaggaaacaauaggugcuggagaggauguggagaaauaggaacacuuuuacauuguuggugggacuguaaacuacuucaaccauuguggaagucaguguggcgauuccucaaggaucuagaacuagaaauaccauuuaacccagccaucccauuacuggguauauacccaaaggauuauaaauauugcugcuauaaagacacaugcacacauauguuuauugcggcacuauucacaauagcaaagaccuggaaccaacccaaauguccaucaaugauagacuggauuaagaaaauauggcacauauacacaauggaauacuaugcagccauaaaaaaggaugacuucauguccuuuguagggacauggaugaagcuggaaaccaucauucucagcaaacuauggcaaggacaaaaaaccaaacaccacauguucucacucacaggugggaacugaacaaugaaaacacuuggacacaagaaggggaacaucacacaccggggccuguuguggggugugggggugggagggauagcauuaggagauauaccuaauguaaaugacggguuaaugggugcagcacaccaacauggcacauguauacauauguaacaaaccugcacguugugcacauguacccuagaacuuaaaguauaauaauaauaaaaaaaagaaaaccauuaaaacacuuuagaaauauauaaagguaggccgggugcuguggcucacucuuguaaucccagcacuaugggaagccaagacaggugaaucaccuaaggucaggcguuggagaccagccuggccaaaauggcaaaagcccaucucuacuaaaaauacaaaaauuuagccaggugugguggcggguaccuguaaucucagcuacuugggaggcugaagcaggagaaucacuuaaacccaggaggcaaagguugcagugagccgagauugugccacugcacuccagccugggcgacagagugagacucugucucagaaacaacaacaaaaaagaaauauauaaauguuuucauuuguaugagaacuuaugaaauagugauuaagagaaugggcuccaaagucaaacugugaggguucagaugcuggucuuccccuuguagaaauguuauguaaauuauuuaugcuucauuuccuacaucuguaaacugggggauaauacuguuaccucacuggcugcuuugggaggaucagcugugauaauucauguaaagcuuguagcagagugccuaaucccuaacaagaguucaacauaauugcugcugcugcuagggagaggcugcaaagcauucuggguaagaacagggacgcugggacaagauuguagaggcucugccauugacaagcuguaaucuugagcaacguauuuaacuucuuuguaccucacuucccucaccuacaaaauggaaguaauaauaaccauuaugaggguuguugugagaauuaaagaguuaauauuuguuagguguuuagacuaguaucugauacaugucugacaaacuauucagcuguacaugaaugguuuuaaagcugugauuauggaaaaccaagggcuuuguacggaggaauggagauaaggagagugugcagcccagucccacucuguaugcaaacaaaguaauucuagcucuuuuacauauuuaacuuucaagcaagauuuucuuugaguaaaggguaaugcugcuuuaaaagaagaaaggaaggaaggaaggaaagaaggaaggaaggaaggaaaccauggcucuauauguaugagccucauauaaaauauaucaguacaggucuuacaaaacacugaauguuuuuauacacauucccuagcagauuuaaccagaucaguuuuaagguuccuucuagaaaggaaguucuccauacguugaaaagugaauuucaguacauucaaauuuuaaagacacgacuucccauacuucuucaggguaaacaaaaaucucaauaauucuaauuuaacaugcaaaagccaugaauauucacuacagucaaaugaauaauaaaucaccccuggguucaagugcuugccaugcaaaauugccuauuuccuagaacauccagaaaucuguuuuuaaauugcuuuuuauuacuuuugcucuugugaugguugcucuucaaagcaacuuggaaaaaugugccauucucagcauuaaggcgauaaaggagaagugaggacagcagaacacggugccauccacaaaaggaaagagagucuguggaucagagggcugggcuccggaagacaguuuuuaaaugucacuagauaaaauuuaugagauaaaagggaauguuccuuagucauccugagcauugauaucuacaugaauaauaaaucaaaaggcucuuuauccauuuacugguaaacauuacgaccuuagguugaagaugugauuuacuccacugauaucaacacaacagaaauccagugaaaguaucacuggacuggccccaaguucuggaaaaucaaugaugcgugggagaacaaacauuuugaggggaagaguauuuuuuuaaaaguaaauauuuguggcacuagcaacaugagugcacucauuaagauuucuuuuaaaggauuacccuuuagucucuccuacauggaaaacucaaguauacucaaguugucaauuguauaauuugauggaaaguuaucccuaguauuuucccccaaauuggauugaauuauuaauauuucaccuuuacaaauacaugcaguauaauucaauuuauauaaaauuuaaaauauacagaacuuacagugauugcaaguaccuaagcugguaauaaagguaucaauuaaugaaggaaaauggauaugucaaaggacaggauagugacuaccucuaauaugaucagagagaggguucagaucagggaauuuucagaggacugcuggggaugcuagaaauacaauguauugacuugggugaaccuugagauagguguuuauuuauaguuauucauuaaacuguucauacaugucauaugcacuuuuccuguacaaauuauauuucacaauuuuauuuaaauaguauguuucauucugagaugacucuccaaucuauuacaugagacacacuuauacucaaaaagguguucauucuuuuucucugaaauucagauuuaacugggcauccugaauuuuaucuggcaauuguaaaccaaucagaauagcaugguuagauuacaaauaauauauauauuuuaaaagacaggaaaauaaaccacagauaaaaugcauucuuaaaagucuuagucauuucauuucauauucuauuaauaugauacauuuguguuucaugguuucugaccccuuguguccagcggacuauaaacauaaguaugcuaccuagacccaaacuaauuuacuuaaaggaaggcaaagaagcugaccauuauaaauacagcaugccuuagaaaggagaguuucaagucaaaaacaaaucuggaaaaaaaauuaauuugcuucuuuuuuguaaagcaaugaugugucguuuuuaugugcauuuguuuacacaguaaaagaaaagacaaucaaauagguaaaauggaugcuguauugcucccuuauacacacaaggaauuacacaucugucuaacaaugcuaaccacucugagcgauaauuauggaucaaugcuuuaaaaaauauccugaauugccugcagaaauggcaaggagaauacaauuaaauuauuuguaaaagccagagucuuuuuuuccuauccaucugcuacuugaaaugggaugaccuuucaaauagugcuugcuguucucaaugcaaacucuaaauaaagaaguggaguguggcuuuuuuuuuccuuuccagguucagcauagauacagcauuuguacugacauucuacaccacuccauaagaaugcagauuuggcuucuagaacauaaaagaggcguuucaggaauauaaaucaggcuuuugucccauaccuucagucaugacauuuggcuucuaucagaaaggugugcggcuucugagauaaguguuugagaacaagcuacaugaaguaauuuacucccuggagaaaaauugcaaaccucacccccaaacaaaccgcauaaaguaaauguguuagugaagaaccuuuuguuaaacuaccuauggcuggggagcuaaauagaaaaggucagauauuuaagcuaacaaugggcucaaaacaaaccuuccaacaggucucucaauaggccuacauuaucaacuaacaacuugcacuauuaagacuauuaauaguaauaagccaugcuuucuucacugagucuauauauauuuuacauuguuuuauugcuccccuacccuuuuuaauuuuuaaagcauuuccaguuugguccuuugugugcuuuuuuaaaaauuaggauuuuggacaaacuuucauguauuuuucuuaauaaaaguguaucaagcacauuucaaaaaguucaaaaaauacagaaauauaaaaaauaaucuauuagcacaucacccagagaaacugacuuuuaacagucugguguuuauacucccauucaucuuaauacauaagcguaucacaaaauuagaugauauuauauaacaaucaaaacuaaucaacuguuuuaugaacaucuuucuaugccauaaguaacaaucuguaucauuauacaaaaauuuucauuacaccuuuuaaauguuuuauggguaucucuguguguguauaguuguaaaauauaacuuuuaagugaauuuauuuaaauacccaacuacuuaugaguacauagauuuacagcuuuuuccacuacuguaaacaaaauugaaaugagcauccauacacacaucuuugcaguuauuuccuuaguauuacuuuccagaaauaguauagcuggaccagaaaguauaaacauuauuagagccuuuugguuaauauugucaaucugccuuccagaaaguuuacuaagcaagguagguagauuucccucuacuguauaauacugagaaauaucaauuuuuuggauacuugucagugugagcaaaaaugucauuauugcucuaauuauuauugcuuugauaacuaauggggcugagaguuuuacugguguuuuauaacucuuccuuugugaaucauuauucagauacguuucaaaugguaauuuguaaaguauuuugaauuuuggcccauuuuucuauaagauaaaagcauuaucguuagugggugcagcgcaccagcauggcacauguauacauauguaacuaaccugcacaaugugcacauguacccuaaaacuuagaguauaauaaaaaaaaauuaaaaaaaaaagcauuaucuuaaaguacaacaccauuaggauuuaagauaaauacacacacacacacacacacauacacacauacacacacacaaugagaaaaaucauuuuaauuuuaaaaacaauacucagcauaacaaauuaaacaaaaaugcacacauacgccagguacagugguucacaccuguaaucccaacacuuugggaggccgaggcagguggaucaucugaggucauggaguucaagaccagccuggccaaccuggugaaaaaauacaaaaaaaguagccagguguggggugcaugccuguaaucccagcuucucaggaggcugaagcaggagaaucgcuugaacccgggaggcagagguugccaugagccaagaucacgccacugcacuccagccugggcagcagagcgagagucugucucaaaaaaaaaaaaaaaauacacagguauguauguaugugguauauaaaauaagucaauacgcuaucccagcacuauuuccaauuccauuuucccauggcaacuaaaaaaaacaaaacaaaaaauagaaacaauuacuuguuuauccuucuacaucuuuuucuaguuucauaccaguacauacaaacagguuuugauauagucauucuuugcuuucuaauuccaacggucucauaucguuccaauuagucaaaugauuagaugcugccauaucauggacaugcuggacaucacauauagauguauuuaguuauuauuauuaguuccauaauauuucacaguaugguuauaguauaaauauauucaacaaucucacuauucaugugcuguuuuuauguuaauguuauuugucuugauuuuuuuuugccacuacuaaaaaugcagccaucuuuaaauauacauuuucacaucagagauuacugacucccaaaauuaagguugcagagucaaagagcaaguguaccauuaauuuugauaaauauauccagauuuagcaauauaugaaacucuuccauuucuaagcaccuuuaacaagcauggauauuaucaauauuuuccaauuuugucaacuacuugacuggaaaaguauuuauuucauugugauuuuaauuuguauuuccacaacuacuaguaaaguugagcagaguugcaugucucuuggucacuuaaauuuucccucugugaauugccaauuaauaucccuagccauuuuucucaaauaugguauauaacuguaugucaucagugucuaagaauuccuauuuuucuaaaauuuauauuguuuaauguacauucauauauuuaauucaucugaauuuuuagauuuuuauuguaaaaaauaguggucuaacauuuacaacuuacugaugaaaagccaauuuucauagcaucuuuuauuagauaaacauacauuucccaacugaacugaaaagacccuuuuuuuuuuuuuuuuuuaagacaggaucucccuuuguuguccaggcuggagugcaggggagugaccucggcucacugcagccucgacuucccuggcucuggugauccuccaaccucagccuccaaaguagcugggacuacaggcaugugccacuguaauugcccaguggguucuccuugccuacugccuagacagagccaauuucucaagacgagggaacugcaauagagaaagaguuuaauucacgcagagcaggcuguaugggagacgggaguuuuauuauuacucaaaucagucucccccccaaacucagggauccaaacuuuuaagaauaaugugguggauagggggucggaaaggggggagugcugauugguugggugggauaugaaaucacagggagucgaagcuguccucuuuugcugagucaguuccugggugggggccacaagaccagaugagucaguuuauccaucuagguggugccagcugaucuauggaguguagggucuacaaaauagcucaaguacugaucuuagguuuuccaauagugauguuucccuguggagcgauuugggagguuuagaaucucgcagccuccagcugcaugacuccuaaaccauaauuucuaaucuuguagcuaguguguuaguccuauaaaggcagucuaguccccagacaggaaggggguuuguuuugggaaagggcuguuaucaucuuuuuucaaaguuaaacuauaaacugaguuccucccaaaaguuaguucagccuacacccaggaaugaacaaggaaagcuuggagguuagaagcaagauggaaucaguaaggucagaucucuuucacugucauaauuuucucaguuauaauuuuugccaaggugguuucgccaccaugccuugcuaauuuuuuguauauuuuauacagacaggguuucgccauguugcccaggcuggucucuaacuccuggggcucaagcacucugcccaucuuggccucccaaaaugcugggauuauaggcgugagccacugcauccagcugaaaagacacuuuuacugaauauuaacuucauauauuuggaucuguuucucuuuuuucuguuucauuuauaaaauguucucguggcuaacaacauaccauuuuaauaacaguaacuuuauauuacauuuuaauguuuagaagaaaaaguaaaaaugaaaccuguugccauucugauaaauuauauuaacauaucuauuuuauaggaaugaaugacauuuuauaauaauaaaaacuauuagggaauaugaguaugacucuuuugacaggcaguuuuaucuccauaacauuuuucuuuuuucuauauaggccuuuuuuguuaaauuguuacuaaggauuuuauauuuuuuguuuccaaaguaauuuuuuucuauuucuagauaacuaguuauugaaaguauaaagaaaaaauuugauuuuuauauauuuauuuugugaucauccagcuaacauguuuucuuaguaacuguguaacagucauaaauucucuaugaauauaaucauaucacaugacagugaagagaguaucauuuucuucgcuuaauuuuuuuguuugauuacaacaagcagaacccauaacacagugcuaaguaacagugcuaauagcaaauauuccuguguauucuuccugauuuaauaugagugacuuuuauauuuuacuguuuaauguaauguuugauuauaggucuuuauaaauauuccuuauuguguuuaacuuccuuccaugcccauuuuauuuagaguauugcuagaaauuucuaauacauuuuaucacauuucuuaucaguaugcauacugaguugaauacaguccuccauaauuuauagucauguggaaucucaagugacuuuauuuugaaacugggucuuugcagauguaauuuguuagauuacaguaauuagaggucauaagggauuagagcggccccuacccaaugacuguugcccucauaagaagcaaaaccagagauauagucagacacgcagagagaauaccaugugauaaaggagacagagacuggaguaaugugucugcaugccaagaaaugccaaggacuguuggcagcuacuaaaagguaggaaaaggcaagggagggccaccccuuagagccuucaaaggcaggaugucccugcugguaccuugauuuugaaccucuagcuuucaaaacugacagacaauaaaugucuguuauuuuaagccacucauuaccaaauuaccaaacgguaauuuguuauggugguuuuaggaaauuaacaaagcauauguuguauaaucaaaucauuuaaucuuuuaauuaaugguauaaaguuccaauucagaaccaguuuguaauuuuugaaaugaagccuauuuuaaacauuuuaucauguuuucauaagcagauagauacaaguugcuauuuuuuaauuauauacuuccacauaugaaaaugaaauuagcauaaaauaucucauuaguguuauuuaucucaaguuuugauauaacauuuugcuagauuuguacaguugagccccauucuauuuucucuauagucuugaauuguuuaagaaccauagggaauaucuguuuuuuaaagcuuucguauguuacaaguaucuuuuaaucuuuuaaaguaccuguuuuuaaauaucuaguuuacauguaaaacuaucugggccuggugccuuuuuucuagugguacauguuuaauaauuuuccacuuucuucuaugauuauugguauuaaauguuuuuauuuugccuaugggaauaauauaauacugaauguauauauacuuuucuaaagaaucaucauuuuccuagauuugaaagugaauggcuauaaaauuuuuuuuuaaaaaaaaucuagccguaccaguauugauuggcagaguugaccaagggaagcuaagaggguacauaccaucuuccucccacacgacuacauaugcauuaaaucagaagacgacagucuuccaagaauaaaaugaaucaucaagggaauaagagcaguucucaucccuaguuagaaucucuaaacaaaccaaagcaaauguuuuuauuugaaucaucaggacugugucacaaugaaaccuagaugguuugucuucaagucauuuacuacuccccuaaagucuuaucaaaaguaugcuaaaaaaguuuaugacauuuccacugagcuacaauaaagcuucuauuuuuuuagauacuugacaaaauuuuaaaaagaauuauuuuucccccacaccugcacacauuuuaaaauaucuucaacuuuucuacaaaacaauuuucucuacagcucucccagacuucacaaacauauucuuuuauucauagcagauggaggaaauuagaguaacauauuugcucuaaaaucauuagugcugcaucagcacuucugaucuaaaugacauuucaagggguuauuguuacauagagcaagacuuugcuccaggcagaaagagacagaaaaacaacuugaaaaaugaaccuuuuuuugcaauuagcuucugcaucuuaauuuguugaaugccauucuauuuggauuuuaaauacaaaucaaaggaagaauaaagugauccaauucugucagggucauaccuuccuuacuggucagucgucugauuaaucauuauagcugcuuccuaaaaaauaauguuguuaaaacuuaccaucaacuacuugauucucuggaaaacuaacauauucuuacuucucagagauaucuugagaggcugauaagucugcucuuuagccucaagaaaugccuaaaauuaaacuauuuaacuggugagcuucacaugacugccacucuguccaagagauaaauaaacaucccuggcugaagaaugaaccaacccauagguguuucuuuagcacauacucuguuaaguccacuguggaauuaaaaaaaaaaaaaaaaguuuaagguacuacacaccuggaaaaugcaaucuuguaaacauaggagaaaccacagagaaugauacaagauagcaacaaucauacuuuauauuuuuacacugcauuacaauuuucaaacuacuuucaugacacuuuucuuauuuuauccucacaguaaauccauaauggaagcaggauaaaagaggaaggagacauaaacauagaacuucagagaugaaagcaacauuaaaggcaucaauaaccuucuuuacagauaagaaaauggagaccaaagggaaauaagaaccuucaccuuguuucagagucaggcaagcaaagcuaaugaagugaaggcuugucaccccaaguugcaaaaagaagucacaaaaauaagacaagaaagagaaagaugauagaaauacaggacacuaauuuggauuuaauguacuuuuuuaaaaaauagaaaaggaaaagcaauucuauugaauucggguuugaaauucaacguuggucucuagggaucacuuggcuauggugguuuuaugccauuaccagaucccuuugagaaaaauacuauuuugaaauucaugguuuccaguaaauauguucaaggcuuugaagaacauacuccuguagguguaaaugguguauacacauauacacaaaagcuugaaaacacuacuuaauuacugaacggagucuaaacauucuacagcucaguuaagaagcuacacaugcgucucacacccaccaucucuccagcuguccuccacacaccaucccagcaaguccuagcugacccucuuaauacugugaccucucuguuguauaauaaagguugaaaaucauccuuccuuugaauaagaauauauuauaacuauauuauuuuuuguuacagccuucucaaaaauguauuucaagccacacauaggccauugucauggcaucuuuuauuuaacagacaauagcuauuuuccaugacucaguccagaauauucuuuaacaucuacaucuaggauauuaucauaauuauaauaagagacggcacuacauggaugaagcuggaagccaucauucucaggaaacuaacacaggaacagaaaaccagacagcguauguucucacucauaagugggaauugaacaaugagaacacauggacacagggaggggaacaucacacaucggggccuguuggggguuuggggggcaaggggagggauagcauuaggacuaaugcaugcggggcuuaaaaccuagaugacagguugaugggugcagcaaaccaccauggcacauguauaccuauguaacaaaccugcacguucugcacauguaacccagaacuuuaaguaaaaaagaaaagaaaggugcaaaagugaaaacauuaaaaguggaaucaugauuuuaaaaaauaaauucacagugguguugaaagaucauaucaggguuagaggacaagucuuuggguuagaaugaacacuuaauuuauuaucagagugaacaauaauuaccucgacauuuuaaaacagcauuuugucaccuuuuaaacguuugggaacagagaaggcgaaacaccaugucugacacacuauggaaaguuuuauaauucuccucaaaaaggaagaaaaaauauuucuauuuccauuccagaucugcacaauauauucuugcaucccauuuggucugauucauuuacauuuugcugaauucuguuuuuguccauuuucaucauucaaaagauuuuaaaaauucaacaacaucaaaaagccaucaaaagaugcuuucagaugaaauugcaaagaaaauaagcacaugaauuagugaagcaacuuccaaguuauacaauuguggcacuuacaucuuuucucaucuuguccgagaauuaauuguacugcugaaauuagacauccagccugcuccaugcagacaggagcccaagccggaagaaaacucuuugaauaacaacacugccuucugauucuuuucacauggcuacauuuuugacauuuacuucaauauucuacccaguugcagugugacuaugacaaaauauuucuguaggcaugacuggcaccucugcgguaaguggcagggaauggaauaggaaacgagucccuuuaguagcuccaaaaagcccacaggcacucugcaaaccuuuugcauacaugcuguuaaguaaaggaugugaaaaauggaaaccgugaugacaauuuuaaucaccuuacagaugauucuaugaucuacuauaacuuuauaauggcaaagccacugacacaggagacugacaggcauauauucucucucugccucuaagucuauuaaauguuuauuugggggguuuacacauggauagagaugaacuuaacagaguauuuauugaaucuauccacggauaaauuauaaaugacuacaacuuuaacuagguggaauuuucaugguuauuuuuaauuucuaggcccaaaucacuucccuaggcucuagaacugucuuccaggagaugucagaugucaguaaucagagggaacccaucuacagucaaugcagccaaaaguucugccuacaagguagcaauuagaguccagcagucucuucuggaagugccaauuacuguucugucuucccuuuugaaugccuccuuaauauaagaauaacauaucauuuuuauccuaucagauuagaaaauauuguuuaaaauaacacucacaguuggcaagaaugcagagagagaagcacucccaaacagaugcuggugaggauguaaauuggaauguccuuucuggaaaacaguccagcaaaauuuaucaugauguuuuuaucuuccugacauuaguuuggguauacuguugcauauuuuuaaauagucuucaaaagcuagaguuuuaaaacucuguguggcauuuuguuacgugaauacgcuauaguuuucaauuauuuccacauuugucagcauuuuaguugauuucaacuugggguauuauaaauaaugcuccagugaacaucuucauaaauacacauuuaacucacauucuguuuauuucuuaguauagauucaaagugaaaauacagugguuggcaaggcuuauauucaaguauaauuuuauccuaguaauuauggaauuaguaucagcaaacggauuccuaagcuagaauucaccaucauuuacuaggagaaagaucuguggugguaaaacagacucugcuuauuuacacagccuuacuaaugggcaauuugccagaggaauccaaaccagagagcauguaugauugacuaaccauuacauggaaagaagaaaucagcuccuaccaaaagcacauucauuucaaguaaugccagcaaccugcugagucaguuguauucagccccuauagaaacccuucccaaguucauugauaugugacacccaugacauauuuuuaccaucauugguuuucaugaauuugccugucuuugagaccugaaaaacaaucugauuuauugaacugaaaaaggcgaauguagugaaacccuauccuguaauuggcaaaccuuuuaccucccugguggcuugaguagagaaguuacuggcuggaggcuguucuaaaggaaaacaugaauggcccuaaaauuaaaauuccagacuuuaggagccaauuaaugaggacauaccacuuuuaauccaucacuuugcaauauauuuaaaauguuaagacucauuguuggcaagggaacaguauuccccaaagcuuauuccaugggaaaauguuuuuguggacaaaagaguuugggaaagagugauauuggaaugaaguucaagcugaacuuuuaaugugcuauuaccaacugugaaucuccauggggggcuguagcuaguaacauuuguaaacuucuucaaccacaaauuauuccugcuuuauauugccuuuguuucuggcaacuggguuucuauagcgcauugcaaggcagagcauucuauggaacguacuuuagagaauguuucucuaggucagcaguucucaaacauuuuggucucaggauccauuuccacuccuaaaaacuguggaaggccccaaagaguuugugguuauguugguuauaucuauggauauuuaccauguuagaaauuaaaacagaaaacuuucaaaacacuaugaauuuauuuuaaaaugacaguaauaaccaauuacauguaaauauacauauuuucccgaaaaaagagcuagugagaagaguggcauugucucaacaucacauuaauauuuagccuaauagaagacagguggauucuccuaucuguuucugcauuguguugugauauauuauuaggguugaagugugccaagaaaaucuagaaggaauauuuuaauagccuuuucaaauaacuggauuuuuucucuaauacugcaucaaaacuuaacaaaugguaguuucuuuaaaaguuacuugcagaguagaacccgaaaccacaucaagaaauuuuuagugcucuguuaugugaaaaauccauggucuguguagcauuuugaauggauccuuuccccaugugaaauuuuguaacagugcacauugcucuggacaaaaauagugguucauuggauuaugcagaucuuccaaauguugacaccuuucauugcaugauauaaaaaagaauuauauuugcaauaucaucauugaccuuuuauuagaaaaagucuuuaaguauugggaagcugucaagcucaugguggcauauccaaguuucccaaaauuugaauuuuugcuuagaagcuugaauuuuaucacuaucaacaaauacuggccaacgguuuacuuaaagcaacagacucacuuugugcauuuuaaagaaaauauguuaaauacuugaguuugcauaauuauaguuugucuuucaaugcuucuuucaugcagaaaaauaguguuccauauaaaagguagcugguucauuucacuacccagucucacaagugcuuuuccuugagacaaccaugauaugucaguacacagcagcaguucuuucugcauacuucccauuucagcacacagaaugcuaaaaaaaaaaaaaaaaaaaaacucaacaaucaaaaugcaauuaaauuaauaauuuuuacuuuucaacaaggauauucuuagaaaaaguugacuuuuuauuuuuuuuaaccauagugcauggcagugaaaaaugaaaggccaaaaguacaguucagugccacugucuugauucaugcuauggugccaguaguuuuaaaaaacauuacauuuggaggagccaagauguccgaagaggaacagcuccggucuacagcucccagagugagcgacacagaagaugggugauuucugcauuuccaucugagguacccgguucaucucacuagggagugccagacagugggcgcaggagagugggugcagugcaccgugcaccagcugaagcagggcaaggcauugccucacucgggaagcgcaagggaucagggaguucccuuuccugcucaaggaaaggggugacagacggcaccuggaaaaucgggccccucccaccugaauaccacgcuuuuccgaugggcuuaggaaauggcgcaccaggagauuauaucccacaccuggcucggaggguccuacacccacggagucucacugauugcuagcacagcaaucugagaucaaacugcaaggcggcagcgaggcuggggaaggggcgaccgccauugcccaggcucacuuagguaaacaaagcagccuggaagcuccaacuggguggagcccaucacagaucaaggaggccugccugccucuguaggcuccaccucugggggcagggcacagacaaacaaaaagacagcaguaaccucugcagacuuaaaugucccugacugacagcuuugaggagagcagugguucucccagcaugcagcuggagaucugagaaugggcagacugccuccucaagugggucccugaccccugacccccgagcagccuaacagggaggcaccccccaguaggggcagacugacaccucacacggcuggguacuucucugagacaauacuuccagaggaacuaucagacagcagcauucacagaucacgaaaauccaugguucugcagacaccacugcugauacccacacaaacagggucuggaguggaccucuagcaacuccaacagaccugcagcugaggguccugucuguuagaaggaaaacuaaaaaacagaaaggacauccacaccaaaaacccaucuguacaucaccaucaucaaagaccaaaaguagauaaaaccacaaagauggggaaaaaacaagagcaaaaaaacuggaaacucuaaaaagcagagcgccucuccuccuccaaaggaacgcagcuccucaccagcaauggaacaaagcuggacagagaaugacuuugacaaguugagagaagaagucuucauaugauccaaccacuccgagcuacaggaggaaauucaaaccaaaggcaaagaaguugaaaacuuugaaaaaaauuuagacaaauguauaacuagaauaaccaauacagagaagugcuuaaaggagcugauggaguucaaagccaaggcucgagaacuacgugaagaaugcagaggccucaggagccaaugugaucaacuggaagaaagggugucagugauggaagaugaaaugaaugaaaugaagugagaagggaaguuuagagaaagaagaauaaaaagaaaugaacaaagccuccaagaaauaugggacuaugugaaaagaccaaaucugcauguuugguguaccugaaggugacggggagaauggaaccaaguuggaaaacacucugcaggauauuauccaggagaacuuccacaaucuagcaaggcaggccaacauucagauucaggaaauacagagaacgccacaaagauacuccucaagaagagcaacuccaagacacauaauugucagauucaccaaaguugaaaugaaggaaaaaauguuaagggcagccagacagaaaggucggguuacccacaaagggaagcccaucagacuaacagcugaucucucggcagaaauacuacaagccagaagagacugggggccaauauucaacauucuuaaagaaaagaauuuucaacccagaauuucauauccagccaaacaaacuaagcuucauaagugaaggagaaauaaaauccuuuacagacaagcaaaugcugagagauuuugucaccaccaggcugcccuaaaagagcuccugaaggaagcacugaacauggaaaggaacaaccgguaccagccgcugcaaaaucaugccaaaauguaaagaccaucgaaacuaggaagaaauugcaucaacuaacaagcaaaauaaccagcuaacaucauaaugacaggaucaaauucacacauaacaauauuaacuauaaauguaaauggacuaaauuauccaauuaaaagacacagacuggcaaacuggauaaagagucaagacccaucagugugcuguauucaggaaacccaucucacauacagagacacacauaggcucaaaauaaagggauggaggaagaucuaccaagcaaauggaaaacaaaaaaaggcaaggguugcaauccuacucucugauaaaacagacuuuaaaccaacaaagaucaaaagagacaaagaagcccauuacauaaugguaaagggaucaauucaacaagaagagcuaacuauccuaaauauauaugcacccaauacaggagcacccagauucauaaagcaaguccugagcgaccuacaaagagacuuagacucccacacaauaauaaugggagacuuuaacaccccacugucaacauuagacagaucaacgagacagaaaguuaacaaggauacccaggaauugaacucagcucugcagcaagcggaccuaauagacaucuacagaacucuccaacucaaaucaacagaauauacauucuuuucagcaccacaccacaccuguucuaaaauugaccacauaguuggaaguaaagcucuccucaacaaacguaaaagaagagaaauuauaacaaacugucucucagaccacagugcaaucaaaguagaacucaggauuaagaaacucacucaaaaccgcucaacuacauggaaacugaacaaccuguuccugaaugacuacuggguacauaaugaaaugaaggcagaaauaaagauguucuuugaaaccaacgagaacaaagacacaacauaccagaaucucugggacacauucaaagcaguguguagagggaaauuuauagcacuaaaugcccacaagagaaagcaggaaagauccaaaauugacacccuaacaucacaguuaaaagaacuagaaaagcaagagcaaacacauucaaaagcuagcagaaggcaagaaauaacuaaaaucagagcagaacugaaggaaauagagacacaaaaaacccuucaaaaaauuaaugaauccaggagcugguuuuuugaaaggaucaacaaaauugauagaccgcuagcaagacuaauaaagaaaaaaagagagaagaaucaaauagacacaauaaaaaaugauaaaggggauaucaucacugaucccacagaaauacaaacuaccaucagagaauacuauaaacaccucuaugcaaauaaacuagaaaaucuagaagaaauggauaaauuccucgacacauacacucucccaagacuaaacgaaacgaggaagaaguugaaucucugaauagaccaauaacaggaucugaaauuguggcaauaaucaauagcuuaccaaccaaaaagaguccaggaccagauggauucacagccgaauucuaccagagguacaaggaggaacugguaccauuccuucugaaacuauuccaaucaauagaaaaagagggaauccucccuaacucauuuuaugaggccagcaucauccugauaccaaagccuggcagagacacaaccaaaaaagagaauuuuagaccaauauccuugaugaacauugaugcaaaaauccucaauaaaauacuggcaaacugaauccagcagcacaacaaaaagcuuauccaccaugagcaggugggcuucaucccugggaugcaaggcugguucaauauacgcaaaucaauaaauguaauccagcauauaaacagaaccaaagacaaaaaccauacgauuaucucaauagaugcagaaaaggccuuugacaaaauucaacaacccuucaugcuaaaaacucucaauaaaucagguauugaugggacauaucucaaaauaauaagagcuaucuaugacaaacccacagcaaauaucauacugaaugggcaaaaaccggaagcauucccuuugaaaacuggcacaagacagggaugcccucucucaccacuccuauucaacauaguguuggaaguucuggccagggcaauuaggcaggaggaggaaauaaaggguauucaauuaggaaaagaggaagucaaauuguuccuguuugcagaugacaugauuguauaucuagaaaaccccauugccucagcccaaaaucuccuuaagcugauaagcaacuucagcaaagucucaggauacaaaaucaauguacaaaaaucacaagcauucuuauacaccaaugacagacaaacagagagccaaaucaugagugaacucccauucacaacugcuucaaagagaagaaaauaccuaggaauccaacuuacaagggacgugaaggaccucuucaaggagaacuacaaaccacugcucaaugaaauaaaagaggauacaaacaaauggaagaacauuccaugcucaugaguaggaagaaucaauagcaugaaaauggccauacugcccaagguaauuuauagauucaaugucauccccaucaagcuaccaaugucuuucuucacggaauuggaaaaaacuacuuuaaaguucauauggaaccaaaaaagagcccgcaucgccaagucaauccuaagccaaaagaacaaaguuggaggcaucaugcuaccugacuucaaacuauacuacaaggcuacaguaaccaaaacagcaugguacugguaccaaaacagagauauagaucaauggaacagaacagagcccucagaaauaaugccgcauaucuacaacuaucugaucuuugacaaaccugacaaaaacaagcaauggggaaaggauucccuauuuaauaaauggugcugggaaaacuggcuagccauagguagaaagcugaaacuggaucccuuucuuacaccuuauacaaaaaucaauucaagauggauuaaagacuuaaacauuagaccuaaaaccauaccauaugaggcacuauucgcaauagcaaagacuuggaaccaaccaaaauguccaacaaugauagacuggauuaagaaauuguggcacauauacaccauggaauaccaugcagccguaaaaaaaugaugaguucauguccuuuguagggacauggaugaaauuggaaaucaucauucucaguaaacuaucacaaggacaaaaaaccaaacaccacguguucucacucauagaugggaauugaacaaugagaacacauggacgcaggaaggggaacaucacacucuggggacuguugugggguggggggaggggggagggguagccuuaggagauauaccuaaugcuaaaugaugaguuaaugggugcagcacaccagcauggcacauguauacauauguaacuaaccugcacauugugcucauguacccuaaaacuuaaaguauaauaauaauaaaaaacaaaacaaaacauuacauuugcaucauuaaugaaaauauuaacauagugaaaaagaaaaagagcaacuuaguauuacaguaauauaguuucgaccuugcagacucccuggaaggaucucagggaucaccaggagucugugaagcacccuuugagcauugugguucuagauucaaaauguggccuuggcugagcacgguggcucaugccuguaaucccagcacuucgggaggccaaggcaggcggaucaccugaggucaggaguucgagaccaacauugcaaaacccugucuuuacuaaaaauacaaacaaauuagccaggugugguggugcaugccuguaaucccagcuacucgggaggcugaggcaggagaaucacuugaacccaggaggcagaguuugcaguuuagcugagaucacaccgcuacacuccagccugggcaacagaguaagacugucucaauaaaacuuacacacacacacucacacacacacacaugcaaaaaacccuuaguuuaaaacacaaacacaucguacagcugcacaaaaauauuuucuuucuuuauauccuuuuucuauaagcuuuuuuauauuuuuaaauauuuguauuauuuuuuuaaacuuuuuuuuguuaaaaacuaagaaaaacacaaacauuagguuaagccuacacccggaugguaucaucaauaucacugccucccaccuccacaucucauccaacuggcaggucuucaggggcaguaacaggcaugaaguucuuaccuccaaugaaaacaaugccuucuucugaauaccuccuggaguucuugccugagacuguuuuauaguuaacuguucuuuaauaaguagaaguacaugcuaaaauaaugauaaaaagcacaguagauaguucauaaaccaguaacagucauuuguuaucauuaucaaguauuauguacuguauguaauuguaugugcuauacagcuggcagcacaguagauuuguuuacaccagcaucaccacaagcacgugaguaauucgugacgcuaugauauuagcacacuacaaugucacuaggcaauaggaacuuuuuagcuccauuauaaucuuaagggaccacccucauaucugcagucugucauugaccagaccauuguuaaguggcacaugacuguauauacaauggaauacuauucagcauuuagaaagaaggaaaucuugccaucugcaacacgaaugaaccuggggaauguuaugcuaaguuaaauaagccaaacauagaaagacaaauacugcaugaucucacuuauauguagaaucuaaaaaaguuaaauucauagaagcagguaguagaagguugguugccaggggcuguggugugggagaggaaaaaaauggggagguguuggucaaaggguacaaaguuugaguuaagcaagauaaguaaguuuuggagaucuauuauacagcauaauaacuauaguuaauaauaauuuauacuugaaaauugguaagagguuagaucuuaaauugcuaagagaguagcauuuaagaucuacucucaccacaaaaauuuaugagaugauggauauguuaauuagcuugauuucaucauuuagcaauguauacauauaucaaaacaucacuuuuuacccuguaaauauacacaaguuuuauuugucaacuauaccuuaauaaagguggggugaaaaugcauauuccugaaacccaucaugggccuacucaaacagaguaucugaggaggaggcagggcuacccgagcagcagcgcagguuguacacugcacaccuugcacaaagguauacaguuagcgaagauuugagcuugaaguuugccuuuuaaagaaauugcauaugugaaucuugguuauaguagaacuuuaaguguucuagagcaguuguucuucaacuuuaugugcaucagaauuaccugucuugggguugaaaacacaaauuucuuugugccaugcuugaacuaccuaauuagaaaccugagcaucuguauuuucaaggaacuacuuagccaacucugccaccuaccaaaaugugacagccauuuuucuagacuaaaaaugguauagcugucuacaagaaaucaacucaacaaaagcugaagacaacacacacacggcuuaggauacucaggcaucauuuggacagagucuauucaacagcuauaaauuuguuguuuaaaauagccaauguuuuuuaaaaugcaacuuuccauaguuuucuguuguuauauuuguuuucauucugucaguaugguauuggaucucaaccuuguauguuauuucaccaacaucuugaaauuuauuuagccauauuuucaugguuuuauaugaaugcuuacuaaacauagucugauuuuuuaaaagguuuuaucuuaugcaagauucuucaagagaaaagacaaacuuaguuuacugucaaauuaccaaacugacucagauuuuuaaaaaccauucgaaguuucauguuaugcacuuaacauaaaaaaaugacucaauguaaaugucaugucucguaaugauccuauuccugggaucuuucacaugaaacagagugggcaggaacauucuauggcugccaaaauggaauuaaacacauggaaacaaagaaacaaaagcacaacucaccccuuccagacaacaggaaaacauguagauaaaucagugauuuuccuuccagcuaaccaaugaaguagagacauguauuuuaacaauuguaagggcacugggcuuaaggaaaggcaaaguaaaaacuagguuauaauguucuucuagaugcgaaaaugccaaaucugccagucacucaugaaaagaacacagccccaggcaacugauauugauacauucaaagauuauaguuauguaugauuacagaauagcauuucauaaacucuaucagacagaacaacucuuuaauggaauguuaagaguugggagagagagaaaaguuggucauucuaagguccaauuaauuugaaaacucaugaguuauauagaauuaaacaaauuuuuuugacuguggaacuucucagagcccuucuguacuaaugugcauuacaccucuccaagaagaaaaaagcaugcagcauuuuucaaacuuuugauacuuugaugcuuuuuuauuuagcuucugacugggcuagaguucucugggacacacccagggaaauauugauacagacaggucaaacaauuaaggcaaaugcucaggcauauaccugaacugugguagaacaaucuagaugccacagaaauggugaaggcaugcccaacagccagccccacuauaucaagucccuuagccucucuccauuggccuuagcucugaaagaaagaugaugcuuauuaguaaagugccuugggaugguugggcaagaaacacuaaauaagaacaaauuauuacccucauuacaggguagaugaucuaauaaaccaucucuauuacuuacaaaguuuggaggccugcuauuuuuuuccuuuuaacuacacuccaauuugaccuuaaaaaucuaugcuaaaaauaacuuauaggaaauaucccaaaaccauaccauaaacuuucuuaucggaccucugucuguuugcacauucucaaugacugccaaucaccuacagguaaaugcaaauuucuuagccugcuguauaacucuccaucuuucaggagcuguagaguuuaugauuaagaucauggucuuuguagggagacagacaagguucacaugcaggcuccacucuacuacaucugaaguuauuucucuucucuaagcccuagauuaucaaaguaugguccaugaacuggcagcgucagcagcauuuggggcuuccuagaagggcagaaauucaggcuccauugaaaaccuacugaaucagaaucuacauuucaacaagagccucacacuguaguuugagaagaacuacacaaauucucauacgcuuugaccagcuccucugcaaauuggagguaauaauaguaaacuuggagauggcauucaucgucuacuccuuugaauccauccucaaguccuaagguccacgcaaauauccuuaccugucucuuucccuucauuaccuuaguccaagcuguucucauuucucuccagaucuccugcaauggccacucaacucauuacaaugcaucuccucuugcuuccuucuauucuguuucacuuacugcaaccagagagaucucccaggaaaagcaaaugugaucagagcuuccaugagcucucaaaauaaaggccaaaagccuuucacagaacuacaaccucuguugagggggucgcuucccaccucuauaucuuaucuugcaugaugcuccaccugguuuccucugcuccagaagcacugguaaauucuuuuuuccacuccuugaacuagccauccuccuucccgauacagaauauuugcaaaaccauccuccuggucaucagugccuuccccucaacucuuuaccugguuaacuccuucucaaucuuuagaugucagcucaaaugucaucuccccugaaagcuuucccugaaccuccuacccagcagccaaacacacugccugaccuguugccugugccccauaaauauuuguugaauaaaugaaggaauuaaugaauguucauucauaugguuauugugacaaucaaauggauugaaaccuguaaaucauuuagcacagugccugguagagagcaagagcuuacuuaaugcaguaccaaugguaauauauuuugaauauuagucuugcuaaaaacuagaccccaagcaguacuuaacaggggcuaacaauuagaaucaccugggaaauguuacacuucucaauguccaggcucugcugcagaccaauuaagucagaaucucuagguggugggacccaugcaccugaggauuuuaaaacucuacaggagauucuaacguacagccaaagugugacugcuuuacucguugucucacuguggucucccagccuuccagagaauagcauacugggcgucaagaagaguccucauuaaucauggcaugagucuguggcccacagaaaggggcaguaauaugaauacauguaguaaaaaucuagcaauucauuuccccuggcuccuugacagcagccagaugguggaaacucuccaucuauuacccaagccagaagaaaaccuuucugggaaaauccaaguugccugaacuacuguugggaggaaguaugguaacacgugaagaugacucugguccuuuggguuaagugaugacuuaacaaaauucaucaggauuccauuauaaaucugucauaauuguuuuguugaagcaauugcuuugugggagcaauuaauuccuacugcuaaaaaaaaaggugagaacuccugaguguuccaucaggcaccaagaaauaggugagccgggaagcauuugcccuuaccuucugucuucuucacuacucaaguauuuggagugucaagagaccacacuguacuucaaaggccuccucuuccaaauaaccaaccuucugcuauguaaaaacaugauuaagaacacacauauuuguacuguaugucucacucauuuugaacuuuucaaaaugugauauugccaaagaagcuuuaucucuuuuaaggguuucacacacacacacauacacugccuugguuugaaaaacaacauagaaugcaggccucauacaauuugagaaccauuuacaauuauaaccuaccaagucagagcugauaccaagccaacacaaaggccucagaauuguuauaaaaggaacagaauugcucucuggaaauaauaucccagugggcuaaauucccccucccccuguuccuccaaggugguaaauugcaacaacaacaaaaaagcaugauucaugaauauaaauuuuucuuggcuuuuaaaaucauacacuggcauaguccuccccgaacuucagccaaaugagaauacacagauaaugacaauuuuacaauaagugguuccaggacacaggcuuuucaagauccacaaaugaaaggcacuauaaaaaagaguauuauuauuauuauuauuucaagcacccagaaaaaccacaaucaaugauuagccauaacaauuaaacuaacaauaguacaucuggaaucagcuccaugguaauauguacuucaugcuuaauaguucaaauuaauucaaucugaugguguuagacauaccaguuaggagcuggagagcaccaaaauucacauuagcuuccacuucaaaagauauuaugaaaagagaaggaaggaaaugaggcuauaaacagcagugguaaauacgaaaggcucagagaugauauggucaggaauaacucucagcuauuaggaauucagugaugaaaauaugaaggcugauauuucuauccuugcacauuccuccagagucaaugacugagccacccaucugagcgacagaacugaaacccuaaaaucagggcaauuauauucaaagaagagggggccuucuucauucugcuuacagcauccuuuacuaguagcccauuuauauugcagaaugcauggagaauuucucauuuucagguuauagacuucaaguaauaagaaaagagagcaggaguuggggcaggcauaaaaggugagguaguuauugccugauuaccuuauuugucucacuccuccuugaagauucacuagauaacugucuuaagcugcacuauaaauauucucuaaggcaggauuucucaaccuuggcacuguagacacuuuggccuaggucauucuuugcugugaagugcuauccugugcacuguaggauguuuagaaacaucccuagucuccaccuuguagaugcuaguagcaucccccacccccaguugugacaacaaaaugucuucagacauggccguauguccucuugggggaaaaaucauacugguugaaaacuguuaccuuaaaucuuuuuuuuuuuuuuuuuuuuuuuuagauggagucuugcucuguugaccaggcuggaaugcaguggaaugcaguggcgcgaucucggcucauugccaccucugcuuccaggauucaaaugauucuccugccucagccucccaaguaacugagauuacaggcaggagccgccacauccagcgaauuuuuuguaguuuuaguagagacuggguuucaccacauuggcgcuggucucgaacuccugaccucaagugauuugcccgccucggccucccaaagugcugggauuacaggcaugaaccaccguuccuggccuacuuuaagucuuaauucacuuguuucugggcaucgggaggaaaauccagagggcagacuccccucuagacucuucuuccucagagaugagcauggauuguauugccagcugugugcaaggcagcacucuucccacggcaugcugaauccuccuccuaacaccuuuugcacauauaggcuuguugcauauaauacagaaauuuggaaccuggcagucuucuauucauugugcagaaaagaguuaacacagagcaggcucgagaaggccuauccuuagaaggccuguuugcaauguuggccuuugguuagcagcugggaauuggagcugguaaacaguucccuacacuaauaugacauuuuuccuaaauuauagaguggccacuaugccucaccuguuuguacaaacagugugguuuaugcugaacaccugcuuuccuucugggagucuggaauuuggguaugugcuaggcagaucagcucccagcaguagccuugggcacugagucucuaaugagugcccuaguaggcaacacuucaaacuuguugucgcagcuuguugcuuaaggaacuaagagcauccugugugacugcauuggaagaggacucuuggacgcuuacuccugauuucuccagacugcacaccaugcaccuuuucccuauguugauuuuacuuuguguucuuucacuguagcaaaucagaaccagaagauaacaaugcugaguccuaggaguccuccuagagauuuacagaaccuugcaaguggucuuggggaccaccaaugcagggacucauucagcauucuauuugugugccucuauuucuagauacagcaaagacuuaaacuccaaguccucacagaauuuaugugguagcagcgagcaaagcauuaauucuagcauauuucaagcuucuuucauagaaaacaagcccuguggcaucucuuuuuuguuuuuauaacagcuuuuuagagauauaauucacauaucauacuguuaaucaaucuaauguguacaauucaagauuuauauucauagagucgugcaaccacgaccacaaucaauuuuaggacauuuucaucaccccacaaagaaacccuauauccauuuacagucacuacccauuuucucccaaccacccagcuaggcaaccacuagaguuucugccgcuauggauuuaccuauuuuugacacuucacaauuggucauaugauauguggucuuuugugaguggcuucuuucacuuaccaaaauguuuucaagguuccuccaugauguaacauguaucagcacuacauuuauuuuuauugcugaauaauauuucauugcauggauauaccacauuucauuuauccauucaucaguaaauggaacuuuguauuguuucuacuuuuuggcuacuaugaauagugcuacuaugaacauuugcauacaauuuuuuuaugcacauaugauuucauuccccuugaauagcuaccuaaguguggaauuucugggucauacauauguuuaacuuuuaggacauuuucaaacuguuuuccaaaguagcugcaccauuuacuuaccaauggcaguguaacagaguucuaauuucuccacauccuugcuaauaguuacuauuaacugucuguuuuuuuuuuuuguuuuuuuuuuuuuugagacagccugucacccaggcuggagugcagugaugcaaucuugacucacugcaaccaccaccucccagguucaagcaguucugcugccuuagccucaugaguagcugggauuacaggcacgccccaccaugccuggcuaauuuuugucauuuuaguugagaugggguuucaccauguuggccaggcuggucucaaacuccuggccucaagugaucuucccgccucagccucccaaagugcugggauuacaggcaugagccaacgcgcccaaacuuaucugucuuuuugcuaauaaccgucuuagugggugugaugugguaucucguaaugguuuugauuugcacuucccugauggcuaaugauguugagcaucuuuucaugggcuuauuagccauuugcauaucuucuuuggagaaaugucuauucagaccuauuugccccauuuuaacugggcuauuugucuuuuuauuauugauuuguaagaauucuuuuuauauucauauucuaucuccaaguuucuuaucagauauaugauuugcaaaacacuucuuccauuuuguggguuaguuuuauuauuucaaucauguccuuuaaagcauaaaaguuuuaauuuuuaggauguccaauuuauccauuuuuuucuugcauuacugugcuuuuggcaccguagcuaagaaaccauugccuaacacaaggucaugaagauuuaucccuaugguuuugucuaauaauguuauaguuuuagcuuuuccauuuaggacuuugauacuuuaagguaauuuuuguauacagugugagguaggggguccaacuuuauucuuuuguguguggauauccaguugucuauggcaucuuuugcaucacuccaagacauaguuucagguaauuuuugucuauacaaauuaagguaacagguaccaaaacacagaaccuauguaugugacaaacugccugaaagccuuuauaaaaacuuuugcaauugguguucuuuuuuucuauuuucagaauaugcucaguauuuugcuauaucaggaagcaguaccaccauuauuaccacuggugcuacugcugcuaauaauaauaguaacuagcagauauuuuguacuuaguaugugccagacacuacacuugcauuuaacauucauuaacuuuuaagcacuacacaugcuuuaacuuacaugaucuuccugccaacaccacgagauagguagaaucauuaucuucauuuuacagaugaugauauuaaggcucacugauguaaaaaaauuuuccuuaggucauagaacaagcaggaaaaccgauuuaaaaaaauugagggaaggaauggcacuggaaaguggaggucaaguaaugucggauagcaaauucuaacaaacaguagcuaagcacguaugcgaaauauacaaaaauaaacaagccaaaaucuagcacugguagaugacauucccaguucugaucaaguugcugacaacaaaggauuggucuccccuucuaacucaacaaaggguaggaaaucuuaucacucaagauaucaaucaagauuuauuugaucgcugaaaggguuuugucaacacuccaaaaauuguauuagugacuagaugauugauggaauaagucaauuagaaccagauuagaaaucgagauaugaagucaauuacuuccaaucugaaaauuaggaaucauuaaacaauaauauaauagauggcaucaauuuucaaaacuacccuucguguguuugucuauagggcaaaauucaaguaaaaaauaacuuugaaaagacuaaaacuauagagcaacuugaucuugggaguguuuucccagauggguagugggcugagucuggucaguuuucaguggagaaaauguagacgagauaagcaguugauguucccaaauucaaauaacuuuauggcagaaaagucagucaaguuuaauucucuuucccuauacuagcuguguccuuaaugauaaauacaauaauaauagcugacauguauugagucuuacauuauauagcucucuagguaccuaaaagaugacaacuaauuuauuuaaaccaaggcauaugaaguaaguacuauuauuauucccauuuuauauaagaggaaaaggauguguaaagugcuaauugaccugcuuaagagguagagugagaccuugaacccuguagucuauguuuguccuccuaauagugucucuauaugguuucagaauagaagcaaauagacacauaaggguuaagcauggcuaaccuaacuccaaguugagucuuuuuacacuaggcaaugcugucuucaauauauuuauaauaacuuuauacaccaaauaacauuuugaaguuuauuuccucccaauacagaaacaucacugcauuuccacugggauuuucaguacugucuguuguggaacugaucugggcuuagugaguauugcuuuaucauucuuaaauaaaaaccauuauagagaaugcagaaaacaauuucccuuucaguuugcccacuucuacccauaccgagaaagacggauccuuaaagcucagaauguaauaaaagcucacaauauaauaaaagcucaguaucagaaauguuccaagucccuccacucuuucucuauaguuaggaaacuaaaauuuaauauagggcacaacgcuccagagaauucaguguaucgaaauguuaauacacuuuuauauauuuuaacugagauaaacaagaaagagauagggaagccagagcagcuauggcaaagacauaauuaugauaagacuaauccagcuaacagcaauagaagcagauagugacuccacugugaugcugugguagaguuuguauggucagaaaacuauaucaguauacaauguuaaugacgcaggagccccauuauaggaaagcaaagauaacuuacuaugugacucuauaaaguaaaguucauccaaaagaucaaagagcauuuguccuauuacuaaaauauuauccaaauguauuuuaucaauuaaaacuuggauaaaaucauuugcuucauugaacaguaauuuaaaaggagcauaggcugggcacuguggcucacgccugugaucccagcacuuucggaggccgaggcgggcggaucacaaggucaggagauagagaccauccuggcuaacauggugaaaccccaucucuacuaaaaaauacaaaaaauuagcugggcaugguggcgggugccugcggucccagcuaaucgggaggcugaggcaggagaauggcgugaacccgggaggcagagcuugcagugagccgagaucacgccaccgcacuccagccugggcgacagggcgagacuccgucucaaaaauaaauaaauaaaauaaaaggagcauaguauguccauaaccaaauaggaaggaaaaugccuauuuugauuuucauaacagagcuuaaacauuguggcaaaacuuuaaaaugcaggacauaauguaaaaauucuucuaccagcucuaaauucgugguugugcuaucaacuaugucacauuucucaguguugaccacaaaaauaccaugagauacauacacauugcugaaauacacuauuucucaaacucaacuuuaucuucuacuccaauaacccugucaaaaggaaaacuagucugguuacuucauuucuggcagauccacauuaacuccuuucuuuuaaugcucauuaaucuuucuguuaacaauacuucugacccucaauacccacccuuucagacaggucaaaacuaaauucuucaguuuaccauuuaagccuuuccuucaaguuuuugcagguaaaaugagauaaaaacagacguuuguauuccagccagauugaaauuuucuacuacccucuuugcucuucccauuaaauucuaccucgcaguuuguuuguuuuuguuuuauuuuguuuugcgucguuuuuuuaaaaaaaauuguuuauuguuuauuuacuaaaucuggggcauauuagauacuugaccaauuuaaaauuuacaucuuuuaaaucaauuuugaaguguuuucacacacacauacacacacacacacacacacacacacaauuggcaugcaacaguuguccuaaggugaaacaaucaccucaucaacaaagugucauagguguucucacccaagguugcuuauccuaaaccugaaaaccuguaacaaauuuaaauuacuuauauaaaacucauuacuuguaguuuuccccuugcaaagaucuccagaaauguacaaauaacuaauauacaucagucacaacauaauccuggaucauccccacaucaaaaccagaugcuccuuuaauuuuaaacucauuaucagagagcaagagaaagucauuucguuuuacacaaaacaaaauucacauaugccaaaaaagaaagacccaagagaaacaaaaacaaaaacccuagugcugacacugauguucagugcccugguuaaacaguggcccgaaggccacggaucaaaaauaaaauagcggcuguauaucacugcaaugaaguuuaacaggcuuuaaccuucuggcuucagaaauccagauuuuuccaauuacaugaaugcauacuuccuacauuccaagaguggagaaaguggaugcgccaguguggaaaugaaaagagccaccauucacugggacaaccacagaacuggcuuuaacagagacuccuuagaaaguuacgcaaaaaauaaagacaaaaaaugguuguaugcggcuugugucaucaauuuuaaguggaggugacugaguccuaagguacaauguaaaauguaugggggaaaauaggugcuggggcaagucuuaccuuuaaaagcaaaacuugaaaacaaaguauaaaagugcccagccuggcagcauacacccaagccagagagcucugccaugagcaugcauagaaaaugucaggauucauacuauuguuucucauaaggacucaacaaaaugaauccuuaauagcuuaaaccacagaaugagggaauacacagaaugcagucauuucaguaaaguacuaucaggcuuugugcugauuuccugaacuaacugcauuuuauuaucaaaacaaaaggaaaagaagauuuuaaaaauauauauauauauauauuccuauauuucaauuccaguguuuaauuucuggaaggaccuauauaauggaggcagcauuuaauuaggaaauuaugccaaucaauugucaaauuuucacuaugacuuuccuaaaaagguguuuucuuccaauuucuauuaaucacaaagaaacauaagcugugacuguauaguucagaaaauuaaaacauagaaauuaauggccuaugacguuaucaccaagguguuugguaaacaguaaacuaugaguuuggaaucaucaggaagaggcuuuugaaacaacccucuggacuucaaaaaaucucuucagguaguagaugugucccaaugucauggcaauuagaacaagagcuucaaagaagcaccgaaggaccacugggcuguuuguguugucacuaauggcucuguguauccucucccagauuuucguguauuccucuuugugcuguacagcugucauggccacagccagcucacugaucauuucuucuaguuuguucuggugagcuucuguuuccaugucuucucuuuuuguagccuccccaauaucaauggugaauaucacuaucuuuggagucaugguggacacucggucacuaaaacaaaauguauuuguuccauccaugugagcagaaaauguguauuucccacuggauucuuugucuccuuuauaaauccuuuuauucuuagguccuguaaucuccauguugaugcccaggaagccaccuucgaagaugaggcccaucuuggugccugaggugacucacuuaagcauucuucagcaugugcguggaugcugaugaaauagcccaagaccauggucaggagaguguucuggagcaacagcagcucagcgagcgucaccacaguggggcuggagcagaggccaggacucgcacugcggccuccagagccacugccgccaucaccacccuacugccuucgccuaccuggcacuuuuugcuaauccuaggaaaaacgcaaacucaaaugccuuuugugcugggagguacuguaaauaaaugaacagagaagucuaguguuaagaaaaauaagacaggccaagugcaguggcucacgccuguaauccuagcacuuugggaggcugaggcagguggaucacgaggucaggagauagagaccauccaggcuaacacagugaaacccagucucuaauaaaaauacaaaaaaaaaaaaaaaaaaaaauuagcccagcgugguggcacgcgcccguaaucccagcuacuugcgaggcugaggcaggagaauugcuugaacuuggcaggcgaagguugcagugagccagggucucgccacuacacuccagccugggugauagagcgagacucugucucaaaaauaaauaaauaaauaaaaauaaaaaauaaaaauaagacagcaguacguuacuggccgaacauaucugagucaugcgucaucaaagaauguuaccagcagugaaucuguaugggucugcagcaaccucaguucuuaccucuucagaagaaagaguucaaccaaggggcauaaggcagaaggagacaccaaagcaaguuuuagagcaggagugaaaguuuauuagaaagcuuuagagcuggaaugaaaggaaguaaaguacacuuggaggagggccaagugagugacuugagagaucgagugcaugguuugaccuuuugacuugggguuucauauauuggcauacuuccagggucuugccucccuucuccccugagucuucccauggagugggcuguucacgugcuggguggccugcaugcacaguguguuuacugcagugguaugcauacccacuugaggcaugcuucccuuaccuaucaagcgucccuauaaggucauacaccaguuaaacuccaccauuuugccucuuagugcacauacuugaucccacgcacccaccuccugagaucuuauuaggaagcugcugaucaccgguuuuagguuucuucugucuguugggagacuauuguucccuggugccagcugcaaccaauuauuauuugagagaaccaucuuaacaacugccugaccaucaccugauggucgccugacauuccuggugggauguggggugucccuuuacugccccaacucauaucugacuagcugacuagcuaccuacuguaacaauuacacuugauugcauuuuuuuguuguuauuuaauuuuuauuucauaaucauaaacuuaacucugcaauccagcuagggaacaaggaaaacauggaacccaaagggaauugcagcgacaauacaaagauucuaggauacugcgagcaaaugggguggagggguagucuccugagcuacagaaggaauggucuggugguuaagagaaaacacaagucaaacuuaguagagcuguccacagucagcaauggugaucuucuugcuggccuuaucauuccuggacccaaaguguuccauggccuccaugauauucaugccuucaccaugccaaagaccacaugcuugccauccaaccacugagucuuggcagggcacaugaaaaacugggaaccauuuguguuggguccagcauuugccaugggcaagaugccaguaccucuaugcuucaggaugaaguucuccucaucaaauuucuaccuguagauggacuugccaccagugccauauggcaugugaagucaccacccugacauauaaacccuguaauaauucugugaaagcaggaacccucacacccaaauccuuucuuuccagcgcucagagcacgaaaguuuucugcugucuuuggaaccucgucugcaaacagcucgaaggagacgcggcccaagggcuccgugucaauggcaauguggaaguacacggugggguugaccauggcugauaguagggugcucccggcaguggcagcgucugcaaagacugcuuuuuuuuuuuuuuuuuuuuuugacaaagucucgcucugucacccaggcuggagugcagcggcacaaucucggcucacugcaaucuccaccuuccggguucaagugauucuccugccucagucuccggaguagcugggacuacagaugcgagcuaccacaccuggcuaauuucuuuuguauuuuuaguagaggcgggguuuugccauguuggccaggucucaaacuccugaccucaggugaucggcccaccucggcaucccaaagugcugggauuacaggcgugagccaccacgccuggccugauugcauaugaaaugcacuauuuccccauccuaucucacccccaucuuuuuuuaacaaagacuucugaaaauguauuuuucaucuuucaaacuuugcuggacaaguuuuuaugaauagucucaacagugcaagcaugaugcuagagagcaauuaaccuuugacuucaguguugggagacugcagggagaggugaagacugcgacaaaccacucguguaucauggcaaucgcuacucccucucagccauuucuugccaacuaggaauucaggcagaauguugucagaucuuucaguuauuacagaaaaguaagaaaaccugcauuuuaugugaaacuuccagauuuucuaguauuuucuaauuuuugcuugaaaucuuuuauuguuccaauauauuuuauuucuauauuccuguguagcacacaucugguuuuuuauuugugugguuuuuguuuuguuuuguuuuguuuuguuuuuaggccagugagcugacagaucgagaccucuggguuaugucauuccuuggucaguagcuuucagucuuuuucaccacuacacccaccucaaccaaccauccuuuccaccaaccgaugcccaucacuuccuuucagauguugcugaagaaacuauuucuccauauaauuuucccuagaucacucuauccuucauuccucauuaccaaacuguuuuacucuuuuagccuuuaguauguaugcucugugguccauuggugagcccuuuaucuuucucuaauuacaccuggacuauagauuucuaaugccgaggacccuuggucuccugccacauucacauucccuuagcagaauguugcacacccagcagacaguacauguauacugugaguaaauauuuuguauuccuagucuugcuaggauagaaguuuuuauucuauacuugaugcauuucuggaucaaaauauuaagucuaagucaagucuccauaguuaagguaaucuugaggauuaaaacacuuagguggacaggcaacauaaaacacuuuaucugaauaaugaaagaagaauccgucuguuggucugaaguaucaaagcaacugucccaauccuacaaacuuucagcauugggacuuccuuucaagauguaagcagggauggaaaauauacaaugcaagcgccauuguuucacucuccugggccugugacagacaucauuaagugaucacaacguucuuuucuucuaaggcugaaugcagucuuagaaaccauuuuaacaugguauccuagauguaucguguccaucuuguuuauuucuauuaagaaauagaguuggcaugagagcugaagauccuaucauaugaagguacacauacaauuuauuauucaaaagccagagaacaacauacaacugcugcugcaucucagucucucuauauuuuaauuuauuuauuguuuugagacagggucuugcuuugugcaggagugcaggcuggagugcagugauaccaacacagcuuacugcaaccuuugccacccaggcucagaagguccucccaccucagcccccaagaagcugggaccacaggcauggcaccaccggcaucccgccauguuaccaaggucucaaacuucugagcucaagcaauccacucaucuuggccucccaaaguccugggauuacaggggugagccaucccaccuggccucaaucucuguauauuuuagaggauagauaacuucgaaugggaaaaguugucucuaaaguugaccagucaagaagaaacaaugcuuccacuuuaaugccuaugccagacuuaccuuacccauuaacuuuuaauccuguaagaaagauuugcuaugugaugaggcugcuuuuguugcaccuuguaaaacauacugaaauaaacaaacuguaaaugacuuugcagggauugcugauuuaaauaaauaaauuguuauaauuguaguuacaguuauagucaaggggcuauuucauuucucagacucugaaccaaagcaauuaggaacaacucagacacaaaaugaccagcaucaagaauuacaaugaaaagccaauuaccuuuaacuauaagaaaccuuauuugcauuuauuaaaacaaaugaucucucaguacuggagaaaauuauguggauugguugauuaacccuucacuuguaagagaccagaaauuacuuuucagagagccuguaucuuuucuaaauuuacagacaggaaaccaguaaaugauaaaugaucaaggcccaaggaaaaaacugcauagcacaauggacaucuaugaguuucacuugugcuagcaugcauuccucauugugcugguaccaucauccucacuuuccucuggggaauccccuucuccaguucugacuccagaugguguagauggagcuaacuucacuccccacugagaaugagcaaaugaccaaucaauguauuucaccgaugaaugauucagggagccaaucauuaauucgagucaguccaguacuacucaaugcuaagauuugagaacuacugaaggaacuauugugaaagggaagaauuuaaaaaaaaucuugcuggcauucugagcugguaagauaaaaacuuugagcgucuagcggccaucuaaccacuacaaagugagaccaugccuaugcgugagaccaacccaauggaaagaaaacuaagagaugauagagacauauuucugaugccaucuuugagaagcugcauccaaucauucuggaggcaaaaagcucuuaacuuuauagauaggcaagccaaaaucuucuuacuuucauuaagccacaguuagagcuagguuucugucauuuguaaauaaagaaguuaagacuaaaugcaaaucacuuauagcuuauuuuauuacuagguacucaaugucuaugcuuuugcauagcuaagugagagaacuuaaauuccaauacugaugggcuauuaccucaugcagguacccuaauaaaucuuguuuccucucagugccauuguuuccucauuucuaaaauggagauuaaaaugguagcucacaaagaagaaauacaaauggccuauaaucacaugaaaaaacuguugaacaucauuagucaagaaggaaaugcaaaucagcucuacaaugauaccacuucacacucacuagaauggcuaugaucaaaaagauagacaauaacaaguguuuucuaggcuguggagaaauuugaagucucauauuggcaagugggauuauaaaauggugcuucaaaaagcaucuggcaguuccuuaaaaaguuaaacauagaguuaccgugugacccagcaagucuacuccuagguauauaccucugaggaaauaaauauacaaguacacacacacauacaaauuaaaaaguccauaaccacauuauucuuaacagccaaaaugugggaaaaaaaaccuuaaauuuccauuuacuaaugaauggauaaacaaaaugugucauauccacacaaugggcauuauuuggcaauaaaaagaaaugaaguucuguuacaucucacaacauggaugagccuugaaaacauuaugcuaugugagaaaagcuagucacaaagaccacauaucauaugauuccauuuaugugaaauguccagaauagguaaauucacagagauagcaaguagauuggcagucaccaggacauaggaggagaggaaggacagugacuguuaauggcuagggguuucuuuucagagugaugaaaauguucuagaauuagauagugguaauggcuacucaacuuuguauuuauacuaaaaccaccaaguuucacauuauaaacggauaaacauugugcuaugugaauuauuucaauaagaaaaauaucuuauagaaaaaaaaugguagccuauucugauucucacaaaugaccauuauaagaaauccaugaugauaacaauauuaaagugacguucuuguuggagccuaaggaaaaacaauccauacaaaugcaaaggccuauuguuuuuaaggccucagcaagugcuaagagaaugggaaaagaaaauuaccaaauagauuuucccagaucacuuagcuuccuuuguauccagcaauggucaacaaauauauagcaggcauacauaaaagcuauucggagaucucuugagguuaacagcaugcaacauauugccacugcccccagccuggccaggaauauuauuuaugccacccuuucacagcuguaucaaucucccaugaaacauucagagccuccuuguuaauaaacuacauuaugagccggaugcauugucuggauaaacugcauuguccaaaacacugccccauuauuacagaaaaugcagaauguaauuaguauucuucuuugcauaaacugcagcuuccaaaaauggugccauauuauaaagccuuaauuaauaaacaagaguugggccaugaccaguuacacuuaucugaauuuuauauugugaagaaaggccacuguucaaauuccguuuacaaauaucuaaauucuggcuagccuacaugaagauagucuaaacagaaagccugagaauucuguguugcuaauagcauuguguugguacaccaacaauagcaagccauuaacugcugggacauaaaccauccugagaaauguucagaguggaaggaugauaacauuguauuucagcugcaucguauggugcaauucuucuauuuguucauaugcauuucccauuuaauagauggaggaaccaggguggcuuuucauaucucugugaaaccuuaaaugugggggagaaaagugagcuggcaaaaaaacaaaaaggauaaguacgagguauuguggggugggagcaggguuacaucacaauggaauguaaguacacaguugcuuucuccauuuccagcugguuuuuauugauuuuccccuaaccuaaccccaaagcaaggccauuuacauaagucaugagcauugaacuaauauuugggaccauaauauuaagcagcccauuuuaugaaccucggcuaaaggagcauuugcauuaaacugcacucaccugauuaaaauccaucaacucuagcaccuugagaauuguagaguaccuguuaagcucggcugugggacucugcauacugaggcagaccauaaucagaaggcagcaaggaauccgaccgggagaggaaagggaggaggagaacaugugauguguguugaaaagcagaucgcaugaaagaccgccagugcucaaaucugaaaagaguccuaagccuacugcaaacacagagcugugcgaacaugauaauucuuucagcaaaguccauaauauggcuuauagggcccugugaaaacaagguggaugagauaguauuacaguucagugaagaguaacuggcccagcaauggaauguagcauacacaggaggccccaaaauggucccugccucagcagaaugagcaagagcucagagaguccaagccgagggacuuucugcagccuaaacaagccgucuuagaucacugcccuuuccaucagcuccagguaccaagcacaggcucagaguccuaucugucucagaaggaccugcuuuaccgugaccgcaaggauggcauuugaaucaguaauaggcugucagaggccaccuugaugcauuugaagaagagcuaucccugagacauugguucaaguucucgaucuguaccaccuagcuguguggucacggacaagcagucuugcucaucugaccaaguggaugcagauaauaaacacaugugaaaugaaugaaugagagaauaagaccucugaagcagaauuucucuccccagugauacagacagaagacaaggaaauacuggguagaagagggagguucccuggcaaaggccccaaccucaagccuggagaccugcggccccuaaguggggcauuucuguuuuuguacccaaacgguugccuuuuggcaugccacacucccuuauccuguacccauauaaaucccggaccccaggcuccaggagcagacaaggagaagaggagaaaagcagacaaaugacacaacagagaaagagagaggagaaggaaugucugaacgccgagaggaacucagcugggggcagucggagaagaguuuggccgcugaacagccaaaacuccaggggaagaucaucuucccauuccaucccccagccagcuccccauccaucccauugagagccaccuccaccacugaauaaaaccccugcaugcauccuucaagccugugugugacccaauucuucuaggaugcuggacaagagcuugggauacagaaagcugucacacuggcccucugcccuugcagaaaggcagagggagcacugagcugguuaacacuuaagcuaucugugaauggcagagcuaaaagagcauuguaacacuggggccacaggcacccaccccuagacacuaccaugggacuggagcccaaagcacucacucuugcuccugcaccuggccaucugugugcucccucucccacaagggguuugaguucauggugguugaacagagagccgcaccccugucgcaugccccaugaguggggccagggaacucuucuguuucaucaacacuauugacauuugaggugggaugauucuuuacuggggaggcuguccugugcauugcaggauguucaucccuggccucuaccuacaagaugguaguagcacacauacucccucaauuauaacaaccaaaaagucuccagacauugccauaugucucucaagagccaaaauuauucccaguugagaaucucuaauuuauccuucagaauguacauuccaggaucuaaauuaaugagccauacacccagauagugcccccuaauuauuaggaaaacuuacauagauaccuucauuaucacuggaaauucaucaagacaaaaauuuuacugagcaccuauuaucugccauguagaaagauacuguuccugcuccugagaagcucacaaguuuaaguggaaaguggcauuuuacaacuucacaucaaagaaaagagaaauguucagguaaccaucuuuccaauaaauaauagaauauccuucuaucugauuagagaggugaacuguaaagacaggcaagaaucagagcauaucucuuugcuauuaaaagaauacuacauguaucaaaguugcugacauuugauaaggugaauuuuugguaauuuugacucauuuuagauguuugcugcaguuguuuauugcugggugcagggagucucagacucaaaggacaaucuuaugaggugguuuagccuaagagcauaagccaaaagagagagcucuggaaugaaacugccugguuuuaaaucuagauucugccauuugcuuguuacgugaccccuggcaauucauuaaccccuucaauccucaaauccuucucuaugaaaaggagauaaucaauguaccuaccucacggauuuguuaaaaggguuaaauaacuuauguaaagugcugaacacaaugccucccacaaagcaaaaauuguaagaacaauagcuguuagcauuguuauauugauauugcugccucuccauuuuauuaugaucuuuuuuauuguaguaaaauacauguaauauaaaaugugccauuucaaucaucuuuaagucuacaguucaguggcauuagguacauucauauuauuuugcaaccauuaccaucauccaucucuagaacaucuuuuauuuuccccaguugaaauuucccauuccucccuccaccaggguuguucucuuaaaccaguccuuacccagcaaaauaccuucuaaggaaaugaggacaaagcuuuuguaaaugagacuaaaggcaauucaaacucagguacccuggaaacugaauagagguagugcuuaaaauggccauuugggccacuugggguuauguugaugaguuuagucaccaugaaccaacuccuaggaguaacauucuaaguggguuuuuguuuuguuuuguuuuuuguuuugaggcaaaugguuccuggcucuguggccuucccaucuuaccaucacagaagcauucacucuacuccucuaaucaauauuaacccagaaaaaaaguccagggacauauauauuuugguagccuagaauuaaugggaaaagacaaguugcugggucuaaacuaucaaagucacguacuuuuuaacagagaaugaacaaaccuccucccuucaagaauccaccuguuuuugcaagagcauucuggggugggaggaaaaccuucugauuucuagccagcuccucaaaauagcuaaagaguuccuaauuucaccucaaaccucuguuucagcaccuacuguguugugccaaguuauuucucauccacuaucauuuuugacaguggaucugacccuauugcaaucgaguuuaaggaguuuguagacaggaacccuaucugagcugucagcacguugccugaucaucuucagcaaguggucuggcagaagcaugcagguaaggaugcccugaagcaggcugucaagaaaacugaccaaugagaaagguguuuugugcuccacagcugaagccaauucugcugggacaucccaagacagacuccacucggacucaacugauaauacacacuuuacaucugucacuaucugcccaggcauauugacuuuguaacauuccccccaggcacuucaaguccaguuucgacucugugacuuuugccuguggucacuuugccugaaaugcccuuucuccuucuccuucuuauccauucauuaggaucuagcaaaauguaccuccuuugaaaagcacuuucuguagcccucaggcacaaguggggauggcuguguuggaccagaaaaagcaaccauugaaauuuccaaacugaaucuguacuuugauuuauuucagugugguauaauguaugguauaauauauggcaauguuuuccaagucugacuguacaucacagugaccugggggacuuuugaaaaauagauucccaggcuccccuccaauuaagacagcaggucagaagguugcaacucaggaagcuuuacuuaaugucuagaaguuucccaggauauucugaugcaugaaccguacuugaaacaauagucagacauugcuacuuaucagcugugugauuuggggcacucugagcuuguuuccucaucuguaaaauagcggggaaguaggggagugucacaaggucuuagaaaggaccacaugagggaaugagugcaaaauucuuaaaugaugccucaguaagugaaauuaugaugcuaauuacaacgaauguccuuaaaaagcuacuuuucacuuccaauaguccagcuugcaaaaccuuccucuaucagagaaaaauuuagugaaagaguaaaugggcuucacaccaggaugauagccuggaaaaaucaaaagagacauugagacauugcccacauagaaagcaggggaagagcauguucaguuuuucugaaggucuauauucuucauuccuacuguccauuucuccugauuaaaagucucucccaauagcugagaccauuaacaaauauaagcccaucaaaugguagcuaccccacuuuguaaaauuaggcuuuugugucucucauagaauaauguucuaacacuucacuaccuguaauaaaguauuugcaccacaagaaaaaaauguauuucaugaccagcaggcuacaaccagcauucugcuuuuaggaacccaugcguuugauuguauccuaaguugguaaugagucaccacuuuugcauuuaguuaaggacaccaaacaaugacucugugaaccucagcucagacugccccugaguccucagaagaugccuaaauauggacuguucuguagcgcuuaaggauaucaaaugacaguauaccaugacaaucacaacuaaucgaaguccccugcagaguaguuccucauaaagagauggagauggaaaaguaggaacguuuuucaaugcuaugcagaaggaaaauaauaccuacugaccauauucauccuuucaaaggucugcccugaaggcaaguugacaacacccaggcuugguucucccuuuuggaagagcuaacgcuaggagaguucacccuugcucccucuggcgggaaucagcagaacagagcgggaggcacuguggcauuaggauugcaaacccuggcuucggacacagugcugcuugaaucagaaucuacacugcagcugggcaacuggcugaggucacauuuuuaggcucugagcugcuuucucuauuugcaaagugagaauacacagcuucuaaggucauaaugcagaucaaauuauauauaaagcacuuaacaugugcucaguaaaaagucauugaucuaauuauuguuguacuuuauugucauuaauaucaagggaaugacagcauagugagucuccuagggaugcaggucaauagauguugaacugcuauuaugcagcagguacugugcuagguccuggguaauaccagagcaaacaagaucaacacaaucugcaccuccaggaagcuuauggucuaguucagagguaggaaaaauguguuuuguuuggccugcaccuuguguauaaacacaaaacauagagcaaacauuuuaaacuuggaugacuucacaccacaguccagauuucuggcuucucuuugaaaacaucagaaauucugagaguaagggagauuucuguccacaugccaagccuucuaagucccaaagcaccaaccuuccacuggagaguggccugcuggcucuucucauuaagaaaaaucucccucuggcuacacaugaugaggggccuggaggaauuaagagagaugagguagcugaggacacagguccaggggaccagaacugaagcaaggaaggagaaaggagacucagcgcugguucucuuucacgggguuuuuuugucucucagcucagcucgcucuguuuggcuggacacagaaaacccuggaggagaauucugauuccaacuugcucuuugcacaguuaauuauuuggagcucccagaagguuggagagaacaaugacuuccccugcaguggcagcuggacuagcuuaguucccuuuucugcccccaggggucagaacccaaggaaggggggcuauuuguuuuggccuuaaaccaaaucugccuagagacacagagcgaugcucugaccugagaccacaaaagcuacuauuucaaugccugguaaagcuccucucucuugccguccacagcagucuacugacgaaaaacgcguuuucccuaugcaaacuguuuacuucucuccuuugcaaauuggaaguaauguaaaaaaaaaaacaaaacaaaacaaaaaaaaaaaaaaacagaaagaaaagaaaagaaaaaaaccuauaugcacaagaauuccaucucuccuugcaaauaagauauuucacauuuccuuaggcagauagcaugcagacaaguaggggaacuaauugggauggaucagugaaaacaacgaaagcucauuuauacacaacuugcuaaguguccacaacuuuguucuaauaggggauccaugacaagucccucaaaaacagagaaacaggagagaauaauuuacacuuuauaguugugagcccuguaacaguagaacaaccuuccugcagucccagagagauuguccccacaucuaaccaaaaccauuaccaucaaugguguccugcauuuugaacaguuguuaaugaagucuugccugacccaauacagagugaaauggguguaguugcugcuacaggcugccuucuagccuuccugcaucugaauacauuuucucuguuggcuguucugauagagauucaucuggaauucuuaacuagauaaaucccucaaugacaagguaaggcccaucuucugauuaaacuuguauugaauuuauuuauuuggccaaucauguaauccauauuuauuagguaccuuuuaagcaccaagcauugugcugagugacggggauaucaaggugagucaaaacaaccauagucccuguccuuagaaguccagaggggcugggugcaguggcucacaccuguaaucccagcuuuuagggaggcagaggcgggaggauagcaugagcccaggaguuugagaccugccagggcaauauaggaagaccccauucuccacaaaaagggggaaaaaagcaaguccagagaaaaggaagcuacuaaucaaaagaucucacaaauauaaaacugacccucugaaagguguauaagaaguauuuugguacuaggaggcucuauuacaaagaguucgucuagauaugggguggcagauaauuugucucagaagaaacaguacuugagcugacauuuaaagccaggggaaaagcaucauaggcagcgggaaucaaacacucaaaggccuugccgugaggcugagcaguaaacauaaggacugaauaaagaccagugagauugguguggagaaugcaaggaauagagugaugaagauggagaguugguagggaccgugcaaggccuuguggagcacuucaaagauuuccagcaacauaaagcuauuuaaagauguuuaagcaggguauaauggugguaguugaugugaucagauuuacgcuuugaaaaaauauagauuagaguuggcauuuuggggggacacagaguagauccagguagauccagguagaccaaguagucuagaccuccuaggucacaggugucuaggaggggaugguaauuuggacuuggaugguauggcgcuagaggugauguagccacauugacauauucuaacaauaguuacucugguaccaacccaauauaccagagucauccaauggcccaagagugguacuaacuguaauuccugauucugugaagcugaguaaaaacauuuagaaagaccaaacuaaaaaggaucugaacgcaucuguacucccucauccccagcagcaagguaccaccacguacucugagugaucauagcuuuauacuugaauugacaaauucugcauaagacuccacaggaaacccauuaaauaggcagggaagaaaaugcucaccauucagcauugacaagaaagaugauaacaagcaaguuuucagucaaaguggguaaaauguugaauuucuacucuagugucauuagcacugcaccugauuuuuuaaaacaauauuuugguuaaucaaaacucugggucaaucaacuguuccacagugacagcuccuguggucaucaaucuuuguuaucgcuugaagcugacauggucucgguccacaggagaguaagcagcaaaagacaaagguuucucuucauuucccccaaagggaguuaagcaaugagucauaaaagcaucuaaauuauucacauggcuuuccagaaguuuaugauucaagauuugggagagauaauugaaggagguggggugggaaacguaacacuggaugaacacauuuauuuugaaaaugaaaggaugaguuucugagguagacccaauuaccacacacagggcuucaggagcgacagcagcggccuaugguuccgccacacaaugcuucauucauuccuuacauggguucggacgaucauuauuaaccuacagucaccugagaaaagcucagugucugccaaucagucacacuggacuuuuguggaaauggaaaaaggaagagagaguaagaagggagggauggagcaaggguauggagggaaugugaggaaagcacaaggaggggccagaaggugucagcugguggaggagauaaaauguuuucuguuucuguuuuacuuguaggguauaagaaagagacaucagugugaagauaugccacuggguaggggcugaggguuguuuguauguuuguuuguuaauaaacguggcuugaauuagauauauggcucuccguuuuaguauauaagaaauacaaguaaaagaguucagcuauugugaaacuucauucucuugccaaauggaguuuccuugacuguaaugcuccaagacugaaccauguacauucacuauuuauaaaagcuagacaugcauuuauugaaccuaccagauguagguacuguaaccaggcaugauuaacaguagaaagaacugaaaaacccuucaugauucagccuuaguuuaccuuacugguuuuaucuccugugaauucuccuuuaaaacuaagaucacaguucugugguucuuggaauucacaaaaaaaaaaaaaaaugcucuacuuccccucuguguaugugaguauucucucugcacugaaugcccuuccuccuucaucuagcagcacugcuccucucugccuggaauugucuaauuccugccauuccucggaucuguuuagacauaacuuccucaggaugccauccugaauucugagcugagucagguaucccuucucagggcucucacugagcuuaucucaacaguagucuagguagcauucaaucauaauuagauagugugcaagcuuucugauggcagaggcuaagacguuaucauguuuguauccccagccccuagcacaccaugaaacacaaaaugcccaauaaauuuuugcugaauaaauaaaaaaauacaauacuugauacccaacuccaaggcacuuucaguguaguuaguaaagauagaacauuuugaaacauaacacagcacagggcaauaugaaagaaaauaaaaaauuaaauaaaucuguuauaagcaacaaagcagguauuuagagaaggcaaagauuacuuuuagcuggggugacaggagcaacagaaucaacgacaauucaauguguguucaugacacaaguccuguguuaguuguuuucaacaacaacccuguaacuugauaauauuauccccauuaacaaauguggaacccaagguucagagagguaagugauuuuucaagguuauauaaucagcaaugccaggauuugaaugaugaaucuaagauuucaaaacacugagaauggaaagguggguaucccagguagaguaaaaacagaaacagaaaaaaaugugcaagugcaucucaguguaauguauguccuggggauuaaaaacaaaucaacuugauauaaucuauuauaggaaugcuaaggaugcugauccuagcaaguaagcugugacuagacugcugggggccuugagugucaugcugaggaacuugggugcugaggagccauuagaagcuuuggaguagagaaaaugugaucagagcugaaacucugaaagccuuauuagagagugggagauaggaugaacuggaaagauaagaaggaaguuugcaggcaagguaauucuguuggggacaaaaaaacuuuuccuuuaucuucuuauguuagguauuugggggccugcaaauuaaacugacaaaccacagauuaacaggagaaaaguuuauuuaugugcauauggaagcuuacaaaagaaguaacucaauaaaugguuaaaguuagaggcuuauacagucuugccuggguauccauggggaauugguuccaggacccucucucgcccuccaucggauaccagaauccagguucacauuccuuauauaaaauagcaaauauaaccuguacacauccucccguauaauuuaaaucauaucuaggccaagugcgguggcucacaccuguaaucccagcacuuugggaggccgaggugggcggaucacuugaggucaggaguucaagaccagccuggccaacacagggaaagcacaucucuacuaaaaacacaaaaauuagccaggugugguggcacacgccuguaauccuagcuacuugggaggcugaggcaggagaaaugcuugaacccgagaggcagagguugcagugagccuagauugagccacuggacuccagccugggcaacagagugaacuccaucucaaaacaacaacaacaaaaaucauaucuagauuacuuauaacaccuaauacaaucuaagugcuacauaauuauuacauuguauuguuuaagcaauaaugacaagagaaaaaagucuauacauguucagcacagaugcaauuuucuuuuuuucaaauaguuuugauccacuguuaauugaaccucagauauggaggggcaaauguauaacuaccuuaguagggaaaaaggagugggagaaaagaccucuuuggaaagaauaagcagguuucuacaggaaaaacaaugagagauaagaaaguuuguaauaauguuuguucauccagguacgaguggucucucugucuucuucaaggcuauaaaacucccccagagaggauauuuaugauauauugagucuccuuccuaggaguaaaagccacccugaagaaggaauuuaugaaagccucauuucccagaaguuucugcuauuagucaaauaagagaagcucugagacgguuuuuuuuccgcaucuguugaaucccaaaugucuucagcuuaaaauaaucuucagaccaacucugggcuucugaguggguacccgacauuaccaccuaggagccuagcacaacucuccagcuccaaaggcacugaugucugggauggagggaaaggguggauucaagcccuacugugagagaagacaccaacagccccuaacagcugaguuauugugcgucugaaagagaaggaacuaauggugacuuaaaagcauuaagccaagaugacagagagaucauugucaccacuaacacaaauaaggaagccagucaggagaaaguacuaguuugaagggggaaauuuuaaacaugcugaauaagacacagcaggaaaaaucucuaggagacaauuggaaacguggaaccagaaaaccagaaagugaucagugcaggaaaugcaacuugggagucauuugccuaaagccauaacuugaagccauaguaaauguggguauaucuccaaggauuaaggaauagagaaagaagacuagaagguaagcaacaaaucuuaguuaauacucaaauuuagauggucugcaugugacauuaacaagugaaagauacaaagaauuaagauuaaagugcccaguauaagucugacacuaaacugggaacuuuuucuaugucauuuuaugacguaggcacuaccucuauuucauuaaaaccaaggcugagaguaauguaucuugucaaagccauauaacuaguagacaacagagaugggaucaaaggcauguugccucacucagggaccaucugacucaugccuucauggacaggacugugggauggagggcaauggaggaagaguuuucaggagugcauaggaugaacguagucaaaggcaauggggaccgagaagaggccacugaauucugaguccucugagaggacucaccucucagaaauaguugcaguauaaggucuaaaaucaaggcccccauauuuugugcugcuuugacauauggagaaauucaggagggccucaaaugaccuaaugacaaguuccccuccugacaugguuuggcugugccuccacccaaaucuuaucuugaauuguaacucccacaauucccacauguugugggaggaacccagcaggaggugauugaauuaugggagcaagucuuuccugcacuguucacaugaucaugaaucagucucacaagaucugaugguuuuuaaaaugggaguuucccugcacaaggucucucuuugccugcugcccuccauguaagaugugacuugcuccuccuugccuuuagccaugaucaugaggucucuccagccauguggaacaguaaguccaauaaaccucuuucuuuuguaaaucacccagucuccgauauaucuuuaucagcagugugaaaacagacuaauacaccucccagcucugcuccugcaaauaaagucccccagccaaacaacccucccugucaugugaaccaggcaugguuccugcuuauuccucuuauuccggaguaguggauuucaguuuccugccagccugcagaauuauucagacaagccgacuucauccucccauagaaacagggauaaucccaccccucuuaauacuaaagccuucuucccacauccccugauugcucacuguguucccaagugcaacucccacguggaccuguguggcacucaggguccuuccucccugggcugugaguauaugugacuaacaaacugcugucucacugguccaguguuguucagucaucuuucuaacccuagggugggacccuuucucaccaaccagguaagucgagagugguuagaacaacagaagacaccagaguguuuacuguggaaguaacaugggugaaaugcuucacuuuaauaacuacuggcuuuauuacaacugaagaaaucugagaaauggaugauuacucuuuucuaauuuuauauaggaggaaacugaggaacagagagguguucaauggauacuuagagugagacagcaccaaauuauuuuucucacuuuaauguugcauuguucucaaauauuuuuuuuacaagauccuuuccagaugcuucuaugagaaucacauauauccaguauuuacagaaagccauugcaagcaauaaggaaaauccaaaaagcaaaauaugggcaaaggauaggaacagauaauuuccaaaagaagaaauaggaaugccaaugauggcauaauguccaaccucacuaugaaucaaagaaauucaaacaaaaauuacaacaaauauuuuugucccuuuuugguugagaaagcuuuauacuacccacuguuggugagauuuuaaggaauuggagaugcucauacacagaugggauaaguagaaaucaguaucucucugaaaggcaggguagcaacuuucucaaaaucuuuaaugguaguauuuuaugaaaaaaaaauucauucguaggauuauauccaaaggaaacaacuugugaaauucauaaauguauauggaugagaaugcuuauucauuguuuuuuuauaauauaaaaaaaccagaaacaaucuaaaugcccaucaaaaggggauaggcuaaguaaguugugguacaccuauaaaauagaauacuaugcagucuuuuaaguggaagauguagauguauauuuaucaacauaggaagaugauauuugguuuuaaaaacuagguuauaaagcugcagguggaagaguacacauauuauguaaaauguuuauaaaauuuuguguuuuucuacguacacgcauaaugagacauuuguugggaaauuugcaaaguuuuaguauuccauagucuucaaauuucaggugagucuuacucucuucuuuaguuuaucccaaaggcacauaucaguaaucaggaaauaaaagguuguuuucacugggggugggggaacacauggagaggaaugaauaggucaccucaaaaagaaagcauacuucaggaagaacuuacacaaauuacacaacauacuuugcuuuugcacuuauuuuuuauuucccaacagauaacacgugaaauuccagaaaggggagaaucaauugugcauucgauuuuucacagggagcucaugaaacuaaggcuucugugcagcagcagggccauggaguggaaacuggaaggcgacuggggucaguaggugcuggccagucccucucugauugaaaaggacaugugaagggugccaagugagaccuccucuccaaguucucaacaauggcuacuuuuuugcguuuuauuuugugaacaauucgaacccacaacccuggauacauuccacuuguguagguuuccccuucagacagcaaaugcugcuguuuccaaauccaaucaugaguguuugcuguuggagcgcuugguguaaggcauguguguccuauaaaauauguuucucaaaacuuaacuuuuuaagaaaucagucacugguuuaucucccaauucuaucacccagaagaagagaaagaugccaaaacagaucccacagagaguuucauucugaaaaacagacauuuaauguaguuauucugaaaaaaauacaaacuguauuaugucacuuuagaaauuucaaaauagagaucucuagguaucccguuaggcaucugucgugcucccaauuacauuacuuucgacagcccuaagagaagcaauauuuauuggccuacuaagucuuuaagaaugcaaaacuuaacccaucuggaacuaguuguguuguuggcuccaggguuccuuacaucagaacaaauucagacauaaacucugggacaguucuugaauauugcaugaaggugaguugcaggcauucacacaacacagcauugucuuuuaaagcauuuuuauaaagcagauccaaaggcuggcaaaccuuuccuucaccauaaaggaaaucuaggcuaaaggggaaaauaagaaguuuaugaacuauuaaaaaaauaaagcuguggaguuagggaguuauggauuagguuccaauccauuaauucuuuuauucucuggcagagcuggcugaagaugugcagcccucuggcggguaacagaaacauucauguccagaacaaucacaaaaagggagagaaauggcuggcagagcagagggcggauccacucauuuggauguuaauuuauacagaaaucuggaauucaauaaucucacaucccccagguaagggagcgauccacucuccaauuucauuugggaguucuauuacauuaagcaauauucuguuuggccagacaugccauucuucucuugaaggaaauuaauuucuugauucuuccaucuaauaaucuaauauaaucccaagucagugcuuuaaguuuucucaugacacuacuagacaaaauaaacucugaaguaccucuugugggaacucacaagauacagaugaaaacaaaagaagaaaguaaaauugaagagggugaggccagggacaauuagguauugaacugccugcccugccucugacacaugauacaugugauuuguuaagacgauuuucuauccuuaacucuucacuaaguagggcugcuuuacaauuuccauaggaaauuuauuuuuaaguauguaaggccugugaacaggauaaauaaaagauuacaaggaaaaaaaaaagcagugauuucugguuguuuaaaaggcaacucaacaagccuuucccagcaaaaggaaaaggucaggaucaauaaaagggccuuuccuuugggaggagaucuguuuucaauuuaacaaaaauaaauccuuaugguguagucuucugaagaccaaggaaacaucaagcuauacaagggaucuggccuuaccaggauaagaaaacuucuucauuugauauucuccaauaauaucaaaacaaaguaaacuguacccacuuugcacucuuucucggcccccugccuguuagugaaaggccaguuaaccugaaaaaugaaaaccagcucuuaaauguaaagaugauacuacucauugaugcaauguuauccugauaguggcuuuucagagauaucaucuuaagcgugauaucaacagggggaaucucacauacgaguagaggcugguuuagaaaaauccugcaggauauggagugucuuuggugacagaagucauacucuuaaagguaucuuggucaaacucaucaucucuuacucuuuuuauauuagccgggcgugguggcacaugccuguaaucccagcuauuugggaggcugaagcaggagaauggcuugaacacaggaggcagagguugcggugagcuaagaucgcgccacugcacuccagccugggugagaagagugaaacucugucucaaaaaaaaaaaaguacuggcucaacuacuaugaugagaagcuuuugggagauacucagugguaaugucagccuuauuuucuguggcaaaucugaaucuuugcugccguaacacaguuguuuucaacauuuacccuuucuacacucauaggcacacacacaauuuuaacugaugaauucauagaauucauaaaccugacagugucccauugcuggaaccuuagucauacccauuccuagcucuugcuaacuauaacuucuccauuuuuccuuccucucaagaaaguauauuagauugcaagguugcaagagaguaagagucuuaaccuuaaauaugcuuucauuuauuagaaaaaaggaaaucaucugcauccuucagcaauuuaaauauuauuagagaaaaaccuggugggauucagcaucaaaguuauucuccuuucuggcaugaccuccucucagcacuucuucaaguauauaaauccuaccaauaccucaagguccaucuacucuguauucugaaaauacuccaaucuccucucccuggaaucuaccaggacucucaaacucaaguguuuuccagcagucaggaaaguuaguugcaugcugcaggccaauuuucaggcauguguguuuacuggaugagugaugaggacaugacaacagaagagaacacguccucccugaagggggcagcagccagucagucccaucccauugcugucaggugggaaugcaggcccauagcuacccgaucuuccaauguuuuaagauaagucgaaaaucugcauucuauggauaauaucucaacuucaaauguuggcucacuuaggaugacaaugacucugugaucugcauuggacccauggaaccacuaauuugcaaccucugguuucuacaaaacaugaagcugacugauaaaugacaagcuugugccauuuaucagcaaguguuugcuauuucacaucaucagucacaucaguauuucagagagccauaaauaaauguauaaguuauagguaacaaaaauaaagcagggcuuuaacuuaauuaucuuuaauuuagcuuauuuaaaguuucaaauaacauguaaagagggccugagauauuuauauuuagaaauuuagagacauugguuaaauaaguuaaggaacaaugagccagacucugaagucccagcaaggagggacuguaucuuuguuuuauucaguaccuaucaagagugcuaaguacacagguuugaauggaacugauuugaaucauuuaaggaaaaagguuccagacaaacauugcaugcauuagaaacugaguauuucccgauuaaacauacaccacccuuacauuuccaaagugucagcaaagcauucuguucuuuggucaaaucuuguaaaagccacuuacuccuaaauauuuuuacuuuguaaccuucaccguuccaaguucaucuaaaagaauaaagaaaauaccuggcacagagaaugcauucaaaguguauuaguuaaauuucacuaaaaagaaguaaacaaaagacaaaaaacuucaaugcaucuugauucucuguagagagagcaccuuguggcuugggcuucuucuaucaaacacauacccacaccuuuuugucagauaaacucauuugguuuuucuuguguaauggggugaguauuguacaagguuucaaugccuuuuuuuuccaacucacauugucccuuagaagcucgaaguacuaacaaagugcuucaccacacaaaagugcugucuacauuugucuggcaaauacgaugccaaacgaaaagccugaugagucugcaauucgucaugggcaugaucaagcuccaggcugcuuccaccagagagcaaauucaacauuauaaaggaaguguggacaggaaagccuuccagcaagauucucagaauauggacaugagauucaaagacuaauaaaauggguuggggagacgguauugaugaagaagcagccggagaggaaaaaaggaggauuugagcagaugucugucacuaaagaaagugaaagacacagaggaaagagaagaucuauguuaucaccugugauccuaaaacaacucuaggaauuaggccgcauuauccuugcuuuuauagaggaagaaaauguggaacagaaaagcugaauaacuugucacagucuuacccagccaauuaguggcuuaacuggaguuuggccaggucuuuuugucuguauagcacaaaccuugugaccacacagcacuaacuuccaauaagucacccaaaaagucagcugcauguaauuagcucugcugugaaacuauggacuggggaaagggcauuguucauuuguuagcuuaauuuuuguuaaaggcauacaagaccaaccacaaaaaaagaaaaacaaaaacaaaacaaacaaacaacagcaaaaaaaaaucagccagagcuguagaaaaucaacucugucauuaguaaguauauuuuauucaaguauguguuauuaauauauuugagaucucccaaauacuaaagagauagaaauuuagauacauuggagauaaacuucaaguaagcuauuuuuucacuauugcauaaaugggaagauauuuucauugaaaauaauguuccuuuacucaaucacccaauauuuauugagaaaccaccugggccagacauuguucugaauucugaagaucagagagugaacaagaagcaacugacuuuguuuuguuuacaguucagauugaacaaagcaauggcaacagagaaagaaagagaagccauuuaugguuugugauaaaugcugugaaggaaauauuuucugauagagaaugaauggaaaacuuccuuuaggcaaagaggacaggaagggccuccuuaggugauugugucuaaaugagucaagcaugucgaggguugaagaaagggugcugcaggcagagagauaagaguaugcuaagagccggugaggacacugaacuuagcucuuccugggaaguggcagccccuugaguuggugcagugaccaggguggacauguguaguauaagcuucagggaagaggugaguagaaaccagccagccccucaugggucugguauaccacuagagugcguuuggaauuaauuguaagcacaagagaaagcuguugaaugauucagucuucaacaagggaacaacaugaacagauuggugguuuuauuuuggcugccaugugaagaauggaugacacgacacucgcauagaaguggaagacuagucuagaguuuggaagauagcacuuggacguccugcuggaugccugccauuacccucuggaucugcccuccacccuuuccucgccuguugccugccucagaggcuggcuuacauggacuacggcccagggcucucuagcuuccaguuaguuuggucaaugggaaaccccagccagagaucagaagggaggagaaagaacuuaggauauuagucccucagcacccugucaccuccaagcagaguuucucacagguugguuguaucccaccacccagggcugcugguccuucagguggccucugccaaggggccugucacacagcucucccucaggucccaauaaccuucccucuccuaugccucuuuccuccccuuuacccuucaggaguugaguagcaucagaaaacgcugcagcuagccccaagguacugcacucugucuuguaguuugaaaaugcuaccuuuguuaaacucuagucaaauuacccaauguauggaugccaucuguuuccuguggggcugacugauacaggaagagagaagcaagauacuauuuugacacguucaguuacugugauccuugaguaacauucuguuuagcuugaguucauauaacucaaaagguuaucaaggaaaucuuacacccuuuuaccuuuuuaggagaagcaacaaauucaccaaagagguaaaaugccaaaaucaugggcgugcggauucagaaaauaaaauaagcauuaguggucaucaguauuugauuucaggccaauuguuagagcugucgcuuaaaaauuuagauguacauuucucauuccauguuucauuuauucaaucaauguuuauugagugccuacuacuugcaaggcacuauuuuaugaacuagacauagagcagagaccaaaacaaaaugccuacucucuuggagcuuacauucugggggagaaucagaaaauaaacaacucaaugauaucuuaugugcuuauaagaaaugguuaacaggaauagagagugggagaucagcaagaggacugcugauuuauaaaagacagaguaggccuuucuuaaaaggugauaaucugagcagagaucuaaaggaaaagaugaagcaagcuacggcgauguccagggcaaguguguucugggggcggaaaucaugagaugacgagguguggguggcacuuuugaguaccaguagaaggccagugccacuguagcagaggaaguaaggaggacauuggcagccuaugcaaucagggagacggcagggacaagaugaauagccucaagaacuuuggcuucuauuuugagacaauaaguuuuuaugguuuugaguagaacagugauaggaauugauuuagguucaaggggcucauucuggcuacuguguugcaaauaagguggcaaggauagaaauagagaacacuuacgcaaaagucuagagcaaagauggugacuuagaccaggguuguagcauuuauauuugauaugccauuuaaauauccaagggaacaugaguaggcaugggauguguaaccgaagucuagaguugaaagaagaggucuaagcuagagauagagauuucgaaaacaucaguauuuaaccuugacaguggaugagauuuucuaggaagugaggagagcauuaagagacaaguuuuuaaggauggagcccugagucauuacagauugacagaucagaaagaggaugaugaccagcaaggagaccaaaaaggccagugugguuaagugggaaaccaagagggugugguguccccaaagccaacugaaaaaaaaguaugucacgaaggaggaagugaucaacuguaucauguacugcugauagaucaaguaagaauagaacugaguagaaaaauggauuuggcaaccaaggggccauggaugacccagacaagugcauucugagaagcgguggggaugaaagugggauggagagaacaugugcaggcaacuccucugauguucuuugcuguaaaugggaagcagagaaacgugggagcuggaaugaauuaugcaggcuucuuucuuuuuuucuuuucccuuccuuccuuccugcuuuccuuuuuuccuuccuuccugcuugccuuucucccuucuuuucuuucuuccuuccuuuaucuuucuuucuuuucucccucucuuacucucuuuauuucuuuucuuuaucucuuucucuuucuuuccauuucucucuuuccuuccuuuguucuuuuucucucuccuuucguucuuucaucucuuuaguuuagagacacuacagcaucuucauauccucucagaauugucuaguagggagaggaacccaaaugaugcaggagagaacagauaauugcggaagccaaguguuuuuguaggcauguguugagguucacggcaccaugaaggccgaggguggaagcagaacaguucagagagcacauggucuaggagcagguaggcuagugagagcauguggagguuuccuccugacugagcuuugcucaguaaaacaggaaguaagggcauacacauagcaggaccagcagagagaagcuauuggagaucugagaaaagggugggaaauagucauccagggcaaguggguggaguaggguccugcaguaggauugcugagcaguguguugggcuuuaaacugccuuucauaugaauccacaaauccuacuaauauuaaugaaagauauuaauuuucauuuuuccugcucccgucagcuuaaaacgaaaaguuucucuacuuagcccaugaggagucagaaaagaaaaaguaaugcccagcaaauuucuccuuccuaagcuagaaaggaaaaaauaagauauucauguaaggaaaauaaagaagacauggcaacuugaaauuaugaagaaauuccaaauguugcauuugguaguguucuuaagcuaccauaagagaucuucauucuauucuggguagggagaauguacguggcaguugcuaggaaugauccuuugcccgugauccuucccaugugguaccccacuguccccaauagaccugaguggcacaaccaacaaaacaacauucaaauauauggaaaugaucuuuauuuuagacucuuucucauuuagccuguugggcuccgagaaugugaaaaauaaaucugaagccuuacuuuuaauagcuuucuuauaaauuauccccaguauguaaaagcccagcuccuagauauaaccagaagaagggggaggggggaaagacuaaugaccuuugacauuaaaauuuaaaauguccugcaugcaaauacacuuuccugccacucuuuuguaaugcaauaaccagcaagaauuagaauugcaaaaauuccaaaagagcuacauggaaauuauacaacaaagugguuucacagugauauugagaaaggaauaugaaaugaauacaagauaacauagagacagaaugggguguuacagauguaugagugaacgugcguaugagcacaugcaugucucagagagagcaacagauaaaaaauuauuucuuuuuuuauguugcucuucaugagcaaaauuuuaagacagacacuguucuggucacauuucaauaaugugacacaugguuucuauuuacauuccaaaugaguuuucacuaaaugacuuucgaaauauuuacuugcaaguauaaaggagacccuuugaaugucugauuugaaaaaagaacaaaaucaagcaauuaucaacauagauguucuaauacaaacugacacuauuuucuuccaugucuuuuuuuuuuuuuuuuuucauuccuagacaccacaaaagaccaaugcuacagaugucucucuuucggcuuuaaauacuucaacugugacaaugauagugagacagacugcuucaggcccuguagcuaggacauaauaaauaauucaaacaaguuuugaaaaaucauuuggcccauauaauauaccagcuauccgaacauuuaccaaugcccgcccccuccccucacaccucauccuuauuuucauuuuuugcugcuuccaucagcuuaaaaugaaaaguuucucuacuuagcccaucaggagucagaaaagaaaaaguaaugcccagcaaauuuauccuuccuuugcuaccggcuuccauuaaauugaaggugacuucacauugauccuggguucaauucacauauccaaagagaccucagugauuaacauaaagggcaguccaaucaaggauagacaccuccauguguguauggugagcaauuuggugggauguaaaacauaaaugauguagcaucagaacaccugguguggaugaugccaccacuugccuacccaguuauucuccacuucuugcccugaguuuuucuuucucucucucucuuuuuuaacuuagauaaaaaauaaucagcuucuuaaccucccuugcaucuaggagucaucaaaaagauaucgguugaucaauaagaucaauaagaauuugauaggcagggcuuccaaaaaagucuguugaaaagggaagacucagauaacacaguuuguuaguguuugccuuuugcccaagauccuucccucuuucuucugccugugaugcccagggauggaguagucaguuuguagccuaugaggacaaaagucccauggcaaggcauaaccaugcagaaagauagaaggaacugugucccgcuggcacuuugaacuucuugaggcaucuuggggaaaauaagccccuccuuggucuagcaguaugugacaguuaauuucaggugucaauuuggcuaggccaugguauccagauacuuguucaaacauaucuggaugucacugugaagguaauuuuuagaugagauucaucauuaaaucaguagacuuugaguaaaacagauuacccuccauaaugugagugggccucauucaauuaguugacaauuaguugacagucuuagaaaaagaguagcaucccccagggaagagggaauuuugccagcagucugcuuuuggacuugaguggcaauaucaacuguuccuuggguauuuauuguguuggccuaaccugcagauuuuggacugagaucucagccuucauaaucaugugagugaacggcuuaaaaucgaucaucucugucucucucuggagaacccugacugcuacaccauuacaccauucuaacuggguuucuguucacugaaacugaaugcaauucucucugacacaucugagaucaccacuucauacacuguguaacuguguaggugucugugacccucagcuuccagaucuacaaaaugggaauaugaguacuccugacuccacaggcuuguuggcuuacacacgagacagaauguguaaaagugcugugcuguguuaaguuacaaagcccaaucgaaaugauagggaucauuaucauggugggcucacugucaauucacgacuguaagucuguuaugauuguauucacuuaaaauaauaauauucuucaaaucugaccauaaaaagucauuauagaacauuugaaaguucaaaaacgcaugaggaagaaaacacucaaccaccuccaucauuccauagcuacugucaucuaccaauaccuagcauuuauugaguuauuauauagcaggcaaugugugaagcaauucaaugcauuaucucuacccugugaagguagguacuauuuuggugcccauuuggcauaugggugaaaacuugucaccggacauauagcuaguaaguggcaaauccaggauucaaacccaggucugaauuauucuaaagcccauguauguauccagcaacacauggcgaugagcuguguucuuuaauaauguauuggcuacuacaaaauuggagugugaucagguaacccuuacaucaggaaaaaugggguaugcacauugcucagcauauacacaaaucaagacucauauuacaaggcugcuagcucucuugucagggauaacauuuuaauuugaaaugaaguggaagaauguuucauaucagcuacuccgguuaacacugcuuuuuacuucagauaaagauaucccuucugucaggcacccugaaguuuuucuguaaaaaguuguguucauuuguuucaaacugcccauacauccauggucucauuucauuuucccuauagcccgcugaguuaagaggggcagguauuauuaacuccauuucacaggugaaagaacugagcccuagagagguuaacuaaguugcuuaaggucacacagcaaauuagugguacgacggggauuggaaagccuaacgccugacauccagcgugguauguuuuccaucauguagugcuccaucaccugucacucccaccauuccugaggggcuuggaguugauggggcaugcuaucaauuucucaggguaaaacuguccuaucuggguaggaaaaugcacacacacacacacacacauauacuagacacacuguaauugcaucugccaaaaugguuuuauaacaauccagucaaggauacagaaaacucccaggcugccuuucagaaacaaagcccaaaggaucaauuucaucaugaaauaggauuuccucagcuguagguggauggguagguggggagguggaugaacugcauuaacaauggaacaguggacugcaggguaaaagcucauuugacauucacugcuauuaagcaguggcaauguaaaccugggguagcaaagagcaauacccaggaaaaaauacgaagaaaaguuucaacuuaacccuucuguaacuuucuauuuauaagucucaggguauuaagucucauucuuuagaaauaacaaaugcauauuuugacucacucuguaagauauuuauaagaaauaaagagcaaggggguauugauuaagaaaaaacuaggaugagauuauagauauauuaauauguguuaauauacaacauauaauuacauauaauuaauauauaauaaauguacaaauauauaauguuauauaaaugacaugucaauauaugaauauauauauuucaagaucauauucuuaaccugaaaccaaaaaaaguacaaauagagguaacauauugcauugucuauuuagcauugaaaccaggauuuucagauagaaacauuugccuuuccuaagcuacgcaagccaucagauauuuaccucaguggcacuggucucagugaaacaucuuaaugucucuucucucaguugguuagaugaauggaugucauaagguaaaaagaggaacugcaagauuugaagcucauagaaaaaagacuggcacugggaauggcaguuaccgggagauugaaacaagaaggcuucuaaauaugcugucaaaaccagcaccagugaccucucaucaagugaggggcagcacuaaaagcuauaccuucuagaaugauguuaccuugaaaaucaugaggaaaucucaagugucuuucuacuacauuagcaaaaggaaguuuagggaguuuagacaccaagagacuggaccuucucaaaagggaauuugccacagaaucauagauguucaaaaugugaaccaagcuuucuuucaaauaaaagugaauaucagggcuuaaaacagaaagacacauuucaucaaaaaugauuaggggcccacgaguguugacuggggaaugagaauaguggguaagguuagggggaaagccagaaaaaaaggugaaucaaauauacuuacacuaaaaauccuggggcuccaugugauccagucacgguaccuugucacagagagaaauguaaucagggauccaggaaguucuuuacagguuuacuuggugugaugcuuaauauuaggugucgacuagauuggauugaaggaugccuagauggcugguggaguauuguuucugggugugucugugaggguguugccagaagagacugacauuugagucaguggacuggagagaaagauccaccuucaguguggguggguaccauccgaucggcugccagugcagcuagaccaaaugcagguggaagaaggugcgauaagcuggcuugcugugucuucuggcugccuucuuucucccaugcuggaugccuccucccaucccuccugcccuuggacaucagauuccagguucuucagccuuuggaacucaggaacuugcaacaguggcucagacuuuggccacagucugaagccugcacugucagcuuuucugguuugagccuuucagacugagccacuaccagcuucucucucucucaauuugcagacagccuauccugggacuuugccuuguaauggugugagccaacucuuccuaauauauucccuuauauauauacauacauauauccuacuuguucugucccucuggagaacccugacuaauauacuuggacacaugaaaaauuauuaagaagagaugucuauucuuaaugcauuaagaauacuguaaaauuauucucuccucauugcugccuuucugaaaauucuucaugugguuggcagcugacucaggagcacucucuuuccuggcacuuauccaauggcucuaacacccaaucugggcagccuguccggcuuacugucuccaucucuccacucuugcuuauguacuucaacacagacucuuuauuucuuuacuuuuauuucuguuuucuuuacuuuagggaggaccugggaguuuaccaggaagcucaaauucuuccuguauagaagcuaggaaaauagugaagauugugacuauccauacucgaauaauuuuauccuauaacaucucaacagauuuugucucuaagaauucuauugucucaaauaaacccagaaguuagcacuuuaacaugggagccuuuucaaaugguagagucucaaggccacaucugacuccagagaucaugguguuccuacaacacugagaugaugauaggaacuacaguugaaaacagaucuuucuccccacaucaccuugaucaagucaauaaauguuaguauaugccagguacugggcuagguaguaggaacacagagauaagcaagacaagauccuuaucccugaagaagucacaguucaguguaguauuucuaaaauugcauuccuuagaaugaaagugacccuuguaaaaauaauccauggaccaaauaccuuuuggaauguggcaugcucaaucuccuuuuggacauuuuucaugcucauccuaaugcgaaaugauuauauaaacuucaguucuuuacuccagcauuucccacauuuaacucaucgcugacccauuuggcuugcaaaacuuacgucuugaauugagccuacaaauguuaacagaaauucuaccauuagcuuaaaaaacagacaaauaacaggcauuuuaaagauaaaauaagaaauaaugauagcauuuuaauauaaaguaaauaguauuucaaccaaaaggcaagugaaucuguauguugucuuaauggagauuauauuuguuugcucacuacaguuuauaagaacagagaggaugauaaagacaccacaaugaugaccaugcacagaguguuucuaucagcaagccuauauugugggucuuuacucacaauauuuuauuuaauucuuacaucccuucuaugaaguaggaacuuauauuucccauuuuccuccauaaagaaaucaagguucagagaauuuguuaauuugucugcuacgaucaugugccugguaagugauggaagugagauucuaauccagacuauuuacucugaaaaccuaguggcucccaauucuaguuauauaucccagagaaucuacuguuaacugauuuaaaauguccauuagcagagaaacagauuaacaaaauucggugucuucacaugauagaugaucagauggcuaucagacuaucuguggcuucugaacagaaauaagaaagaggcuuuggcaagcucuagauuagaaucaaagaaaggcuuucccucuuguuaagcaacucuuguucuauugcgccccaacaagagacagaauguuucaagauaggacaccaggugacuguguggccugagcugcccaaccugaauuggguguuguuuuauccacugucuauuacauugggugcacucagcagcagcugucuguaucaaaugaaaguagauuacacgggauuguacuauuaggcuuacucuggcuaucccuguuuuaacccaaaccuaagacuucauggggcauuuuuuauguaguuaccugaagaaggaaaaaaauaaagccuacuuuacagacaacauugcacgauaagcuagcuccagccugaaguggacccugaauauuauaaccccacucaaggugaguagcccuaaaggacauugaagaagaaaaaucccaucagugggcaaaacuucaaauaauuaccucuuguggucaacacugccuggaaaaauaguuggccugagguauuguuccacguuaauucaugggcucaugaaugaggcauuaggaagaaaaagaggggaagacugaaagggaagggaacaaauacacaguaaggcuucucaaacuuuuaccagagugugaaaauaucugucuaugugaauguagacuagaagguccccacuguggagaaggcacucaguagcuagguaggcaaggccucuuucccugccaacucagagcuuaaucagcauauucauaaaagcuauuuaguaucuacgguggccaaauacagagguuugcaugggcugaccaauaaggacuucaccaguucuggccacugccacucccaaauguaccacuugcuagaaacaucaauaaggaaaucuguuggagaguuaguuuuuugauucagugaauaccaaugugcucucccacauuuccucuaccuuuugugguaagguggggccaugugacuagugcaggccaacgggcuacgaggaaacagaaaccugucaugccugugaggggcccuggcaaggcauaccgccugaccugcacaccaagugaugaggucagagaaugccagauugcucugcauucucuguauagaggaaaauugccccgcaaacugccugauuaauauaccaauccugaaucaaagauacagaaaaauacccugacuggacccuccagccaccugggggcaugcuguuuguauggaccccaucuaucauagaggagaugaaaauguauacuucuuggaaaagacauauacucaauaagaauuauuucccuguuugccaggcuucugugaacaaccucaaauguuuuauucaccuugauggucucccacagaaccuucuugacuaagaaacucauuuuauauguacauauauuuauauguacauauauuaaaaaguaaagcaauuuaguuggugcucaugggauuccauagucucaccuaguaccccauccucaacaguggaauggccaguuaauaacuuggcugugguuccaguuaaaagacaacacccugaaaagcuaaaggacuauccuacaggcugcagaauguucucuuaacuagugauuaauuauagugcuauuuucccauaccaagaauauauauguccaggggucaaaggggagaggggagagcagugccuuucaccauuacacagaacaaaucacucauuuugcuuuccuuaccaggaaauuugaggucugcuguuguagaggucuuacaacucaagugaaaaaugcuuccaacaauagauaugauaaaagaaaaacuucagccgaguuaaauuuaaaggacuuuaauugagcaaugaaugauucacgaaucgggcagcccccagaaucacagcagauucacagacuccaggggugccucauggucagaacaaauuuauagacaaaaaagguaaagugacguacaggaaucagaagucggguauagaaacagugagauugguuacagcucaguguuugccuugugugaacgcaguuugaacauucagcagucuaugugugguugaaguauggccgcugggauuggccaacacucagcuauuguuacaggugcauacuauuaacuuagguuuucaauuuugucuguuaagcuagguuacaguucauccacaaagacucaaauauagaaguauggccuuuucaggccauauuuaguuugcuuuagcagaugcaagaguguuucuaugaaauuggaagcugaaacuguccaguggacauuuuggacaccucacaccccacucaaacugaguaaaaagggaguuauuguguugggaggggucauuagucuugauuaucaguugggaaaugaaguuccugcucagcaauggaggccaugaagagaauaccuaccaugcagguaaauccucuggaguauuccugcuacugccgugugccaugguaaaggguuagacuccagcaaccccaaaugagcagaagcauugaggguuuccuggauagaauuacugauggacuguuuguucaaggguaaguuagaguauguuaagucagagcaagguauuauaacuugaaaguugaaacauggagaaaaaaaaaaaggaguauuauugauauuugguaccaagaaagggaucagagcgaaauuugucucgcguggcugcccaauauccucuggauauucuugcucauaauaauguuugcuccacaucaugaauucuuccuuuucaaagggaauuucagaaaacucauauccuuugcagcuaaggagcaggcaugcggucugcccuccucuucucaggccacacaagacuucacuguggaagugagcaaugaggaaaaacaggcuauguguggacauucauuuuuccaguauaggcagugagaaagguauccagauuuggggauguuaggauaaauugcaauaaaauuaaauccuucguauccuagauguuacagucaggaaaacauugugguauccaguaaguagauggugacaauugccucauaagcccaguucuaagaaaauguucugcagucaacagcaugucaauggcuguuuucugaccagaccaguucugcaacauaguuuuggacauuguucccaaaagcuuagccucaagcuuauuucucugggucuacaaugauucuuccaaaugccccauauccuuuaauaaauuccuucucuauuuaaauuagagcccauucuauuguuugcaacuaaugcuccugaccauauuuuccuucucccacuuucaauacccaggcaaagauuguuuuaaucauucacaaccuaacaguucucucucaggaaagucuaaucuagcaauauuuuuuucuguggaaucugcaaccuacuccuuuaccuuuaagccauaagcagugaaugaaacugacuccuauuuccagaaucccaccugcauuccuuuuccaacucaaucuucuuucuuagccuaaggcuagccuauuuauuguaugaaauauucuuuucugucagugaacauggcaacaucuuuggcuaagucaaaagccuaacucuucaucuagcuuucaacuuggaagcacaucccuggacacaccuaugcuuugaaaguaauauuuaucucucucucucucuaucccacuguucaacaaucauuuugucugcuuuuuuugaguuacacuuugcauaucaauacucuuucugaaaacuccuccaaaguguuaaauaucuggcauagucauuucaaaacaggaacggaguggucugcauguuaaagaaggcaagaaugccagaaauugucccauuucccauguugaucagugacuguguaacucagacacguugcagaggccuacauggccuacuuccugagaggggggucucacugccuugucaggauuccaguuuaagagcacagggcaagugagaccacugaauacagucauuuaaaaagugcuacaggaaaguauuuaaauagucaucuuauagaagggggugaaaaagcacauuuauugaugcaguaauuaaaaaaagauuuagauccagugugucaauucccauagaaucccacuuagcccccuuaucuaugucaaagcaaacuuaguuucacaucagcagugcuucucauuuaucuuaaugcuaaggauuuauuucuuaugcaaaauuguucauuuucaccagccuggaacuuuaaaaaaauucacauucucuucuucaagaauuuuuauuaagccaagaugucaucaagcugaaaaucucagacacaauuuuggcucucuucugcaggaaacucagaggagugcccaauccaggcaacagcagauuagcacuggcacugcugacagguucuuaaaaguguuggaaagagaagaacaaaggugguguacaaugauugacaaagauuucugcuauaaacuaaaguugaaccaauaaauaugucuagacucugccaugacuaucuguggccuggaagcugcauucuucagaagaaaaaaaaaaaguugcaguuggaauuuggaaugguuuugcccccaugaugugcacacaggacuuugaugaguagucugauaugcagaagcauccagauuaucacugagauagaaaugaaacauccagaugauagauuaaguagauuguucacuucucaucuauauauauauauauauauauauauauauauauauauauauuugacaucauagaggcauaaucaaaaucugaguagguaaagucacuaaccagaauacgaauaccaaguuaccugugugguuucauggaaaaauaauaggggaauugacaucaucuuuauaaauguuguaucaaugagaaaauuaugacagucggggagaucugaucuagcccaucugccuccugucuuuagcauucaagcugccaagcuagcuuugggagacauuuacuuuacaguuuaaaugauaauaacccuuccccccaacucaacugccuuuguaaagcuaaugagggaccaacugagggaaggagagaugccuggaugcugcuaagguacagacaugaacaauugccagccauuauuccagagaucacaagauuugcaacuucccuaauuacuccugcaggcaacaucacuauuguagauuggccuuuugagauacuguuucagguuuuuugcaugucuggcacccauggcucuacuuggacccaccaacugaugguuccucuggccagaagcaacucaguguaagaggacagcuucaacucccuaugauuaaaucuccaacccagccaaucggcagcaaacacccauugcauagccaucccuacgccuucgcccaaacuaccuuugaaaagccccuaaccuacaagccuucuaugagauugauuugaauaauaacuccaucuccggcaugguguggcuagccuucugucaacuaaacucuuucuuuacugcaauuccauggucucuguuuguguagcaggcaggaagaacccacuggguggucacagaauuucaaggcugcaaagagucagacuuuacucaaauauucuaggcaaaaaaaauagaauuuaaggguuacgaucugcacaaucauggucaaaaucaaagacacaucgaaacaguuaaaacgcaacaguuaucccaaggucaaaaccaagaauauuuauuuauuaguguacccuguagcucuguacccaauuaagcccaaacaucucccuagacuucaucuccauaaucauauggguaucugauacccgucaaugcaauuuucuugaucacuaaugaaacauuccuuguucauugcauuagucuuuauaaucacaauauuaaaucauuuucccugguguuuuccccuagcaacaauuuaugagccauuacagaauuucuguuuuuuuucuaugucuucucucuucucauaaguuaaaccauuccaguaucuugcaaaugaccagacaacuacuuuaagacuuugguuguaacuagagcuuccuaccaagcuauguaauuaagccacaguaucuuugcucuucuagcuuacaagauaaucaucugauucccuuuuguuaaacuauuugcccuuuggccuuauaguuuauucacuugggaacuagauuacaguuucccagacuauauagcuacagagaaauuauugugacuuauuauaaguuuaauucaugccaaacaauaccagucugauuucuggcuuaauaccaccuucuuucauaaagcuggaccaucauuuugccuuuaaucaucuucuugauuaguauuuuuccaaguguuucucaacucauuucuucuauagaauuaaaacauuccuacuggaugggcuacucauuuuaaggauuuaaaauuuucagucuggauuugggguuacaccuuugauggaugagcuuaaggaagauacgaaaauggcaaaauuaucuucaugaugacaucauaauggauagaacaaaguaaauuuuauaaaaugguuucacaugccuuauuccauuugauacuuaacagacuugagaacuggacagaguagauauaguaguucccucuugugcacagggaauauguuccaagaaucccaguggaugccugaaauccuguauaguccuaaacccuauacauacuguuuuuucccuauauauacauauuuaugauaaaauuuaauuaauuuauucuuuuugagauggaguuccauucuuguugcccaggcuggggugcaauggugugaucucagcucacugcaaccucugccucucgcguucaugcaauuguccugccucagccucccgaguaguugggauuacaggcaccugccaccacgccuggcuaauuuuuguauuuuuaguagagaugggguuucaccauguugaccaggcuggucucgaacuccugaccucaagugaucugcccaccuugaccucccaaagagugggauuacaggcaugagccacugugcuuggccaaaauuuaauuuauaaauuaggcacaguuagagaugaacaacaauaacuaauaauaaaguagaugccagcaucacuacuuuugugcuuuggaaucauuaguaaguaaaauaaggguuccuugaauauaagcacugugauacugcaacaguggaucugaucacagagcuagcuauaaugucacuaacgggcaagcagcacagacaucacagauacaugggaugauucauacacugggaagggcagagcagggcagcucagauuucacugugcugcucaaaauggcaugcauuuuaaaacuuacaaauugcuuauuucuggaauuuuccauuuaacauuuuuagaucgaguugaccacagguaacuaaaacuuugaaacagcagauaauggggaacuacuguauuacuaugcccaucuuuauaaagcagugguuuccaaacuguguuaaugcagaccaaauucaugacauuguuucaaccagugcagcuccuuucauauuaguuuuuuaaaaaaacacaucuaaguaagaucaccauuugaaaugaauagaguguauguuggcuuuuaaauaaggaauguuuaaaugccccugauagaggaagaaaccaaagcucaguacaaaugguaaacucacaucuccaccuguaaacaccagguaaaaauugaaggagcagggacaaccacccaagucuccagccugugagacagccaggugaggagggguccccagaagaccuccaacuggccugugcaccgggguggagccucgggaauuucaucauguuugcagcggggaggagccuggcccuuccuuuuccuguguggaaccugggauucaagcugugggcgggaagugcucuaucagggacucaagccuugggagacucccucuuuccccuuuacuucuuuuucacccaauaaaacccugcucacccucuccaucggucugugaaccuaaauuuucguggcugugggacggacaaguacccugucuuuaacugaacuauggaaaaguccugcaauauuuuuggcgcccaacguggggacucgagaagggguaagugagaugcaaaccaauaauucuuuuucccucucccuucugagucuucucauccccguggccuuuuccuuccuuuuuugggauggaccggcgagcagcagcugcccacugcuccucacuccaugccggggcugggacacauggccuaaguguccugcacagccugcuggcugguuccccgucacuccuggcugucccagccuuccccuucccuggccaagggauguaacucuaucagacaguaauuaagcuuaaauuugucucccugguggaggaaccacuugcaaagaaauaugagguucuuccucaggcacuuuuaaacuguuucuuuucuuuccccuucucuaccccaucagcaaguuaacuuaaauuuuuuuuucuuuuagaagauguuguacuaggcuagccuccacccacccccaacaacugucaguguauucucugcaaaguuucgguugugaaaucaagccuccaucuuguuuuauauccugagggcauggcugguaauuguggcaaggauuuguuuagcaaagccuugagaggaugaacccuguaagauucaaugucugcauguuuuccuagcccuuucucuuaaagggccccacccagcaacuggguuuucuucugccugccuguguguguacuguacguaauguuugucaagagaacucuaauuaauacagccuaaagaaagacaagugcuugaaucuaauauuuuuuaaagggaagauaaagucugguaccuuucaguucacaugacuuuaaucuuuaagaaauagaaacagucuuaaaaacuauuggucaaaugcagguauuaucaaaauguaaauagguaggcuaaauaaugcaggucagaugcaagguuugcuaaguguuuugagguuacaaacugcuuuuuggguuuucagaacuauauugacuugccagcuucacaacugguaaggccuggggacacacggaacuaaccgcacccuuaacuaagaaggcaaaccuuggcugcaguuagcacacaauuaaagcaacuuaacaaguuuuaguuuacaguuaaaaauugcuaggaguuaauugaauccacuagaaauagauuuacaugcaagguguaugagaacaguaaaauguguuuuucaguaaaagguuauaagaagucauggaaauguaaacuuuugccuaggguuaaggauuguuuugaguuacauuaggaaaaagcugaagguuccaagaagugguggaagaauuguggaaauuaaucuugcagaagagguucucugugugaacauacugacuacauucaaccaaggguauuauaugguuuuucuguaaauugagcguugaaguaaaagcauaacgagguuuuccuaaggugcuaaucuuaaucugcucuuuggcaaaauuuguaaaggguuauaaaagguuuucgcuucuucaaaauuucugagucaucauuuugacaaaauaaauaacuuuugguaauguugacaaaaggagucaaauucuguaaaauauuuuuacagacuuauugugagccacauaugagugaccauggcccgugacacagcccucagaagguccugagaacaugugcccaagguggucaggguauagcuugguuugauauauuuuaggaaagcaugagacuucaaauauauuuaagaaaugcauugguuugguucagaaaggcaggacaacucaaagcggagccuuccaggcuauagguaaauuuaaacauuuuucuggaugacgguugaguuuaucugaagaccugggaucaauagaaaggaaauguucagguuaagauaaaggauuguggagaccaaauuuuauugugcagaggaagcucucagauagcagacuuaagagagagcagguuauaaaaugcuucuuaucagaccuaaaagggugccuggcucuuaguugauuaucuccuggaucuggagagaaaggaaugaaaacaaagggggaaggggauucucuauaaaauguggauuuuucccacaagagacguugcagggcaacuucaagguauggcaaggaaauauauuuugagguaaaacauuuugauuuuuuuccuuguuaugccacagucagauuggaaaguaagucacgauauacaggguuaaauaaaacccaucugaugaaaauuuaugguuuguaagccaugacuccccaggcuccuuagauaggaauuugggcaauauuaaaaaaaaaucagagcuuaguccucaguaaucuggaauuccguuucauaacaucaaguguuuuaaaccuugaacauuuaacagccuucccaaagucaaacuucaguuucaaaaucgucuucccugguacauggcuuuucaaauacuucagagggcccccgauguguccagaacuaagagagguaaacagaauuauuugacauguuuagguacaugggauugccaaaaugaugcucaaucuucuuuagguuauagcugggugaauaaugccaauauauguuccaaaauuguaugggauuucuaaaauucuaaugucugaguauaugcuaucaaccauaauuaagguuuuuauguuaaguuauaguaaaccacggagauaacuaaacuucuuugucagucguguuucuaauuguaacuacccuggaaauuuugcuauucacagacaauuguugcuuuaauucuuuuucagaagaugguuuauaauaagcuauaggacuuugacaggugcuuucaaauacaggcuucugauaacuuuggauauugugacacugaaauacaggaaaauguacaggacucaaaagcugaaaugcucaugauuaucaagcaaaacaagaguuagccaaauggacugaacucaggaagcugaagcaaccuuuuugacuuuugcuuggaauauugcuaauccauguuucauuuuucagagucaaggaaacuuauuuugaacuauuuacagccuuuaacaauugaguaagguauacuccuaugaacaaaguuugaagcguguuuguuucucucugccugguuccucuagaauuuggaaacuaucugugaauauuguuauggcaauauaguuguuugcaucagugccaauaagaauccauuuuucuuuugcagcaggacacauuuggagaaaguaguuauuuuaccaagguuuugacuggaaugguaugcuucccuuuaaggagucaagcucaacuugcagagccaauaaaagccccauggggaaacuggccucauacuguugucuaugcagucccuguacaggguuccugaccuguggucaguaaagaaugucacuuucuagcagguccaagagcuccaaguuuauugugggaccuuaagaggagaggaucacccaacucacagguauuugaggaugcaaacccauggcuaggcucagcuuuaaaaggucuuaucugugauuccuuguggaaaacauuuccaucagugccaauccaaaaagccuauguagaaauaguuauucuugcugcacuuuaugcaaauaaucaggccaaguguaagacuaaagucuauuuugcaaagcacucaguccuaccauaauuuuuuuaacaaaaaugaggacuggagagacagaaauuauguuccaaaauuugccauacauuugucauuaaaugcuaaacucauuaguuguuuuuaaguuuucaucuaccuuuuagaccaacccugcuugcuccugugaaccaagcagcaaucuccagcugcagcucagaaagaacaggagggauggguaauguagaaauauggaucaauauucuagcucugaacaauuauccugcaaacccugccaggugauggaauaaauagggugcccauuaccaggagguuuccuuuuugggaaaguaagaccaagugaacuaaccaaagccaagcaucacguauccaaauccuggcaagcauaacuauagcuaccaguuaucugggugugucacaagacauccuuuucucucucuuguuggaggagaacuggguuccacagcuucacuuuagcauuugucuuaugauaaggaggccaugcaaugccccauccgagauacauuuuugucccagacugaauuccaagcuucacaucaaagccuuaggaaggaaaaucggaucuuagggauccagaggcaaaugacaacagaaguuaaaaggcacagcacaggugagcgugacugauuccugcugauuaagccaaccccaaacuuccuguuucauggauaaaggccacguuaauauccauggcauaaaugaggucuacggaacuccaaggcuacugacagcaggggagauagggcauacguggguaagagcggaugauucccaccccuaggccccccugcuucaugggugcaaguugcuuuaacacccaugguggcaccuaccaaggucacuggaacuuggggaugcaaggauagaagauggaaagaggaugcucuucccucucuaccucacauaccuaagguaucugcuggaagaaaagggaaccagguaugccugcuccccucuuucuagauggguagccauucaucuucagucuguaucccuuucaaaugcauccugaaccucugggacuccuuuaaaaggcaccuucuuuuugccuuucuucuccucuguucucucuucacuaauagguaauugugucuccauacuacaaggcacucuccucagaugcauccuccaaacuagaaagaguugguuucccaaaccuuaaacugguuagcuuaggauugggcucaggggaaggggacccagaagcccaacgugccagcaaaaggguaaaguuuuuuuugccagucaggcuuuuggccucccucuacgugugcaaacuggcaaaaggccucaggaucuuugagcuguccuuacccucccuucauuucguuuugauacauaguuucuaauaaccugguuugucuguucuugccuucaggccauuaaacucuaaacaaucaugcaagcagagccucugacaauggcccuuucugcugugaacccuuagaugggccucugccguuuccccaaaacagcgcccccucucagcaggaagcaguuaaggucagucuucauccuuauccuuaaucuaaacggcagcuggauguaccucuuuagagggaggaaugagacagcuaggugggaggggguccccgaaaaaccuccagucagccugugcacuagaguagagccucagaaaguucaccauguuugcacuggggaggagccuggucccuccuuuuccuguguggaaccuggaauucaagcugugggcaggaagugcucuaucagggacucuagccuugcagaggcucccgguucccccuuugucuucuuuuucacccaauaaaaccuugcucacccucuccaacagucugcgagccuaaauuuucuuggccaugggacagacaaggacccucucuuuagcugaacuaaggaaaaguccugcaacaccuccaacaacuaacaauuguuuccagugcaccuccauucuccaggagggagaaggccaaagcacauaaguggagaaugcacacguuagcccauuuucaauaguuuaauacuuuaaaaaauaguaguguugcugacuuucaagcuuuagcaucuacacgugcuagauucacuuauugacucauuaaacuauucuuuuaccaaugagcuuaccauaugccaaaaacuaugcuauacugggaacccaaaggcacacagaaaaacuagaagacuauuucugcaccagucaagaagcacacaaauggacacucaugaagaaacuauagacccaaagaaaaccauugacaauauaggacaaauggcauaucaaguccugaggaaagagauuaguaaggagguuaauauuuuaaaaaaaauagaaaagggagaaauaaugaaucacuggaaauggucccaucaaccugcaguucuucacuauuuuucaacuuaaaauuggauacauuuauagucacuugaccucucuaggucccaaucuccccauguucaaaguacauauccuauugcuagcucucucuacuuugcuaagucuauugugaaaauaucacaauauaaaauacuuugaagccuuuuagggaagcuuaaggucuucuacaaauaaaauaacaagaaguaccacuuggcugaaaaaugaaagagguaggacaccaaugguaguaaaucacuuguaucacuuuguucagaaauuauuucauuuuuuucauuuuauugaauauagacaaauuauaguuguauaucuuuaugaaguacaaagugauacuaugauauauguauacagucuggaaugauuaaaucaagcuaauuaacauagccaucaccucaaauaccuaccaucgauucuccuaacugaaucauuguacccuuugaccaauaucuccccauuuccccuacucccagccucugggaaccaccauucuacucucugcuucuaugaguuugauuguuuuagauuccacuuguaagugagaacauaugguauuuguuuuucuuugcuagcuuagcugacuuagcauaaugucugcuugguccacccauguggucaaaaauggcaaaauuuccucauuuuuaaggcugaagaauauuucauuguguguguguguguguguauauauauauauauaucacauuuucuuuauccauuucaucucacaccuauuaaaauggcaauaauaaaaagaugaaagacaagucuuggcaaggauauggagaaaggggaacccuuguucacuacugaugggaauguaaauuuguacagagcugguucaagggaaauccaagaacauggcugugaggcaaggaccagaugaggguauuaagggacuaucauuacaguggaaaaauuaacccuaucuuuuuugagagaagccaguuacaaugcuugaugcuaucccugacacacucucucuagcaacaaguuccuuuucuuucggcccuuaaguaaggcuauaagaagaacagaacaaaacagcaaggagaugaauaccaaagcacuggccacacuuuuccccugugggccugucuuauuccauucaugcugcuauaaaaaauaccacaaacuguguauuuuauaaauaauagaaauuuaauucucacagcucuggaggcugggaaguccaaggucaaggugccaguagauuaagugucuggugaagucuugcucucugcuuccaagacaguacauuguuucuguauccucacguggacgaaggcagaaggguaaacaggcauaaagggccuagcuaguucccccaagcccuuuuaaaagggcaccaaucccauucaugacggcucuguccucaugaccuaaucaccucaaaggcuccaccuccuaauauuaucacacuggguuguuuuuuguuguuguuguuuugacaaggucucccccuguugcccaggcugauguguaguggcacaaugucagcucacugcagccucaacuuccccagacucaagugauuuuccugucucagccuccuaaguagcuggaacuacaggagugcgccaccagcuaauuuuugcauuuuuuuuuuuguagaaacaguuucgccauguugcccaggcucucacugggucuuauguuccaacauacgaauuugucugggggaugggugacacauacauucaaaccauagcagggccuucaauaggucauuagagagagagccaaggaacaccaguguggcuuuuugcauugaacaacgauaaguuaauggaaguuuaacauagcccacagucuguagucagaggucagaggaguaaggccuuacaugcuacagaugcccacaaaggagauaagaggaagccagaagaaauagaaauuuguuugucaguggauaaagaacaaggccaagguuuucuuaaauagugauugaugaggcccugguuuacuguaacaguguacuugugauuuuuuaauuuuguaaaaauugucccaguguguaauucucuguuuauaccugaguguggggaaaugaauuuuaaggaaaaagcccuauauuuccugauaaaucacuucuauaacuaauugguuauuuaaugauucaucuguguaaaaagggggacuaaugguuuuaaaauaaaauuucaucaacaguugucucuuucauaagguuugaaaacaaagaaaauggagaugaugaugcagguguggcucuuuaacagaacccacaggggagcacacaggcucuggggagagcaaacaaggcaagggcucagaagacuagguucuaaucccaaugccccuuucucccggauauuuaaucauagucaaauuacuuaaugaccccaaaguacagugauuuccuuaauauuuuacaaaagaauaaaagcacuauggacuuuucuucaaacagacauaucaccccuggccucaggaguuuaauauucagugacucuuuggcaggucgugaacugcccaucagucccagugguuguuaugaauguccucugcucauccauccagauccccuccccaucuuucuucauccugacucuuccugggagggugaucaauauagaccugccaauaggcuccugcacccucuagcuucuaauugcauucuguccacgggaagcccuggugagaguuacaucauuccaggauugggagcaaccuguaagaggccccggacagcuguguccauccucugaaaaugaaggcuguucucaggugaccugcucuacccagaucuuuuuccuuccagguucuuuuuuuuuuuuuuugagauggagucucacucugucacccaggcuggggugcaguggcacaaucucagcugacugcagccucugccucccaagcucaagugauccccugccucagccugcugaguagcugggacuacaggcgugccccaccacacucagcuaauuuuuguccuuuuaguagagaugggguuuugccauguuggccaggcugaucuugaaugccuggccucaaaugaucugucugcuucggccucccaaaauucugggauuacaggcaugagccacaguacuuggccuccuuccaggcucugauaaauguuucuuccccucaucucuuaaagccuaggggagguuauggacugaauguuugugucccucacaaaauuuauauguugaaaucuaaucccaaugugauggcaugaggaaguagggccuuugagaggugauuaggacaugaggguggaacccuugugaaugggauuagugcccuuauaaggggcugaaaagaccagaauucuaccccuucaccaugugaggacacagcaagaaggcauccucuauuaaccagaaaaugggcacucauuagacaccggaucuggacuucacagccuccagcauugugagacagacauuucuguuguuuaugagccaccugguuuaaggugucuuguuuuagcagcccaaauggacaaacacagggagguaagagccccuaccagccccuguccaccagaaagauggggaucugaacagaagccagagguguaacuggaauggacucagguguuuuccucacagagcagauaacuaaagcuagaauucuugauaagaaaaaugggauaaagaaauaacaguugcaaagguaagaagcagagacagaguuauaguccagaggccaaaaggauaauuuuaagaagaaggaguaggucugaaagugaugacugagacuagcccuuggcuguggugauuaagaucuuuggugacaauagaaaauguaacaauaggaguggucuguuguggugauagaaucugcagaccgguggaaguccaugggcccauuuaccaugccacaggcaaagaguauauuaaacucccacgaagagaagugccucuggauucauuuugccaacauucacuguacugauauuagccauggacuugcagaggguuuauuuacuauugcagccuggcucucugcugugucugaaaguugaccuugguguccucuaaguuuuaucccagagaaaaagacagcaauugagcuauuccccaggcacagggggcaaaauuugaaauugacauaaaaccaagauucccugucugacuugggccucugggauuguauugcugcauccugugguggcaaaaagaguauccugggcaguaagugauuucaauuccacuuaaagcaacaaguauuugcugaaaaccaaccauauucuuaguaagaagaugggugcuguaggagacagagaauuaaaugaaaucauuccuucccuccaggagcaaacagcuucaugcuagaaauaaagcuaacucaaaugcaacaaacagaagacacacacacacacacacacacacacacacacacacacagagagaguacuuuucaagauuaguaacaaagagauuaucuacagagauaaagacagaagaauccaaugucugcauguuuuguuauucauguguauaaguuuucuaacuuuccuacauucagugugaauuaguauugaaaucagaauaaaaaagcaauauuuuuuuaaaagccuaauuuuuagaaauugauaguaaaaaaugagacagcccugggcugaagucccaggcguccuucuuccuaacaacuugaacuuagccaaguugcuuaacuacuuggugccuaaauguucucauuuauaaaacugggaagauggcauggagaggcaaugggcauuuucuggcaagaaacuaagaaaaaaggccauaaccaauaaguaacuuauggaaaugaaaaaaucuuuuaaguuuuauaaucuugcuuuaguugauaucuuaaaacaaaauuuugaaaguuauuaagucacucauaaggauuucaggaagcacugcaguguaauaugcuuaagaauggagaugguucaaaugcuagcucggcuacuuagcaauaccuguccucaaauaaguuauuucacccuaccugagucuguuacuucaucucuaaaauggagauaauccuaaaacguaccucacaggaaccuugugaagauaaugcauguaaaaugcuaucacaguccuuggcauggaauaagugucuaauuaacuuuuauauauaauuauaauuaucaucuaaaaaguuuagugguguuucagacaaaucuaagagaagauaagcaugaauagguauaugucuuuuucaucuuuguauuucaccagugcuuugcacagggccugucacaaaguagggaucugagaaauacuugugaaugaagaaugaaugaaugaaugggcugauuuuccuauuugaucaaaagccacauccauauaugacuaaaucugaguauauaaaagaagauaaaacuuguguuucaauucaaucuagugaguuaaauuaaaagaagaaagggaggaaggcaaauuaaaagaagaaagggaggaaaagaagcaggaaagagggaaauaagacaaaaagaaaaaaaaaaaaacaaaacagaaguuggccaggagaaagggugucuccauccuuaaauauuuuacuccuuauugugugauauauuauuuugucagcuucuucuagcuacaauucccaaggaagggauagagagcagcagcuuccaaguaaugacccauguggguauaaagagaaauuuuuaucauauuagaaaaaauauauuuauauacaugcuaccaacuuuaccuagaagagaagagcaagggauuggaaaacaaauuagcauaaaaucccugcuccagcuuuuuacacauacagauguuuuccugcauauuuauccauccuucugagcacugcucaaauguuacauccucagagaagcucuccuggaccccucauccugggcuggauacucugucacaugcucuaauagugucugauacccuuccacuagaacagggaucacuguuguaauuagguaauuauuuggguaauuaauuguuuaacaucuguguccagugucaguaugcaagcaagcuccaugaaggcaguguuccugucugccuguucaccccaaaaucaccaacacuugcauaugccuugcaugaaacagguaagugaacauaaauguguauaagguuggcauccauucuuugugcauucuguguuugugaauuugcccacucaauaaaaugcauuuguaaccucaacaucgauacuugccacauuucuguggucauuuuugggcaucacagagaagugaaaaauuugucacccaacauguacauuccccaagugaagcagaacaaagcaaagcuccaccuucuugcuccaucucucauacuguaaacaagggucuuuuucugaucuauuaaaugccagguuguugggguggguuuucuuuugcauuuuuguacauaauggccccaaaagaacagugcugaagugcugucucuuguuccugaguacaagaagaauaugaugugccuuacagaggaaacaugagugauagaagcuucauucaggcucagguuaaacagcucaggcugugucccaugacuucaguguuaaugaauuagcuauauguuaaauaaggcaucuuuaaauaaaaguaaacauuuaaaaaguuuacauauuaaucaauuaacaaaaauguugugaagaaacagccaguagcacgugccuguaguucugguuucucgggaagcuaaggugggaggauuacuugagcccaggaguucgaacugcagugcacuaugauugcaccacugcacuccagccugggcaacagagugagacccuaucucuuaaaaacaaaaaaaauauuguaaucagaggcucucaggaacucaacccuggauuuccccuaggggcaaugguucauuauuugcuaauucagcguuuguggagacuuuauacaacaauuuccuaugaaaaaucaggaucaacuauauauauacauagaauguauauguguauauauauuuuacauauuuguguguauacaugcacauguguauauauguauguuuaguaguuuuuaaccauuuugguguuauacaccuguuguaaaaauuuaaggaagacguggauacuaggggcugaggguugccacaaagggagguauguacauauauacagcccugugcuaugcaucuccagggcaggagacaggguguugacauucacaguauagccuaagugaauauuccuacuccauagaauuguucaguguggugacacuucaugcaaauaaauacauguauacacauacacauuugcauaagauucugggcauuuguggccuccuaucguguaccucagguaaaaauccugacagagaaauaauagauacacaaauauaaauauauauuauauauggcacauucaauuuuacuucaaauguuuuacauaggcuaaaauugaaacuaaaaugcuuugcauuucagccaccaccaacagggacuagacaauuccaaaauauauguauccccagaagaaagauaauuuguugugaaacacuggcuaaagacauucccuaagguaaacuaaacacaggcagaaaacugagaguugaaaaaaaauauauacauauauagagagagagaugagaguugaauaucuauauguauauauagauauguauauauagagagagauguguguguguguguauauauauauauauauauagagagagagagagagagagagagacagaggagagagagagcacaacaagaauacgaagguuggccaggugcuguggcucaagccugaaucccagcauuuugggaggccaaggcggguagaucacgaggucaagagaucgauaccauccugggcaacaugaugaaacccuaucucuacugaaaauacaaaaaauuagcugcgcaugguggugcacaccuguacucccagcuacucaggaggcugaggcaggaggaucacuugaacccaggagacagagguugcagugagccaagauugugccacugcacuccagccuggcgacagagugagacuccaucucaaacaaacaaacaaacaaaauaccaagguuaaccugccccguuugcuuuccuaagagucuaagauucucuggauucucaggucuguauggugggcagcaauguaaauuuaagcuucucugacaucuaaguucuuuggagacaguaacuauuaaacaccugacucugucccuugaauaacagacauuucuuaguaaagcuuuuaauuagaucuguugguugaggaugaaaauagaaagacaccagaaggaaaaaaaaaauucaucccuguaaaugguccuguggaaauaguaacuaaaacaauuauacuguuaauaauucaauguugguuuaaaacuauacaauugugaguuauuuauacagaccagaguuggcauguguuguaccacagguggaugugaggucaccaagaaaccacuucacaguuuucccagaaguguagcgucaaaaaggucacuugugguaaaagaucuuuuggauuagucuuuuaaaucaaugcaugaauuaaagacaauuuacauauaaauaggcuaauacucuggcuuugaaauuaaauggauuuuuaaaagauuuaaguaacugcagaaaaggucaguuaggcaguaaguguacauaaugugauucuugaaaacugcugucuuguugguuuauuaauauuuuguauucauugucaguguuguucuaaaauugugugcauaauuagcaaugcaccaaagucaacggcaggucccaaaaguaaggaaagcggaauuuacaaaucagugaaggaaggacaagucuagauuuggacaugaaaauagucaaaauuaaccuuugccuauauauuaauacacauuagauucaaauaugucacaacauauucuaaauaagcauggcaucacucgcuccaguuaaauuuaccuuggcauuuagccucacugauaaauuuucaacucuuccaaaauacaaaagcugcaguagucuccugaguuaucacaacaggaucaugauuguaauuugaaauccugauuccccuuuuagggaacagaaaccugcaguuuuuccaacuguaaugaaaggauagagcgaaacuuccauaggaucaaaccacauuccauuaccaccacuccucugaacauuaauguaccuuaaaacauauugaaccauaggaugaauauauggagcaggggcauuuuuaggagagugaaacuauucuguaugauacuacgagagauacaugauguuacauacuuguccaaacacacaggacuaugacaaaagauugaguccuaauguaaacgagggaugacuucaguuaacaauaguguagcaauauugguuaaucaauuauaacaaaugugucaauccaaugcaagauguuaaccauaaugaauacugugggcaaagggaggggauuugugggaaaccucuguacuguacuuucugcucaguuuuucaguaaaacuaaauuugcuguagaaaaucgucuguuuuuuaaaauagugaaccaaauguaauaaugcacucaaagacucuuuuuagacaaaugguuuauaaacuauauucagaggagcccuagugguccuuugcuggccauuugguuuaggaguguuugggaaaauagaguaggagagaagagggaacaaugaagaaaagacugcucaagcuggccccuuaucuuucaccccuguuucaaacaaagcaacaaccuuuucaccuguacauauuguuucuccacauuggagcccaguaaagaaggguuucucagcuaaagagaaaaaaaaaacaugaaaaucaccaauguaugcucaauaaaguaucuugcuacauaaaucagcaacucaaagaagaaaaaguuaaauuauaaaaaccuugcuaauaauguacacuaauucccucagcuacuuaauaaacauuuaacuaaaacuuucugccugaccauuauuacuuccuaugauugggcuaagcauaagcuaaaugacuaccuuggaagaacuccaacuaagaaguauuuauuucacaucaacaaugaaccaguacucuguuagaacaugcaacaugcuuuggaaagacaggugaaauacaaagcaucauuccagcuguccagaagcuuaucaucuuacaggacagagaacaugaacacaacaaaaugcagaaacaauauaauacaccugaggcacccagcacccaacuugaugagcuaaaaaauagauuucaggucuucugucagguguuaacaaauugucaacucugaauaaugugagggccaguaugaaugagaacaguccaauccccaguuaagccccacuuuucuaaaucuucuucucucuuuaaaaaagcaaagugaaugcuaacguagucuaucaguaauggacaguguccucauaaaaagacauauguaaaaaggaggggaaguggaagguaagcagugcuuacuauuuuaucauauucaauuguauacacaccuccucucaaaauuggugucccccuaucaguaguuacuaacaaguuaguucccaggaucuugcagauggugggcugguuucagacaaaggcacagugguccagaggaucuggcaaccucuuucaggggcuguugggagaugcccugacggcagcagaagcagccuccaaugaggauggcuuccugcucaagaccuccucacacuccucuugcauaaauaaaugauuuagacaccguuuucuccucuaauagccagcacuacaccaaagagaaaacacuccgcuauugaugacaggagagggcuuuuuuuguaaguguguauguguguuaugcuauaaauuacccuguugguggguguaaaaauaaauauccauguauauaguuguguauacacacacacacacacuuacacagagagaauauguuacaguuaaaaucaugcugucgacagccacucaaaucuagagcaauuuauggcucucaaugcagucacacauucaggauaaagacaggaugauaauaaauacuuugaauauuaccagcauaaauaaacugccugaggagcuuaaacauuugcaacauagccuugcuggcucacacugacaaccagcagaccuguugccagugagcgacugaaagaucaaacaugauuaaaaaugcaaagaugcugcacccaaaugacaugcuuuauuugacaaugaacucuggacucagaggcaccacugcaaucuaugagcaaagugcuuuuugguaauucauuugcccacugaggccagcuacugaggaaucacaauacaagucccuuuuaaaguaggcacaguucuuuacagccauuaguaauuccaucuugagacugcccuucgagaaaacaauuucuuuuuuuuuuuuuuuacugagaauugaugguuuguguuuugucaaaaugagccccagaaguuguuaagaacuuguguaauacauuagcuaugaguagccgaauaauggucuucaaguaaguacaggaaaaugaauggcugugaugaagauggugggcagguauccuuuuacugaaacuacuaaagcaggggcugaagucagguuuuaaaaaagauucuugugaccauaagacacaggaauguccaguggaagaaagccaguucuagcuuggaguuuuaggaacaagccaguuuccuuggugucucaguaucauuugauucuauaguauguuauuucuuuuauuuacauacauaugacauucaugauuucuuuuuaaauauccauaaauucaaaguggaauacaaugucacaaugucuuaagucucagaauaagaugcugagaagaccaugaacaagugauuucuuuuucuuuuucuuuuuuuuuuugagacagaguguugcucugucgcccaggcuggagugcagugggcaagaucucagcucacuacaaucuccaaccccuggguucaagcaauucuccuaccucagccacccuagugguugggauuacaggugccugcuaccacgcccagcuaauuuuucuauuuuuaguacagacagcauuuugccaugcuggccaggcuggucuagaacuccugaccucaggugaucugccugccucagccucccaaagugcugggauuauaggcaugagccauagcgcccagacaaacaagcggggguuucuuaaggaagggcuuccaagaaaaacugcuuacagcguggcaagaaguagaacagggaaaggcaagaagccaagcgagggugugauucaggguagaauccucugagggacguuuucccaccagaggcaaggaaacugggcuuucacucucacucaccaaucacucugcagcuaagagccauccuggggguuccuaaacuccaagcacuuccagcucucagcagaccuagugaagccagcagcuccaauugguccugcaaagaccauugccgaagcagccauuggaagguaaauacacagaagcuggggcagggcucacagauauguugaaagguaccagggcagugcuccgacaccuucugcuacagcaaagaagcaaaugguccaaaaaucaaaaugaggguagaauaagguuggagaauucaaaaagugcagaaaaaaaauaaaagucccccuucucucacccccaccuuccacucacccuucaccuaguccuucuuuccaaagguaaccuuuguuuacaguuuucuauaaauccuucuaaggaaaaauauacacauauacuauguaucuauuuaaacauucuuuuuaaaaauaugcagauuggacaacuguuccacuguucuacuccuugcuuuuucucacuaaagaauauaucuuguauucuagauauuauauuagaucuauauacauauucuaaauagagagaugauagauuagacagauaaaugcaaagaggaaggaagggaaggaaaaauggauggauggauggauggauggauggauggauggauggauggauacuacacuucauugauuuaaagauaaaacaguuuuccacauuuuaacauuucugaaauaggcugucuuauacuugacagcauuuuagauuugcuaaaaugcaguagauagauauauagcuauuuauggauggauugacaguucacacauagcucugccacuugagaaguagugcaggauaguaguuaagaguauauuaacacauugcuuauuaaugagauacuuucguacuugaggaauaaggaccucuuuugauggggcuaauauuuuaauaaucugauaaauuguuuauuaacuuuaaauuuucauaaugaguccguaaaugaguuugauuuauaguuuucuauucugugcugucucucucagacuuuggaauccauauuacauuggcuucauaaaaacacacuggcaguuuuuuucuuuauuugugcuaugggcaauuuuguuuacuuuuauaauucuuugacuauguaauacauguacuguguaucaaauucaaaaaguacaaaagggcaugaguaaaaaaguaucucuaccugucuuccagcugccuagucccuucccccagaugcaaucauuguaauccguugcuuuugcguuccuuuaguuauguaugacacauacacauaugcacaaggacacacacuuuuacucaaaugucgguauaauagacacaaugcucugcaucuugcuuuuuuuucacuucauguguuuuguagauuguuccauaacuauacacagaaccuccacauccuaucugaugacuucacaguauuccauuaugcagauauaaaauuaauuuuaccaguuuucauuuuuaaauagaauuaacauuaucaguuccuugaaaugcaaaauuauuugcuucugaaagcauaaagaccuguggcuuuuuaagaucuuugauaacugcuucagauuuuuccgauguuauuaaaguucucuuuccuguugaauauguuuggguaacuuauuuaccuguuuaaaaaauacauuccuugaagauuuucaguuacuuuugcaaaaguucuccuuugaauauuuuaauuucuuuagccaugguucuuuuuccuuuuuccuuuguuuuuuguuuuuuuuuuuuuaagacagggucuuacucuguccucugucugucacccaggcuggagugcaguggcacgaucagggcucacugcagccuaaacuuccugggcucaagugauccucccaccuuagccucuugaguaguugggacuacuggcaugcgccacuaccccugucuaauuuuuguauuuuuuguagagaugggguuucaccauguuacccagccuggucuugaacuccugggcucaagccauccagcugccucggccucccaaaguguuaagauuauaggcuugagccacugggacugucugcuuuccauuuuuuguuuuuguacucccuaacuuuuugaguaagugaauuucauugcuuggcauuguuuucaagguguguuagucuguuuucaugcugcugaugaagacauacccaagacugggaagaaaaagagguuuaauuagacuuacaguuccacaugacaggggaggccucagaaucauggcgggaggugaaaggcacuucuuacaugguggcagcaagagaaaaugaguaggaagcaaaagcagaaaccccugauaaacccaucagaucacguaagacuuauucacuaucaugagaauagcaugggaaagaccagcccccaugauucaauuaccucccccuagguaccucccacaacacgugggaauucggggagauacaacucaagcugagauuuuaauggggacacagcgaaaccauaucacaaggagacaguauuugagcuuauuuaugauucuuauggauuuauuuuuaaauuagaaaaccuaauuucuuauuuuuaucuuuauuauuuaguucuuucugcauuuuuuccaguuuuuuggcugucccuuucuuaagucagaugcauaauuccuuuauuuuuauucuuuuuuaaauauucagguguuaaaggcuguauacauuuucuucuaagcgaggcuuuagcuguagcccauagcucagauguguuauauuuucauuaucaauggugucuagauauuuuucaaguuggguuuaaaauguuucuuugaauuaagaguuguuuaucaaagaggguuguuguuuguuuguuuguuuugagauggagucuuggucugucccccaggcuggagugcaguggcacaaucuuggcucacugcaaccucugcuuccugggucaagcaauuccccugccucagccuccuucauagcugagauuacaggugugugccaccacacucaacuaauguuuguauuuuuaguagaaacaacguuucaccauguuggccaggcuggucucgaacuccugaccucuggugaucugcucaccucggccucccagaguaucaaagaguuuuaaaauauccagauuguaagguuuugauaaaacugauuucuaauuuauugcauuguaaucagguaauggggacuuuauuuguacuucagcuucuugaaauuuccugcaauuucuucauaacuuauaaaggccauguguuuguauuacauuguuuuauuauuugauauauuuugaaccacauauuuuagaggggcuuuccuaucacaaacauauuucaaaguuguuugcaaaauauuuugcauuuucuaaucaccauaagugaagugauuagaaaacacaucagggcuucuguggcucaggauuuggugcuugccucacauagacacaaccaguaacucuuacucuugugccaaaugauguaauugcccuaggaaaauguuucuacaccucucuugcccacuuucauugaagaaauggugacugaaucugaaugucaggaaggguuguggguuguggauauggcaacugcaaaacugcagacaauagagauguacacugcuuuugugguagggacaggauuugagcaguggaaaggcauaaauaagaaaaagagaaauuaauucaugauuaagacagauucuggcauaaagaaauugcaguaguaguaguaguaguaguaguaguaguuagugcugaauaccguaucuauuuucuuucaucagaaucugcugguuccauuucauaguucagaggucucacaaauucaggcaauauucacagcuguggacauaguaacuuaggcauauuuugcauuauuaaacgauugaugcuaucuuuaaauuuagguugcaacauaacauacaugaaaucugauaccaagucuucacauuggcaacuagaugggcauugaacacaaaacuagaaauuguuuuauuuuuauaaaauauuuaauaagauuuaauuaaagugucauaaaaauccagcuacauugaaauguuugauuuaaauguuuuuuauuagcuaacccauucuucauuuugcuuuuuaaauucuaauguauaauuuugaauauugugcaagaaauaugacuuucuuaaaaacauuaaaaauuaauuuuaauuuuuucaauguauaauuaauuuauaugcuugaggaaaauauauucaaauuguauacauuuuaaauacaaaugcaguuuaauuucuaauucuuuagaucagggaucagcaaacuuuuucuguaaagaaccagacaguaaacauuuugggcuguuacaacgacucuucucugucacugcccuagcacaaaaggaaucacagacaaugcauaagugaaugggaguggcuagaguuggcccuggggccuuaguuugcagaucccuguauuagaucauaacugccaauagacaaaaaguaucuuaaaaaaaaaccccuugauuauaacaacaugacaauuuuacugaaaugaagaugagaaaaaauaacuuaauuggaauaaauauauaauaauuuaagaaauauuucagucuuuuaaaaaacucacuaaaaugucaucagcccaauaacagaacauguacaauaauaaucaagagcuguugucuuugauauuuggucaauuuucaaucacguaaaaacuagggcuucaccuauacauuuagauuuuguccuuaaaaaaguuaucucauggcagaggauaaaaaacacuucuuuaauggcuuacuagcuggauuuguuaauuuuuaaauauuuagacagaugguauauggccuccuuuuugcccugggccccauaaaccuuagauguaggccugaauacaacagugaucaagagacaaaggcccuacugucuugaauuacagucuaguaaauucuagugcacauccauugacucuaauuuagaccagucaaucaucuauucucacaugcacuacugcaauagcuuuuuuuuuuuuuuuuuuugagacugagucuuguucuguugcccaggcuggagugcaguggcauguucuuggcucacugcaaccuccuccucccagguucaagugauucuugugcaucagccucucaaguagcugggaucacaggugugcaccaccacgcccugcuaguuuuuguauuuuuaguauagaugggauuucacccggccucccaaaauguugggauuacagguguacuguacccacuguacccagccugcaauagguuuuuuauugcucucucuauaucuauucuugcccucaccaaccuauuuuccacauaacaaauuaauauguuaaaaacauaaacuaucaccucuuuccuaaaagcucuucaauuguuuuccauuacauuccagauuaaauccaaagucuuuuaugauuaguauuauuauuuuugagacagaguuucgcucuuguugcccaggcuagagugcaauggcgcaaucucggcucacugcaaccucuaccucccagguucaagcgauucuccugccucagccucccacguagcugggaucacaggcaugugccaccgugcccagcuaauuuuguauuuuuaguagagacaggguuucuccauguuggucaggcuggucuccaacucucgcccucaggugauccaccugccucagccucccaaagugcugggauuacaggcaugagccacugcgccuggcccaaagucuuuuuuuauaacauaugaaaucuuguucuucccuaucuuccaacuuuaucuugugcacuuccuuccuugcccaguauuaucuggccuuuuauuguacuucuaacauauugaggcauuucuugccucgggaccuuugcacaugcaaucaucuggcuacaguguuucuccuuucccuacuccuuuuucggggcuacuuuuuucauuuuuacaucucugcuuaaacauuuucaccuccaagaagacuuguaaguccauucagucuaacauauaugauucuugcuauauucugucacugcauccuguucaauuuccuucacagccauaggaagaaaaccuguaauucuauauauuuaucuguuuacuuguauauuuccuauucuguaaacucuuugagagccaggauaauuuuuauuuuguuuaucacuuccagugcccacaaugccuggaaaucauacauacucaaaagauaguuguuaaaaaaguaaaugaauaucaauucauuuguugaacaaauaaauaugaaauggauaggcacauucuggaccuaucgaaccauucuagcaugaagccuuuauucccagagugauagcaauaucaggguccccccaacuaaugauuuucaagcccacucagauccuuuauucaugcuguauuuccaagcugaauuuccuucccccacuucucucugccuucucaaauauuuauuucuuucacuaauucaaacacacuucucucaacaagucuuugguacccuuuucagccccaaauaauaggucuugauuucuacauuuauuaucugaaucauucacuuuaguaucaucuuacggugccuaauucuuucuaaaucuaaguuccuuccauaguguauguaguagagaccaugugcacuuaauccagccagcagcauggaguggaaccccaaaacauauugauaucauuggcagccuuagccuguguuccccaucugacucuuacaucccacucaggaaagcagacccuaaacaaaggcuuacaacuagguaguuuauuuugggaaaagaacccuagauaaucaaauugaggaacgagggagaguaaaacaggggaaaaggguaucuuaaaucagauucccuagaaguacacucugaaauggguacgcuuguacaagaaauugauugaaauagugcccucaggagaaaccuauggggaaaugagggaguaggaugggccagggaagaagccacggaaagauauggcuucagcuggaguccagccauggcccaaacccagaguauggacaagaguauggaguaugaacagcaccacagaguuauuccccuugacagcuucuguuaguccuuggcuguggacugcccuugaccaggcauaggggauccucuaagguauuucuggggaaguucauuucccucaauagaggguuaauucuccugagaugaguucagcugugagaccuuaguauccaacacucuaagcagcuggggcauggguguguugacccacuaaugguggucuugguaggggaccaacagcauccucuacagagggaaauacaauauaaguauacauucucaagucgauaacaacuacaggcaccuagggcucaaccugcuggaaucuuccgagaaaacuuacaugcuucagauguauauguauaaugugcuucagacaugucuaaacaaggcauggaagagauuauuuauccaccaacucccaguccccaccagucagggguuauuccguggguuaauaacucucuuauacuuccagguugccagucucacucccaaggugguagaaaauagggaugaaaauagggaugcccaaugccacuuaggcaagaggcuucaggucacacuugcccuaaccugguuuccacagcgacagcccuaauacagaaagggagacaagaggaugugagaugugucacaggaaguguccaauccacuaacuacuugcccuagaucuuuggagaauuaaauaaccuguccuacugcuaugcaugacagaagcccuaccagugggggcuaguuggccuucacauuggcuccuggccuucucauuggcucaucuuaggugucuugggcuaucugccugauacacauuuucaguuaggcacgucaugugaccuuacagaccaagguuaugcaaaagagaaaugaaaauuaacuuauuaaucuuaugacaguauugggcucucuguauuuuucucagggucccugacacugaugguauuaucucauucuuuggugaugauuauguguggaauguuucauuuaaaaauuccaguguugucucucaugaaagccugauacgguaggcucuauauacauacuggugaugaucguaauauguguguagcacaaaguagucccugaacaacauuuuuaauggcaaacagugauuccuucccccaacaaauuaaguaaaaaugauaaauuccuacauugaaagaaaucggcaaaacagaacauuuccuucaauucacauaaucauuaagaaguaucauucauaagggguuagaaacauauaauauccaaccuuccuguuuaacagagcccagcaaggacucaaaugcacaguucauuacugucauuaugagagaauuucugccaacaaguuacagucagguuacuaucauucaaucauguugcuaauaggacuaauuucaugguaauuggcauauucuagaccagagaagaacucaaaugguuguggaaucauuaaugauuuaugcuuucaugguaaaaaugacaaucuauuaguuuaccagaugcuggaucaagccaugggccauuaacaggaggguguucucagaacguuuucagaacaaauaccagcuacuuuauuuucagcuugcagacauaaucacaugcauccccuaucagauccaccacuauacugucagauacaucauaaauuaaaggcuccaugggcucauuauuggcucuuauucguaaaagcaacacguugcccuggcaagacccaaaauauuaaaugggcauuuaaagaaacugcaaaauguguaguuuuggaaaaaugaaaucuuccuuaaaacuauuuacaguacucaaguuuucaaaauguccuucauccucgauuuugccucaauauuuguuuuuuuguuuuuuguuuuuuaauaaaagcaaagaaaaaagaaacaaauuccugcccugucaggaaagcuuuuaggccgagucucuuaggaacugggugucauuuauuaguaaaccuaauaugcugccuucagaagaacagaggugccagcaucaaauaaacaggcuuaaaaaaaaaaauuccaggaaacuuaauguacacuacguuaguaaccaggacaacucuuguuucccagcaaucuauggcauagauacguugguaugagauaaagccuccaucuuuccugaaucuucaaaacaaauguaaagcugauuaaaauuccucuucugucuugccuauguacaaggcugcucucccaauaccaagcaauccuauuuggagacaaugggauguuugccaaaccaaaccgaaauaaauaaauaaauaaauaaauaggagaguuucuguuuucaacuguugauggcaucacccuugccauuuguggugaucagauuauccaccuagaaaguguaagaaaacaagucuuccgguuagcacuuacugggcaaagggcugaguuucaagaaucacaacugaaaucggugggguugcucuuuguuaaugggaaaaagcaccauguuaaagugaccagggccuggugugugcaccgcaugaucugugagcaugaguugugugugcaacaugcuuccucgugauuaccgccuauacggacagucacugugcauuagugcauugguagccagccgccgccaaaaacaggauggcauucuuccaucgugauuagagguuuugugagcauuuugggaugggggacacuuucucaguaaagacucuuccgccccauucacguucauucagcucuuucuaggggaaauuaaaagcugcagugauaaucccuuaaggacaacuuggaagaguauaaaaggugcaguguauaagcaauuggaugagaaagccuuuuauguggaaaguuacugaauggguggcugaggguggugugaguggggagaaagaggggcagcuuuucuuuucuaagguggggagcagcggggauaucauggcacuucaguucccuuuaaucauccagauuccuacgcugucccugccccuggugucaccuuguuuugcagugccagcuagcuccucccugccauuuuccccucaaagagggagaggggagcaaugcgauuuuugguaaggacccaguuucucgcugaaugccaacucagccagcuggcaccgaacaggccaagccuucuucagaagagguuagcaaaauccaaauuagcaugguccauuuuaaaaacuugcuuuuauuuaaagacugauucaugacaaacaguggcucccguacugaggucuggcaccccaggggcuggcauccaaccaaacacaugcaacuaauugccacccucggaugacacgcaacuaacaagcuccauuuugaggcaguagauucacuaagaauguaaccccggaaggcagcggaggcagaaaagcuccuuucauaacccuguccuaggcuaaccauggcagcagagagccugaaaaacacuuuuguuucauugcaccaacaauuuagcuccacggagggcuacaaacacggcuaacuugcugaaaagugaucaagggcacugcgaucccccucaugguuauaggaggcaggggcucugcuuuucucuuugcucaaggaaacacacaaaauugccuacuaucuugaaacuccgcaucuugcaccauuugcaaaucuaucgacccccaguacuuccccuuauacuuuaguucagaugcucucaggcuuccuuuguacaagcaagggcucuggagccaggaugccuagguucaaaucccagcuccaccauucauuaguaauuggcaaguauuuuaacccaucuaugccucaguuucuucaucuauaaaguggagagaauauuagcaccuacauuacuacgaguaggaacgagucaauguaauaauguacauaggacaaugccugacauaucaucacucuguuaugaaagcucuuugagucugagauagcucggccuuaugaagaaaaaauuucccuuugcauaagcugcauuuuagucaaaguucuugcuucccuguaaacuucuagagauucaaccucuaagccuuuguuuaccauucuuucuccucucaacuguccuuccuccauugcacagcccuguaugacuaaaucucaucauccuccaaaaccauucuucaaugccaccuccuccgaggagacuucucugccaucccagcugccaugaaucccugcacucuuggcauggccauggcaauuucugcaaacaaaugacuguguuuuacuugccuguuauauuuccuuuucuagacugacagauccuuuugagcauaauccacgaguaacuagcacauaguagauacucaaugaauauuugguaaagaaguagauggucagaugaaagaauugcucugcauaaaugaguagcuuuauacuaugguuaugcugggcauuacucaauaggcaggaugggggaaucguuucuuaaggacuuucauaguugcuuuggcccaaauuaagaguuguauuuaacuugucaucaacugaggcucauaaauaaaaucuaucaaagaaauaugucaauuaccaccuuagucagcuugggcugccauaacaaaacaccaaggauuguguggcuuaaacaacagaaauuuauuucucacaguucuagaggcugaaaguccaagaucauggugucagcagauucuguuucuccugaggccucucucccuggcuugcguauggcugccuuuucguucaccaugucacauggucuuuccucugugugcuuccuccccuaguaucuccucuucuucuucuuauaagggcaccaguugcauuggauuaggucccacccuuaugaccucauuuaacauuaauuaccuuuauuuuuauuuuuauuuuauuuauuuauuuauuuuugagauggagucucgcucugucacccaggcuggagugcaguggcgcaaucucggcucacugcaagcuccgccuccuggguucgugccauucuccugccuuagccucccgaggagcugggacuacaggcacccaccaccacaccuggcuaauuuuguuuuuguauuuuugguagagaugggguuucaccguguuagccaggauggucucaaucuccucaccucgugaucugcccaccucggccucccaaagugcugggauuacaggugugagccaccgugcccugccuaccuuuaaagggguaauuaagguuaccuuuaaaaguugucuccaaauacagucacauuagggauucaggcuucaguguaucaauucaggggaauacaauucaggccaucacaaugacauauacauauagaagcaugaauauucuguauauuacuuaagugcauaggaggaacuuaaccauaggaaguccacaagccuuugcuccuuaaguccuggcauccagaucuucauuauguuagcaaaaguucagacaauggaaacaaauguggcacucaaauacacaacuauuuuaucuagaugaaaaauuaagcuuucuuuggaauuugugggauucaguuggggggcucaguugcuucucucuuagaggcaggaaaacaucagcaccccaggcagcagccacaacccugucuccuguuaaagccauugccucucccaagaacaaaugcaaauucccagcuaaacuccugugcacuuucuaggaggaggcucacuuugguccuucuaggaucaauuuaucugaaucuuuucuuuugaaggcggaccugcagcuuuauguagcccugaaacucugaaccagcuucucaugccagcaccccuucuuuagucacuucauaauucaaauugcuguuaucagcauacacuauuuguacugauuugacuuuuucacauuguuuuaaaucacuaauuuccuauuaggcagauuccucacaucaauaccauaagcuaauggcucccaugguauuuguucauaucuuucucuuaagauacuuaacacuuuuuaccugguaggaggaugauuuauagucauaugugucuuucuugccagaccuuuuaacuacuuaagguuagaauugcaucaaacccauuguuuuaucccaaccagugcuuaacaugauauggcacacguagcagagucacaguaaaaguuugcuguaauucacauagacuuugccaggagugcauagaaggauuaagcaucagaagcaaugcaaucgcaaagguaucucguaccaucaaggggugaggccaacaucuuagaaaauuaagaucaaauaucauccuucauuuuuaauuuaaagcuucuagccaguugacccagaaacaucccacaccuccaccaugacuuaccaauuugucugaaauaauaaagaggaaaaugagaggcuauuagcgccacuuccauucuccagucaaucauuguucuaaauuauuaaucaguugaaguauugccaagaaauuuucaggccucucuccaaaaguguaaaguagucauuuucaagugaacaauuaacuauuuuauucaucuagaaguuguagaauuuauagacaagcugauuucuguggauuuucuuccccccuuuuggaugcugguggagguaagagaggucuacaugaacuacaaauaguuuccuuuccaucacucacuuauuaauaacuagaauccuguuuaaaaggaauguacuaaaauauuuucuaggcugaagcaggaggauugcuugaacccaggaguuugagacuagccugggcaacauagggacacccugucucuacaaaaaaaaagaaaaaaaaaaagaaauuaaauuagcuggguaugguggcaugugccuguggccuuaacuacuuaugaagcugaggugggaggacgccagagcccgggagguagaggcuacagugagccaugauugugccacugcaccccagccugggcagcaaagagauacucugucucaaaaauaaaguaaaauaaaauauuuccugaccaguucagcauuuauaauauuguuccuaauagcaugccacuccugacugaucauugcuggcaaaagcaaagugaucgauugucaccacccuguuuguccccaggauuaacuugguaaagaaguacagccaugguuucugcuuucguggagcuuacauucuagaggagacagugaaaaagaaagguaaauagacaaaugaaacaacuacagcaaauuuuacuaaaaaaaaaauaaaauaaaaaaaggaaaaaagaggcuaagauaaagaaaggggagguguaccuuaaauaagaugucgauaaagaccucacuagcaggaaucauccuccguggaucaggagaauccugaaacuggggaccucauaggcaguccaauccaaagugugaauaggccaugaacauuuuuaaaacuauauauucaguucuggucaucuauugaccucagagacacuagauuuccaguggcauccacuacuaugacugcaauugcugagggguaauuuucugagccagaguuguagcaugcaauuugccuugucauucucaucugaugcucauuaauagucccaacuuuuauguaagguaugugcuuucaaagguagugugauauguggcuaaaaauauugauuuuuuucuuuuacacuuuuguuucuuuuaaaaggaggaaaagugagcacuaauuuuuuuauuucaacuguaucuuuugaagguucauuaugcauauauuuugauaaucuugucuaugagaaugaacccuaggacaauuaaauauccuuuaauuuugagauguguagucuggaaauaccuacauggccguccuaggcuuuagguucauuuucuuugagaggcucaaccccauauuauaucagauauauuuacaggucaaaaggcaagauugaaacaaauuuaguuuaaagaucuuaacuggcuuuuauuugugauucuagaaucagacaaaaccucacuguauaaaaaagaaugaguguuccaaugagcugagcagaggagguuuccuuuacagcuggaaaagggaugaagaaagcagaaacaaagaaccaaaagcaaauugguuguuuccaaguuacuuuccuuguaaagguuaaagcagagggacauccuuaucauauuggcuacaacuggucuaguugaggauuuggcuacuaguucuccccccugauuucuuagaaggucagaugaaaaacuugguuuuggcuugguggccaaaacuucagcaugaguaauucuauuuugguuuggacuguugagcuugguucaguaguucaguccaaaccaauggacuucuauaaauuuuauucaacauacacgaaacaguuuuuguaugugagaucugugaaaaauauuuuuauacuuuugcauuuaaaauuauuugcuuauguauaauuugguuaauuuaauuuuuuaaauugccuaaaauuucccaguaaucaacaugcaguuucaggaauucuuaagaacugagaaaagcuaacucauaaaaugucucuaagaguagacauuuuaauaacuauuacauuuaguaauuaaucacaauagcauaaaauuucauuuauugacauaucauuaaauaugacauuguucagauugugcaauuucugcauacacugaaaucaaaguaguuuuucucucucuguuaguucugaauauuuucauaggcccuugaaaaauacauuggcccuagucauuaguuccugguaccuaaagauuaaagaggcaauagaauauguguguauucccaggucuuacauggcacuagauagugggggucuuuucccccuaaauaaaguggaugcuauuauaaccaugcaugacuccaguuagacccagaugaauguaccaaaaucacuaccauuuaaaaagcauaaaaaaccuugcccucaauuuacugugauuugcaaacucuccucugaaguuucacugaaccccacuuauaaauaucaucuugcuucuuuagcaaauucucaaaccuuaguacauaagaaucacccagagcucuuauuaaaaacagauuccugggcccugaccccaaagaaucuuauuuaauagaucuaaguggagcccagaaaucagaguuuuuaaccuucugaaaccuuaaagguuguauaagccuuuagaaaacauuaguugaugugagcaggguugaugauaacagcugguaagauuagucuugacuugagcuacugaacaacucaaguccauuuaggcuagucucucucaacccuggcucauacuagaauccccuggggcuuuuaaagcacuuuacccccaaggauucugauuucuucuguaugggcauugguauuuuuuaaagcuaccauauaaacaaauugagaaacccuaccagccuaagggcauuucugucagaaaggauuaacccacacacugcggugaugauaaggccuaacacuccuacaaaaugcaaacacugaagcagagauuucgcaagacuaaaauccaucuggagcucuugauucccaguuugugucagccucaacacacccaaguuggccuuaacaguuauggcacaagaaaaugagcccuucccuuuaguuuucaucagcuggcagaaugauuuaguagcucuauuauaaaagcaacuccauuauaauuacaguguuugaauuauaaacaaaacaagaaaaauacagaaggaauaguccuuuagucaaaacuguaaaacagaacaauuucuggcugcaguuaaaagcaaacugaaauauuaagaguaagcucuccagcccuuugauucuugccucuuucccauaggagcgacacuacacauuuuuucaauuaagcaguuugacaaccugaagaaacccacagugcaugauuuaaugagcauauacugugugcaugguaaucggcaagcugacaguuugcucauuucaaacugacaagagagcacuacacauuaguagaaagguuucuugggucucuuuucauuaaauaagcuuuacaguugaggaacauuccaacuguauuggcaaagcugucacuaaugguccccaggcaaccuuaacucucugucacucuccaaguccucaagucuugaugaagaaauugcuucuuaaaaaacaaagcacaaaaacaaaauauagauauuuaaaguucucuggauguugucaggggcaagguggagcuuucugagccaugaauccacuggugauuucacaguacaugaauucuaacccaguaugugcugguucuucaugcagaucacuuuauaaacuggaauuguuuuuagaaauaaugcccaaacuguuaaauuauucaauaguuuagaaaugauucaguguacuggaaaaaacauaggccuuggugacagagagauagggguucgaauucugacuaaaauacuucucuguggccuuggucaaauuacaucauuucucaggggcucaguuuccuaauuuaugaaacauggacaauaacaucugcuuuguaugaacaagaucguaaaagucuuucgcacaguuacugacaacacaggcauacuuaaauagagacuaguuuacccacagaaauucagaguaugggguuuuaacaaagcuaacuauagucugacuguccugagauuucuaccaugagccuuuauuggaguucuauaagaagaaaaacaguaagcuaacauucacucacaaaugggauuuuauuuaauccuacuaagauucugaauuuuggguguuauuacaccuguuuuuauaaaaucucgaaauaagaaggguucuuagaggucauaugaggaauuucugacauuuuaacuuuucugauuacaagaauaugaaacuacuguuucccucuuugcucugcuugucagaaaacucgagugaauucucaugcuaaauguauguuugcaacucuguuagcaguagcgguuagcagauuuguuuccugauuuucuauacauauguuaguaaccuuacuuaaaauaguuuauaagcuacccugaaggaaguugagauuucuuagcuaacuaguaagauccauaacaagaauccaugucaccugacuccaggcuaggacaccucacauauaacauggaaaugacauagaaaaccccagaagcaaguacagugaagccauagcuuauugcuuggguccuaugccaugaagaugaucaaacauauuagccuucuaguuacgaggaaaaaauauggaagcuucaggguccuuauuucuaaaauagggauaauauauauuucuaagaucauuguaaagauuuagagagaauauuuucaaaaucagccaguguggcauucgauacauaguaacauuuuaaaagucugaaauguugacucuaagaaauaauuguaguucuacuaauuacaaguaaaacacaaaugcauagacccuuaaacaugauuuagaaaucauuuaucccuccaaacuucacgcacugauguaaaauucugccccaggcuaggugaagauccauacuugcugucuuucucucaugucacagaguacauggagaucuggaaaaguuguccauaaauuccaaauucuuaauauaaacaugucuauuggaaauacagacucuuuuuuuuuuuuuuuugagacagagucuggcuguuguugcucaguggagucaucuuggcucacugcaaccucugcuuccuggaguccagugauucuuuugccucagccucccaagcagcucagauucccaagcagcaucaugccuggcuaauuuuuguauuuuuaguagagauggaguuucaucguguugcccaagcuggucucgaacuccuggccucaagaaauccacccacuuuggccucccaaagugggauuacaggcaugagccacugugcccaaccagaaguacagaacuuuaucaagaauacacacaugugacauuuucagguuuaauaauuuauacuucaggguacucacaaaacugggccaaaaucauggucuaccucuaugugaaauaccaaguuucccuaugucucacagccaugacuccacuggugacuucacaguacacgaauucuaacccauaaauugacuauauccagaauguagccagacauaccauaaagauguucauuuaucuucaagggaguccacaaaaauagcacuguaguuccucauaugcauacccuaacaaaaaugagucagugguguuuccccagagaaaaacgaugcugugcaguggaagcagcuuuggaaacagacagauucagauuugaaggcuggcucugcuauccauuaguuguaugacauuggacaacauaguaugaaccucuuagagccauagauucuuccacuggcaaauggaggaaacacuuugaacuuauauaacuauuguaagcagggguuauguuaugauuuaaauguccccuccaaaaauuauguuaaaauuuaacugccauugucaugguauggagaagagggaccaucaagaggugggaccacugagagaugauuaggucuugagagcucuaccuucauaaauggauuaacaucauuaugaagaaaguagguuuguuaucaugagugaguuauuauaaaaaugaguuuggcccucucauuggcucauuuucauuuucuccugcccuucugcuugccuccaugggaugacaagcacaaaggcccucaccagaugccagcaccuugcuguuguacuucccaacuuccagaaccaugaaccaaauaaauuuauuuucuuuuaauaaauugcccaaucucggguauucuguuauagcagaaacaaaauggacuaagacaaaugauauuuaaaauauuuaaccauuaguaugguaaaggcaccaaccagcauaggcuuaaugccuguucuggugcauacuaauuaaauaugaacuccauuugaagaauuuugaaggcauccaacuugauccuagaucaugggaggugcuuaaacauauacaacgcauuaaaugaagcaaacacguguuguaaaacauuacaauaaaaaacuuagcagcaguuauacugagaucucuauacucuccaauuacauuuuuucaccuguguuguuuuuauuccaugauuuuauuaaaugauuguuagcuuaaagugaugagccacuugcgucuuuugacucaugauugagacagucgucaaaaaauucuagauuugaaaagacauaaagugaucucacuuggaauuuuaucaagucuauauucauguauaauccuuaugucuucuuaauuuaaugacuccuuuauuaugacacacucuucuucuuuaucucugauaauauuuuuugucuuaaaguugaguuugucugauauuauuauagccacucuagacuuccuaugcuguuuccaugguguauuuauuuccaucaauuuauuuuaaaccuaucuguguuuuuuuauuuaaaggcuaucucuuaacagaacauagcuguucuugcuuuuuuauacauucuaaucaucucagcauuuuuuugaauauuuauuuauuuuuguuuguuugguuucuuugcccacaaaacuuauucauuuugucaaucauuugaaaguagcuugcauucauaaagcccuugggcuuaggucuuuuuaaaaaaaauucauucaucuguuuuuauguguuuauuuuuucaaguuucauuuuagauucaggggguauauuugcauguuucuuaccuggguauauugcaucaugcugagguuugggauaugaaugguagcauuacccagguacugagcauaguacucaccauuugguuuuucaaccuuuuccccucucccuucuucccugcucuaguaguccccagugucuauuguuaccaucuucacguccacacguacccaaaguuuaguuccuacuuacaagugagaacauguggcauuuaguuuucuguuccugcauuaaauugcuaggauaauggugucuggcugcauccacguggcugcaaaggacaugauucgauucuuuuuuauuacugcauaauaucccaugauauacauguaccaaauuuucuuuaucugauccaccauugaugggcaccuagguugaguccauaucuuugcuauugugaauagugcugugacaaugaacaugcaaguacaugugucuuugguagaaugauuuguuuucuuuuggaucuauacacaguaauggaaucgcuggaucgaaugguaguucuguuuuaaguucuuugggaaaucaccaaacugcuuuccacaguggccgaacuaauuuacauucccaccaacaguguauaagcauuccuguuucucagcagccucaccaacaugugguuuuuuuuuguuuguuuaguuuuguuuuguuuuuguuguuuuuuuuuuuuuuacuuuagccauucugacuggugugagaugguaucucauggugguuuugauuuguauuucucugaugauuagggacaaugagcauuuuuucauguuuguuggccacuuguaugucugucucccuuugagaaguuucuguucaugucuuuugcccacuuuuuaaugggguugguuuuugcuuguucaaucauuuaaguuccuuauagacuccagauauuagaccuuuagugguuguguaauuugugaauauuuucugucauccuguagguuguuuacucuguugacaguuucuuuugcugugcagaagcucucugguuugauuagucucacuugucaauuuuugguuuuguugcaauugcuuuugaggacuuagucauaaauucuuucccaaggcugauguccagaaugguguuuccuagguuuuccucuaggauucucauacuuugaguucuuacauuuaaaucuuuacuccauauggaguuagcuuuguauauggugaaauguagggguccaguuucauucuucuguauauggcuagccaguuaucccagcgccauuuauuaaauaaggaaaccuuucuccauugcuuuuguuaacuuuguugaagaucagaugguuguaagugugcagcuuuauuucuggguucucuagucuguuccauugguuucugugucugucuuguaccaguacuauacugguuugguuacuguagccuuguaguauagcuuggaguuggaaaaugugugccuccagcuuuguucuuuuuguuuaaguuugcuuuggcuauucagucucuuuuuugauuccacauguacuuuauaauaguuuuuuccaguucugugaaauaugguagaguaguuuuauaaacuaccuguauaaaaccuguagauuauuuugggcaguauggccacauuaaugaaauugauucuuccaauccaugagcauggaauguuuuuccaucuguuugugucuucuaugauuucuuuuagcaguguuuugugguuccccuuguagauauauuucaucuccuugguuagauguauuccuaaguauuuuauauacuucuauuuuuucaggcuauuguaaaugagauuuccuucuugauuuggcucgcaaguugaacauuauugguguacagaaaugcuacugauuucuauacauugauuuaaugaccugaaacuuuacugaaguuguuucugaguucuaggaggcuuuugguggcgucuuugaguuuuuuaggaauagaaucauauugucugcaaagagagauaguuugauuucuucuuuuccuauuaagaugcauuuuauuucuuucucuugccugauugcuguggcuagcacuuccaguacuauguugaauaggaguaguaagagugggcaucuuugucuuguuccaguucgcaaggguaaugcuuucaguuuuugcccauucaguaugauauuggcugugguuuuaucauagauggcucuuauuauuuagagguauguucuucagugccuacuuucuugaaguuuuuuaucaugaagggauguuggauuauagcaaaagcuuuuucuacaucuagugagaugauucuaaggcuuuuuaaaaauccuauuuauguggugaaucacauuuguauuugcucauguuggaccaaauuugcaugccagaaugaagccuacuugaucauaguaaauuaaccuuuugaugugcuguugaauuugguuugcugguauuauguucaggauuuuugccucuauguucaucagggauauuggccuguugauuucuuuuuuuuuauuguguguuugucagguuugguaucagggugaugcacagaaugaguuugggaggaguugcuccucuucaauuuuuuggaauaguucaguagaauuguaccagcucuucuuuguacaucagguagaauuuugcuaugacacugcuacauuuuaauuagugauuaguccacugacauuuagucugauuacugauaugauugcauuuagagcugcaaguuuauuauauguuuucuguuugcuccuccacuucuuguuuuucuuuuucuucccucugcaacuuuuggaucauuuuuuucuuaauuuaggauucuauuuuaucuuuggauuuucggugguuuuucuaggaauuaaaacguauauucuugaucuuucacagucuacuuagauuuaauuuuauacuaucucauauaaaauuggaaaaccuugcaacuguauaaauccauuugccacugccuccauucuuuaugcuauaaagucauauggauuacaucuguacauauuacauuauaaacaccacaagacaauguuauaauuuuugcuuuaacagguccuguguaguuaaagaucuuaucaugaaaaacuagucuuuuauauuuacaauuuccaaaauuuuuucauuccuucuugaagacuuaagauuccaucugguguuaucucacuuuauagccugaacaaucuuuccuuuagcauuucuguggggcaggucugcugauaauaaaugcucuuaguuuccuuuuaucugaaaauguacuaauuugccuuuacucacaaaggauauuuuugcuacacauagaauuccggauuaacaguguuuugcuuuuuuuuuuaccccucguuuguacuuuaaaaacaucauuucacuuuuucuggccuuuauaaauucugaugagaagucaucguucauuuaaagcauuguuccaccaaagauaccgugccauuuuucucuggcuacuaucaagauucucucuuuauugcugguccucaccaguuggaauaugauguaccuaugcacaguuuucuucaaauguaucccauuugggguucacugcauuucuugaucuaugcauuuauguauuucaccaaauuugaaaauuugggcccauuauuucuucaaauauuuuguucuguuucauucucuuucucuucuccuucugagacuccaauuacauguaagcuagacauuuuaauuucuguuacacaggucccugagucucuguuuauuuuuuuuauucagucauuuuaagucuuuuuuucugucuguucuuccaaaagaaaauuucuauggaucuaucuuuaaguucacuaacacuuuccuuuguuuccuccaguugcuguaaguauacucaaugaguuuuuauuucaaauacuguauuuuucaguuucaggauuucuauuugguucuuuuugcaguuucuguuuacuaccuucuuauucauuaugaguuuauuuuccuauuauuuguggagcaugguuaaaauagccacuuuaaaaucuuuguuaauucccacauuuggcucaucuuggaauuggucucagauaauugcuuuuugucuucagaaugagucacauuuuauuggguuuccauauagcguguaauuugggguuguaugauaugcaaguauugauguuauuguaugaagagcuucaauccuguuauaguuuucugaaggguauugauuuauuuguuuuagcaggcaauuaguuauacucaaauuuaaaacuauccccuggguagcagcucgaaucucaguucaguucuuuuaucuuugugauaauuugugucugcuccaucaagaauauacacaugacauauaccucagaauuacaugacgugaucucacuuggaauuuuaucaagugcauauucaucuacaauucuuacuucuucuuaauauaaugauuuacuaucaugaaauguucuccuucaucucugguaacucuuuuugucugaaaguuuaguuugucucauauuaauaaauucaagggucaaccagaaauuuggguaguguuuauauacagauuugggagcuuccccucucugccucucuucuuuccaagauucugaauucauuuuccuguggcuaugauugcccugaacccuguucuuugggucuucaaaccaaaaacacugugaguuuucuauuggaggauggccacccgaagugacauuaauuuuagccuguucucacucuaaaaguuguaaaaugggaaacucacucuggaccgaccugugcuuccaaguuuugaauuucagcuccccuccagaaucugucugcuuaauuuuauucucuaaugcuuccagguaauuucuuuuuucuuuucuuuuuuuuuuuuuuguuuuuggucuuuugguacuuuauaguugauaucugugagaauuucggauccaguagaacuuacuuagccauauuggaaauggaaacaaguaaaaacauuuaggaaacauuccuuugcauuuccuaacaccucuccucaaaauacuuaaccuccguccauucccucauuuagugacauuugaguuugguuuuaaguagaaauagaagccaggcucagggcuuccuugaucaucuugccaaguacaugagaagacuuggaaugaaaacacagcauaaaguuaaaugauagaaugauagaacaucaaucaauucuagcucuuagacugguggcauuuaaucucaaagcaaugaggcuuauacagaaucaugacuaccagugauuaucuacaugguacuuugccacguuauuuuaccuuauuucuuuggucucagauaucucuaaauccugccucauugaaaacugcaauagauaauaugccacgagaaacagaauacugaaaauccuaaaaugccaacccagaguugguaauugcacaauuccuucuaaucauaaucauuauggcuuccacuucuugaaagcuucuguauaccagccaccuugcuaaccacuuuacauuaauugucaguuaauccuucacaacuauucuuugagcaguucccauaacuagcuucauuuuacggaggaaguaaccagaguuccgagagguugaguucacuaagagcacacagcaaacaguagaacucugagucagucuuuguaaagagaagaaauagcaaagggguuuuggagacaucaggcacauacucuuuacuauuaggagagaagauagaagucuuucuaggaguaaguaggguuucuaaaacuuaaauagucuacaguccuuuuugucaguaauuauugauauuaaaaugccacccuuccagaaacaauauauuuuauauugacagcuuuuauguuuaaaaagaaccuucuagccgggagugauggcucacaccuguaaucccugcacuuuggguggcugagguggguggaucacuugaggucagggguucaagaccagccuggccaacacgguaaaaccccaucucuacuaaaaauacaaaaauuaggugggccugguggcgggcacuuguaaucccagcuacuugggaggcugaggcacaaaaauugcuuaaacccaggagguagagguugcgguuagcugagaucacaccauuguacuccagccugggcgacagcgagacuccauuucaaaaaagaaagcccuccuucagggcuuaaaacacuaacccaaacaauaacaaaaggaucaaauaauuauauguaaaggcucauaugaaaaggcacauaacaccagugcuccauuuuaccucauuucauuuacugccuuuaaacuuuguuuuccagguaaaccaucuaaacaggcaggugaccugccagagaaaaaucuggcacauuaggaaguaaagaugccugccucaucccacaacaagaugcagcaaugucucacaguucuacaacucuaggggcaauccugcccaacuuugcaaauuuugcauaaaccauggguuucaagugacuuuggaaugagagggaaagggaaggcagcacgaaggauaagcuggcugacauuguaaaguggauacaggaaacugggacuuaaccggaagcaggaaaaggaauauaguaucuuuguguucugguacauaggauuauucaauauacauauuuauuauacauguuaaauugucugagacccggaaaugagagauacuguuaaaggaguaaagaugagaugagguaacagaaaaggagaggaguaaauaugaguccuaaggagggguuacaugagcacaguccccugacgacaugcuagagauuaccagauuagugcauugcuccuacuuucuugcuauuauuauuauuauuauuauggguuuuuuuuggcagggucucacucugucgccuaggcuggagugcaauggcaugaucuuagcucacugcaaccuccaccucccggguucaagugauucuccugccucagccuccugaguagcugggauuacagacaccugcuaccacauccggcuaauuuuuguauuuuugguagagaugagguuucaccauguuggccaggcuggucucaaacuccugaccucaagugauccaccuaccucggccucccaaaguacugggauuacaggcccuuuccugcuguuuuuaaaaauacauauucaacauauccggugaaaucauucaaagaugcauacagauaagugauuauuuuacucuaacguaaagccucuuuguaagaccuacccuucacugucugucccagcauaugcccuaggacuuccucugaccaugaacaguaccaugccacugaaggagaucuguuucaacagagccuccuccugcugcuccuaacuuuauuuccauuccacuagcuucucaaagucaugcaaaacauaacaaccugacuuuguaacuguuuaaccuuacuuuuuacacguaaaaauuauuaaauauguguaacugcuggggggaggauaauauaauggcaugucagucagguaacagguaagcuacauuucauggaaaagaaggggaaugcuuucuucagaaagugaagucaucauucuuuuauuuaacugacauaauauuuauaccccaauuuuuaaaauggcagcuacaaauagaagucgaaagaggguaaauucuccaagggaaucuagcccugaaauuuuaccauuuuaaaaguucuauuuuacaaguacauaggaacauuacuacuauuauaaggauacucacagcaggucaauuauuucaaacucuuugaaaaaaaaaucaaaauuaaguaaaccuaccuuucagaagacugcuaccucuucggaguccucaguggcaggaugcacagagcuuuuauagagggucuaagcaggcagguauuccuaggauaccuacaccaaggacaagaaauucagaugauuauuucagcagugauccagauggcucuagguacaauuucauuaggaacguucaccaugaauacugagcauugccacacagguacuguuaaaagcgcagaaugaagguacauaugugauuuuugcaggcauugucauuaaucuguacauuggagacuguggcucaaaaggguguaagugguucauacaugaucacacaagaaaaggggcagaaccaugccuuaauuauucauuucugauuccuaguccaggguuguuucagccacaucaucugauccuccucaagaacuggaaaguccuggcacuggggcuuuccauuuugcaaaaagaugaggcugacccgugagucuggugggaagagucuuucucugguuuucugguggucuaugccaagucaccugucugaaguguccuguguggccaguuuacucacuuucccuugaaacucugguguccacagaaucugaaggaaucugacaagcaaagaaacauggguuuuuuuggucccacuggccugaguuugaauccuaguaauguguuuacuacuucuguguccuauguagcugcucaacaucacugaggcucacuuucuaucucuaucaaacggguauaauaauauuugaaggguacauuuaugaagaggauuuuuuuuuucuaaaugagaauaaaguaucaaguacaguuucuggcacauguuagaugcuagggcaaagugaaagccccaugacccaccuuacuugcagggauaaccccaaaguggacaagugacagggaggcuauugagaccuugcugcucauaaaucacucaaugacaaugcacuaauccccuaacuggcugguuccucacugcucugaccucuaccucuggguuuccuucauguacacuucuuugaaauaaaaauaucauaaacaccaauucauucccuaggaucucauuuagagguaaucguuuccuuuuuuaaucuaauaaucuuggucuacaucauguuacauggucagcucaauguaguaauugaaagcagaugaucauucauuuaacaaguauuuauugagacucuacuaaggugucaggcacuauucucuauagcaguggacauaauaguccaagaucaggccaucaugcugccuaccuucugguagaggagacaaacaaacaaaauacauauguaaaauacaugagugguuaaauaguucuaaggacucuggagaaacacaaaguaggaagggagauggugaguacuauggguugaauucuguucccccaaccccuccccaucaggaaaaaagauauguugaaguccuaacccucaguacuuagaaugugaccuuauuugguaauaggauugauacagauauaauuauuuaaguuaagaugaagucauacuggagaucggugggcaggccucucauccaauaugauuggauauaagaggaugaccacgugaagacacagagacacaggggagaaggaacgccaugugagaauaaaggcagagauuggaguuacauagcugcaagccaaggauugccagcaaaucacuagaaguuaggaaaaggcaaagaaagauuccccugcagauuucagagggagcauggcccuggugacacuuugauuucagacuuguagccuccagaacuaugagacaauaaauuucgguuguuuuaagccacucaguauaugguacuuaguuacugccacccuaggaaaucaauacaguguguuuggggagauuguugcauuuuugagcaaggagaucaggaaagaucucacugaaaagguaaugucucagggaagauuugaggugcaggggacaaccaugaugauggcucuggaugaagaaauucuaggcagagggaacagaaaguacaaaccucccaggcaggugcauguuuguauguuagaacagcagggaggccaguauggcuggaauagccaggggagaguggcaggaaaccaggucagagugaugacaaggagcuggagggugcuagaccuuaugggccacucuaagaacuuaggcuuuuacuuggagcaaggugggaagccauugccuacuucugagcagaggugaaccaagaucugacuuacauuuuaauaagcucucucuggcuauucgguaagaauaaacugaagaacaaggccacuuaggaggcuccugcaguuauccuggugaauaaaggugcuagccagguagcacacaggagagugaaaacuggucaguccuaugcgaaauauuuugaaagcagauccaaaaggauuugcaauagauugcagguagagauacgccugacuucuugauaguacauagaauuaaauuagaaaccguaacaacuuaacuguacugaucaucugaauaaauuaucuucucaaaugccagaccagccaaagauauuagcaacagguuuaacagacagggaauaaguaaccagaauauauaaggaacuccuaaaaucaacaaaaagaaaaagguaaacaaauaaauauuuuuuaaaaucaugauucaaagaaggaacaauggaccauggacauaagaaaagcagcucaaccucacugauaugguuuggcuguguccccacccaagucucaccuugaauuguaacucccacaauucccaugugucaugggaggaaccuggugggagguaauugaaucaugggggugggucucucccaugcuguucucaugagagugaauaagucucgagagaucugaugguuuaaaacaugggagucucucugcacaagcucucuauuugucugcugccaucccuguaagaugugacuugcuccuccuugccuuccaccaugauugugaggccaccccagcuacacggaacuguaaguccauuaaacuucuuucuguuguaaauugcccaaucuccaguaugucuuuaucagcagcaugaaaacugacuaauacucucacuaaacaugaggaaaaugcaaaugaaaauaaugggauucuacuuuauuucuaucagacuaguuaacaugaaaaagacugacacaauucaguguuguccaagauaugagaaaaaauagcauauuauucuaguuuacuuccagcggaaucaugaauugguauauuauucuauugagcaauuuuacuguauuaucaaaagugacaguacacauaugccacggcauaguaacucuucuugggggguauaccagggcuaagaaacauacacauaaggggacauauauuaaaucaguauaacaaaacuuggaaaugaccuaaaagucacccuuaaaggcaaaucaguaaauaaaauaugcuauauuuauaugauuaaaggacauauggcuguuaaaaagaauagauugguuuuauaggcaucaguguggauguuucauaaaugucaugggcagaaaagcaacacaaaggaaaauguuaacauacaaacacaauaguauguauucauuguaggucgggguccccaaccgccaggcggcagaccaguaccagucuguggccuguuagggaccaggccacacagcaggaggugaguggugggcaagcgagcauuaccgccugagcuccaccuccugucagaucagcggggacauuagguucucauaggagcaggaacccuagugugaacugugcaugcgagggaucuaggcugccugcuccuuaugaugagacccuaacgccugaugaucugagguggaacaguuucaucccaaaaccauaccccccaccuccccauccauggaaaaauuaucuuccacaaaaccagucccuggugccaaaaaguuggggacugcugcuguggauacacauauauguauguaaaaguauaaacaacggacuagucaaauacaucccaaauuuaugguagggaauuuuaggcagggguacaggcagcaaagaaaguggaggguggagggaaggacaggacauuauuggugaaaaugauuugguuuuaucaauaacuucuuuaaaaaggaaaaaaacaacacuggaagcaaaucugaccaaacaaaaacagauacucguuuugggauagugagaguacagaugaucauuacacuaguuuuugugcucaucugugcuuuuuuguuuucugcgaguaaagaaaggaggaaagggagggagggaugaauggauggaaggaaggaaggaaggaaggaaggaaggaaggaaggaaggaaggaaggaaagaaggaaggaagggaguuaccaguucuggacugcacuuaagcuaaucgcuaaucauagauggggauagaugagguuaguuuuuuuguuuuguuuuguuuuguuuuguuuuguuuugagauggacuuucacacuuguugcccaggcugaagugcaauggcacaaucucggcucacugcaaucucugccucccagguucaagcgauucuccugccucagccucccaaguagcugggauuauaggcacgcgccacuacgccuggcuaauuuuguauuuuuaguagagacgggguuucuccauguuggucaggcuggucgagguuaguuuuuuaaggaugaaacucaaaacuauguuuuaauaaucagcgugaccauuggugauuccuagcagacugucucagcguggagggcugaauuucaguucagcccgcagagggaaccaucugucauuuggaaugacaaggagcucucugccaggggaacaccagaacaccggaagcagccauggucuucacugcauccccacuggcccuggaaccaccaacacuacaggacacaggaacacacaaaguaaaccaaggguacaccauggacaucuuuucaaccuuuuuaaaagcacauugcaauuuucuagaaucaagggaacaauaugcuugauuaguucuucagcagauuuggcaauuuugcuugucauauuucucucuuuaaagcaaguuggucauuaaccuuccauguucuaggacuugagauuagguuuuccccccacaaaaugaaaacuuugcuuaaaaaaaaaagaguuugcuuuaggauaauucauuuuugcugcuaauaacugcaagauccucuuugagccaaggaggucauucuugaaaggggcuagaauugugaagaauguuccuucucuuccuggagagagagucugugaaggcaaaaaaguuugcaggaaaguucaguaaucaugaagugaaagcccaaagugaccugaauacuuccuccugggucaauauuguauguuuaaaaagaaacaaccaaaccuucaaagaaaaaucuggccauccccaaaucccaauacaugaaacuagaaggcaggaggcaccaguagaaugcuggcuuugcucucauugcuuggccuccaucacaguuacaauaguugcauaucauccuuuuguacgugucauccuaaaaaugggauuuggauugguuucuaacaauaaaacgagcaagguagaaaaggaauauuaugaauaaguuaccaauguaaauaugcuauuuugcgccuuugaauuugaguguugauaaacaugauuccacacauggaaauuagacuuuucagagcuacuacacugaaucauuuaauuugucugaguaaguacuuauaauaauguggcugcucugcacugcaauaaacaucggguuuucaaaugaacaaaugaaguaugugauacuccuuauaaauggaacugcagcaaagggcguucagcuagggagcugugcacuaaaaugggaugggugauaagaacaucucucuccagcuccacugauagugaaaggaaagaaucauauggccucugcugcuacauuuucuguuccuggacagaagcaaggcugaagccucacugugaaaugaugggggacuguugcuauuuuggguugucacaggguaacuugucacacuacucaggacacaugaggacagauaauucuguuccuccagauuguggacuugagaaugcuuuaguaaaauagcacagggauauauuuuggauagugguuaaggacauggguuugaauccugggcucuaccaaccaaauaggugcaugauuguacccaaguaaucaucagucuucuccaugcucauuuuccuauuugguaaaauaaggauaauaacuuuggcuuccucauuaaguuauuagggggauucagugagauaauuuauguaaagaaccuggcacaugauuagaauucaccuuuuuuaacauuaucauuuuaacauuaucaucacauuuuuaacauuaucauucaccuuuuuuaacauuaacauaaccauuuuaacauuaucauuauauaugucaucauuauuauuauauuuaaccuuacuuucauuuuaauccauuauucaauuuuccuucaacgcucauuaaaagcacaacucacuacauuguuuaguaauuaauuacuuuuguucauuuaacaaaguauuuauacuuuguuauaugugccaggcacauaugcuaggggcuaggguacauaggugaucuaauccuccuggaagcuauuagaggagaugggcaugagucaaaggcucccauaggaagugaaaccuuugaaacucagggaacaggucuaaaagaaaggagcaggcuaggcaugguggcucaugccuguaaucccagcacguugggaggugaggugaguugaucaccugaggucaggaguuugagaccagccugaccaacauggcaaaaacccaucucuacuaaaaauacaaaaauuagccaggcaugguggcgggugccuguaaucccagccacuugggagacugaggcaggagauucaguucaacccgggaggcagagguugcagugagccgagauggugccacugaacuccagccugggcaacaaaagugaaaugcugucucaaaacaaacaaauaaacaaacaaaaacaaaggagcagaucacucuaagagauacuaaaacaaaggaacuuaaauuaaaccugagaccugaaggaugagaaggagaacaagggauggaaugauggcuuucuugagagaaacacaacaauauucaaaggcauggaguauacagcacuuuaucauuguuaucaaaagucauugcaaaaugaucuacugaauagcucaauuaaaucuaacaacuaugugacaagcaccuacuaugagccaagcgcagugccaaacucuagaaacaccauaguaaagacagauaugauccaugccugcauccuuaccucccaacaccuacuacuauguuugaaaaccacaccaaagucaauauuuacuuuguaaccaauaaauuaccccucuggguuugaucacagagagauuucaccugcauggaaaaacuggaaugcuuucucuggucagacaaggaauguuacauaugccaaauaauucccuuucuucuuaguugcuggauaucuacaaccaaauuuaguuuauuccaugggccuaccaacuuauacuacuaaagauggccauguuucucuuucaugauuaauuguucuauuauuuguagacuaccuuuaauuuaguaaacagccucagccucaaauuauuuggaaaguuauuagaagaggagaaaaaaguaaaagaaaacaaggaaaagagaucucaaguuucuugagaucugggaauuguccaaugugcuuucuguaguauucgugguaccuaacauggugcuggauggaaagcauuuaauaacuucugauugucagauggaugaagaauauaaagcuuuccugguucaacuugggcuccauuagaaggagggaagaacugaaacucgguagaucagaauaugccuccccacaacauccuucuuuagcauaaggauuauuuugagcugauuauuuugagagacugcagcuacaggagaagaucugaaaacagaagagaaguuaccuuuuuguaaaaggauuuuacaucuauaaaggaaauuucuacucauaagggugucucccuuucuauaccaggaagagaaggaugaccaaaucacuagagacucuuaccaauggagaagacaccaacuuaaaucugcauaacaaaccuuacucauguuuaccauacuuuuccugggcaucccuccacaacugacuaucccccauacccuucuuuuuuuucuuucaguggacaaugguauuugagccugaucucaaagccaccucuuugagauuuauucauaucucuggguaucuuccacguguacaugagauacacauauuuuuaacuucuguuuguuuuucucuuguuucugggucuaucccaaccuaaggaccauaaaggguaaagagaaaauuauuuuuccuucccuacacuuacuuuucucuagucuccagguucagaggaaagaacucaaaaaaguggcugaaaaguuuagcaugauuuucauuguaaagcagcccaauaaccaaacagaagcaccacauaaaccaaaagaagagagugguaagugaaauauaagguaccauuagagauuucucucagggaauaagauucuuguaacaaaauauuuaccuuucuuauucuggugcuaguaaaaauaagagaaaugucacaauuuuaauuaaugucuaagcaacagggaaaaauauuaagcuacuuuaugacaaaauggaaauauauuuguaauucuauauccuaauguucucucaguuauuuuggaaaaacuauuaguccuuuggucucuucuacauuaggagagcaaaaagcuauaauauggccuaucuggcuaacuaucgggaaucggagaaaucaauuuaaaagaaauuuggaagacaccuacauuaucgauauuagagcaaaguagagaucugccuuguucacagcaaagcaauccaauucacacacacacacacaaaacaaauguugcauuuauggaaguauuaaaacaucucauccuuguccuuagcuuaacauauuaaugagaauuucugaauuaaucuccaaucgugaacugugucuaggugugauauaagggcaguaaauacugugcagcuugcuucaggcauguuuuaugacagauucucugacagauagaaaaucuuuaagauuaaauuauuucuguauuuuccuaagaaacucaucaguacuaacaagcauaccacuuccccaacuaguugauaaacagaaaagaaaauauuauuaagugauggcacuugaggaaauaguuaaaaggagaaacucagaacauaagauugugauuauauauaaugaggagauucucaaaauggcacagaaaggaaaggaacgaguugaagcugaaaaacguauguuuuuaggagguaaguuauuccauaaagcaauuacuaaaaugugagaguucuucucaugguucucaaccuuauacucugaaagagaacuucuuauaaugcaagacuaagagagccaauuacuucagcaccaagguacauccuaaaucucuggacuuggcaguucaaaaaaacucuuggaaaauguucuucuaaaaucuucacuaacagcccugacuuuagaaauguagacucuaaaaggaugaauaaaaacuaaccaauuagauagcaaaauggagaagagagagcacugaauaaaaagaccugccagaguucggguuguaccucugccaccagccucagacuuaguucauauuuacaauaaaaccauaaucauaaaaauuaauaauuauggaacacuuaguaugccaagaacuuuucauauauuaucuaauuuaaucauccuaacaaccuaugagggagacaccacauaagagaaaagcaguugaagaguuuguccaagaccacccagcugcucugagugauggguuaggauucaaacacgauuuuuuuggaccccagagcccaacccuuaaccacucacucugcagaauaguucagaaaccuccuaggaugaucuaaaaggcuucuuucaacaauagggcgcuaagauuuaugagacaugauuguauaauggaaaaaaaucucagguuuuugaagugacuuuguagcccaguugagcagcuucuucucuaagccucagaaucuuagauaacaacacuacuuaccuuacaagcuggccuaaggaucagagauaauacuagagcccuuagccccaaguaauaauaauaauaauaggcagcauuuauauaaugcucauuaugugcugggcaccaucuaaacauuuuuuuccccacauuaaaguaugcaaucuucacaaugaccuuaaaaguacuauuauuuuguacuuuuuaucuaauuguauaagaauacaauuagauaaaaagaaaaaaaaagaguucuauuguuuugauuccuguuuuaccaaugaggaaacagaggcaaagagaguuaaauuacuugaccuaaaucacaguuacuaaguugcagaucuuggauucugauccagacagaaugacucacuggacaacccaaaacauauuggaggcacuccuacugauacauaaagaaccuccuugccaugcccaaugucugugucacucucacccaaaguaacaaauuuaacauaaacuugggaggaugaaauacauagggaugcccagauaaccugccuacugucauuccgcagauugugccuuuaaaaaaaccaauuucaauagaaaccagcaagaaagagauacaucagguaugucagacauacguggucacaacuauuuuuucuccuuccuggcuaaucacucccuuuguguugauaaugugcugcuuuaaaucaauucauaaaaaaaaaaaaaagcacagaggcaccauaaaagucguuuuuccuguuuucaaucuggaagaaauucagucucuuauucauuuuaaaaacuauuuuaauaauagcuuuuacuuaacccaauauaucaaaaauauuauuucaacauguuaauaaaaguuaauaagagauuuuacgcuaagcauucaaaauucagaguuuacuuuacauuuaaggcccaucucaaaucagacuaaccugauuagucugaaugcucaguagccauauauguugcuaguggcuaccauauuagacaacacaguucuagaaagauuggcuuagaaaagcccugguuguugauauuuauaggucucuuuccuugggcuggucaaauuccccagaaagauaucuuucaaucuccugccuuagggguauaagccugggugccauuguucugagauuuaaguaugggaaagagcagaagccccaucauauugucuuucacuuaagccccgauuuucaucauuauacccauccucagcuaugcauggugacuccaaucacgagcccuguaguugguccaaccccuccagucuuccuccuggggaaguagggagggaggcaguugggagaggcaguucccaggcuaugcggguugggcaagaacucuggggacugguuagcaguuauuugucauucuuucaauguucuuuuaauauuccuucauucccacuuucauacauuuacagugccaugaauuccugacacguucuagaaucucaguuuagauuuuaccguuucucuccccuuuuaaaucagucccuggccuuuuaaggcagcuucuacaauuguauucugugaccuucuccucuaugauuuuuguucauauuccccuccccuuuuuuaacuaacauuuuuuauuugaaauaauuguagacucacaugaagguuguaagaaaaaauacagagaagguccauaugcccuuuauccaauucccuucaaugguaacaucuuggaaagcuauuacacaguaacacaaccaagauauugacaaugacacauucaaaacacagaauguguccaucccagggauccucuuguugcucuuuaauagccacacccacuucccucccacuccaccccuucuuaacuuuuaaccacaaaucuguacuccauuuauauaauuuuuucauuugaaaaauguuauacaaguggagucguacaguguguaaucuuuugguuuuguguuuuuuuccccuuuaaucuauucccugaagauucagucaaguaguuucauguauuaauaauucauugcugaguaguauucgaugguauggauggaccacaguuugcuuaaccauucacccaauaaaggacaucugaguuguguccaguuuggggcuauuacagauaaagcucuaugaaaauucauguaugggcuuuggugugaacauaagcuuuuguuuacuugggauaaaugcccaggaguaugauaagugcauguuuaauuuuguaagaaacugccaaaccauuuucuagaguggcuauaacauuuuacauucucaccaguaacacaauuucucugcauccucaccagaauuuguuguuaucauuaucuuuuauuuuaguuauuucaauauguucauagugauaacucauugugguuuugauuugcauuucccugaugguuaauaauguugaacaucuuuucaugugcuuauuugccaucugcauaaccucuucaguaaaaugucuggccauguauuuucuaauugaguugcuuggauuuuuuuacuguugaguuugaaaauucuuuauauauucuaaauacuaguccuuugucagauauguaguuugcaaauauuuucuuccagccuguaguuauucuuuucauucucuuaaaagggucuuaggccgggcgugguggcucacaccuguaauaccagcauuugggaggccgaggaggguggaucuuuugaggucaggaguuugagaccuggccaacacggcaaaagccagucucaacuaaaaagaaaaaaaaaauacaaaacuuagccagccacaguggcaugcaccuguagucccagcuauuccagagccucaggcaggagaauugcuugaaccugggaggcagaaguugcagugagccgagaucgugccacugcccuccagcuuggggaacugagugagacacugucucaaaaaagaaaagaaaagaaaaaaaaaaaaaaaaaaacucuuucacggugcaaaagcaaaaguuuuaauucugauauaguccaauauaucaccaauauaucauuuguuuccuguuauggauuguguuuaugugaaaucuaagaacucuuucccuagccagagauuccaaagauuuuucucuaaugccuucuccuucuaaaagaaggguucuuuauucuguuccguugaucuauguuucugucacuccauggauagccacauaguaacuaugcaauacuucuugaaacuggguagacugauugcucccacuuuauuauuucuuuuucaaaauuguuuuagcuacucuaguuccuuuguuucuguauaaauuuuagaauaaugucaucuauauaugaaaaaaaucauacugagauuuuugauaggaacugcuuuaaaccuguauaucaauuugggaaguaucgguaucuuuacuacgcugugacuuucaaaucaugaacacaacauuuuucuccauuuauuuacauuuuuaaaauuuauuucaucaacauuauauaguuuucaacaaacaaguuuuauaaauguuuuauuggauucacauaaguauuucauauuuuugagcuaaggcaaauuguacuauauuuuuaaaauuuguguccacagauucauugcuaguauaaagaaauacaauugauaauuuaaaugucuaucucauauccugccaccuuaaugaacucaauuauuaguuuuucauuuguuugcuugagauagggucucacucugccacccagguuggagugcaguggcacacagguauuggcacaaacacaaccuucuauagccucaaccuccugagcuccagccauccuccugccucagccuccuaaguagcugggaugacaggcauacaccaccaggccugguucauuuguuguuguugaggagagaugaggucucuccauauuucccaggcuggucuugaacuaggcuccagcaauccaccugccucggccucccaucguguugggaugacagucaucagucacuacacccagccacuuacuaguuuuaagaguugguuuuguguuuuuucgucuuuguagaucacuuaguguuuucuguguagaaaaucaugacaucagcaaauauuaacaguuuucuuucuuuccaucuguaugccuuucauuucccuuucuugccuuauugcacugauuagaacuuccugcacuauguugaauaggagugguggaaccagccuugcacugcuggacuagacuccauuucgucgugguauauuauucuuuuagccugaauccuguuuguuaauauuuuguucaggauuguugugucucuauuuaugacaguuauugguauauauuucucuuuuuugcacuguuuuuucuguuuuucauaucugaguaauaccagcuuccuaaaaugaauugcgaaguguucucuccuauuuucuggaagagacuguauaaaacuccuauuaauuauucuuuaaauguuugguaaaauucuccagugaggccaucugggccuaaauauuuauuuucagggaguuuuuaaaugauuaauucaauuuuuaauaguuaugggcuuuuaaauauuaucuauuucaugauaggugaaugguaggaauuuguguuuuugaggaaguggcccauuucaucuaaguuaucaaauuuauguguguagaguuguucauggcauuucuuuauuauccuuuugaugucuacagggucaauagugauaucuccucuuucauuccugauauuguaaccaaaugcagguccagaugcccacuguuuacagaguccaguuaacaagagugaggucuaguagaaagaaagucauuuuacuaaaaccaguaaaggggaaauggucagauucccgcccaaagcaaucacuuugauuuugggggaaggcagggguuuaaaaagggaaaacuugauaaggaaggcaugcaagaauuguacuaaguauaauaucugugugucuuguucugguagcuaucuugggucucagucuaccuggauggugagucaagacaucugggaauaucuuuacuuccccuuuauuccugaggauauuuucacgggcuguaggacacugcuuugauuguugauuauuauuucauucaggacuuugaaugcuuuaaguuccugagcagccauggccagguuuuuaacuagccacuuugaaguaaucucuggaauuuugcagcugggucuccaagcuuauuccgccugucucaagauuagccccuggaacuucuaagaaggcacaguaauuagauacuaguauauacuuagacaaaugugaagggaguauauauggugaaaaagggagggacguggagccuauuucuaggcugaggaaaaggcuucugcaguuuuucaagguuguaucuugaaaaccaagagaagagaaaaaaauguuuuaaaaugcauuuggaaguuaaguugccuaguuacaauauugguaauuggugucuuuucucuuuucuuugucagucuugcuagacugucaguuuuauuaaccuuuucaaagaaccagcuacucuuguuuuccuuugauuaaaguuugcaugauacaucuuuucccauuauuuuacuuucgucuauuguuauauugaaagugagcuucucauagacagaauauaguugggucauauuuuuuaaacaauucugcuaaucucuucccuguauuauaagugguauauuuagaccauuuaacuuuaauguaauuauugauauuuuagaauuuacacugccauuuuauuuuuuguuuauuuucuguuuguucucuuugugguuuucuguuuucuuugcccagacuucuuauaagcuauuugaacacuuuuuggaauucuguuuugauuuaucuaaagugucuuucagugcauuucuguauauaauuuuuuaaagguuucucuagguauuacuuuauauauuuauaacuaaacaguuuacuggugucaucauuuuaccaguuugaguaacauauagaaacccuaucuccgcacuuugcaucccuuuaucuuccccauuuauaauauaauuauuuuaaauacuuccuuuacaugcauuuacauccacaucagaauauugcaauuuuugcuucaaacuucaaacacaauuagagcucucaagaguacaaauguuuuugcuauguuuuuuucuuccuuucugauguugaagagauccauuuuuaauugucuucuuuccaauuagauaacucuuuucuuuucuuucgaggcagagucucaccgugucauccaggcuggagagugcagugaugcaauuaugcaaauucuuuuaguuuuccggcugggcgugguggcucacgccuguaaucccagcacuuugggaagccgaggcaggcggauugccugagcucaggaguucgcgacgaaccugggcaacacggugaaacccgucucuacuaaaauacaaaaaauuagccgggcgugguggugggcgccuguagucccagcgacucaggaggcugaggcaggagaaucgcuugaacccgggaggcagagcuugcagugagucgagaucgcgccaccgcacuccagccugggcgacagagcaagacuccgucucaaaaacaaaaacaaaaacaaacaaacaaacaaacaaaaaacacaaauucucuuaguuuuccuucaucugauaauauuuuuacuuccccuuuauuccugaggauauuuucacaggcaauaggauacuggcuugacuguugauuguuaucugcauucaggacuuugaaagcuuuaaguuccugagucucagcagaaacucaaaaauaauacauguaggaagagcuaaaaaaauauacaauaaaccggauccuaucgaauuuaaaugucaccaggcuacaagaaacugauucuggcagaaaaaauaaacaugugaaaaauaauuacaauaaugugugauaagugcaaaaaugcagguauguacuugucacgaugcugacacacagagagaaucagcacugcuugagagaaucagugaaaacuucucagagaugugugaaccagguucugaaaguuagguaguaaaaggacuuccugggugaaggggaacccagcacgaaagcccugagaaaagcggaaaagaugguacauuugagaaucugugagacugaaugccuggcugagguauagaacacccauuggaacaagcaagagaugcaguagaaaagacagcuaagggaaggaugcugggcuagagggccucauccucuacuaaggaguaaacuuuauccuguguaccacgaggagcuaccgaacagacgaaaauggugaguguaauauuuaaagcaaugauugcuacuauaacacucuuuuuaaaguagcuuuuccaugaauuauuaacauuaucuuuagucuaauacguaucaaaauuuaguuuauggacugguaggauguguuaauggccaauaaaaguaaaagacucagccgauucccugccuucuacacuccauuuuacacacacuccauccugccugccgaaugacuucagugucucugugaccagugagugaagcagcaugcaaugagaucauggcuagauggcagcacauucagugaagugcuucagcuuuccuguugcuucugauucccuggcauuugucagugucugucaaaacauuaacauuucuuaauguauauuuugcauuauuuacuaaaugaaaauuuuccaaugacaguggcugagaaaaaaaaaucagauuuacauacaguaugucaaguucacauucgaugccccagaaaugcccaguccccaaagaccucuagggacugcagcucauuuguugucccucucccucucccguuuauuaugcugacccucugcccagccacauagcucaccccacccccuuagaagcaucuagaguuggcucuagacaugaaauggaauagauuucugcauuuacauaacugcuaucgcacuucuggugaaaaguaguuucagaaaaacacagaaaaaaauaaacagaagaauaaaaagugucuaugugauaacauaagggcuuauuuaacuacgucuuuauuuccuuuacaguccaacuauuuuuuuuuuaaaacugcaugccaccuucaugcugccucucggaggggacuugaucuuauuuagacccgguggcgaggguccuucagcuccgugaggagcucucuagcacucaguccucuuuagaggaaagauaucuucagagccuaaaggccuugaaagaaaugacacauuuuuaaaaacagaaaaacaagcaugaaaguggcccaucagaaaugaaggugugaacuagaauacaauagacagcgaggaaggagccaaaaauccucacccaggcaggccaggauauaugcagauagggaggaaauugggaggcauuccuuugcuaauaaagaugauuuuucuucuaauuuucacaucuuucaugauguaucuuuuguuuuuuguuuucucucuaugacugcuguucuaaaauaagugggcuuuaagaauaugaacuacaguccgcauguuugccagccccauauucugcgaugaacuugacaugugaaugaaucaauucugcagaggugaaaaguuauuccuacaaaguccccaguuuuccuugugagaaagaucccuacuuaccuguaaacuuguuaauuaaaugucaaagguuuuuauaucaaggacaauaacacaagccaaccugggaaucugcuugucugaaauagguaaagagugucuguguuuauuuagaauugauuguacacuuuccuucauucucuacauagauuuuauuuucuccccacauucuucuuuuucuguauugccuugagggcuuucucuuauaauuaugugacaaauuauaucugaauuauguucaaauaagcaaggagacugagguuuucuguuaaaaacauauggccuaucaguaaugaaugaaguuuugcccauaucaugacaugacuuuauugaaggcaccaucucauauaugcaguuuucaauguggugucuaacagauuuguguaaaaugucuaaaauuaagcaaaugcaauuauaugaguuaguaucaucuuaucauguacauuuugcuugauaauagaaaagcaaaugaaaaguuuauuagcuuauuacaacagucuguuuuugauuuuuacuuuagacucuauuccucuuuauuuucuccucuucuguuucgggucauuauuuuaucuggagaacccaaaauccaauucuucaucuguauuuaccacauagaucuuuagauucucuuaccaauccaacagauuucugaauauuuaacuacccuauuguaaguugucuuguuuagaagaaauggaaucuaagauuguggcaguaaaggacaagcugucaauguguuaaauaaauuccuguugaaaaguaacggcaugcacuguguguuaacauaauuuauuagaacaauuagaacccauccuuguugucuuuuaauuagauuauucccuguucugguaauuacacuagacaagggagaauaauagucuugggauucuaaaaucaucuguagacuauguggaaagagaauaaauaaucaauaaugcuaauguaccggaaaacuuaaauucccagaaagagaucuuuuaucaugagcaauccuuuguauaaacagcauuauuucucaaugucuaugcuuaucuugcccaaaguugaaaagugaagacacuggacaaauaacagauauuuauuuuacugucagaaaccugguugggcugggccaccucuggccucuaguggcucagacauugcuucagucccuugcaaaaugccaacaagaaaccgcaaaugaaggauuuaaaauuccaugcagagcagcauaucuagcagucugaaugccuaagggaaaggaugcagggcuuuuaaguucugguccuaggugaggaaucauaaaguuccucaauuuaaaaaaauauauacaaauggacaaaaaugucuuagaacugagaaggcuacuaaauauuaaaaaaaaauuucugauauuuccauacaugaagauguuauuugcagaaauuaauaggcaggcuguaugucaggaaaguuucuggcucucagggaugggcugaggccuuuagaugugaaucgaacuacaucucugguuuuauguuuggaagaccacagggaauuccagugcuccaaggacgcuccgagggccuacacaacugucaucaagcauguuaggacauccuagagaguaguucccaaaacuucuaggcuucagaaucuugacaaagucaugggugggcauauccugcccucacggauaacccuacaguugaguagaaggaugcuggaaugcacagaauugacaccagugaaucuggaguucucuguaguaaugagcaacacaaauaucucaccaacagucccacuguuauccgagucugccuuagucaauguaaacuccuaaugagaccaugucuagacaguauugaucucccaccagaaaaaaaaaaagaacucagagugugacuucuuuucuagcuuagcccaaaugacacccuaaaacaugcucuuucauucacucauugcuaacacuuuucauaaccugagauauuuuaucaacuaggcagccaaggacccauaggcuucuucgcaagguauaugugauauuuuuuauauuuaaaacaucuuugauauucaaauagcagauaagaaaguuacuuaagcuuauuaaagaaccuagagaaauuaaaugaguguauauauauauauauauauauauauauauauauauuuuuuuuuuuuuuuuuuuuuuuuuuuucccuugcuaggcaaaggagacaggccuuuaaaaaaugaaaguccacauaagauuaaggugugaucauucaaguuaaugugggcaagauaucuaaaggagaaaucauuagcuuaagcuauccaaaggauuuuacacacaguccugugguuuaggagcagaggaucacccguacuacugugcuauccaucccagcugggaagacaugguucuuuauagaaguaccccuuaaaauugucaggggugcuauuaaguacuuaggguuccccacuauucuuaucuccagacuggucaaaucuaccaggcaucuuucugauauaucagauagauacaaucuaucauagauauaccaaagauuuauuugcaucugaguguccuguggugaggcauuccacagcaggcugugcaucaggucugucugcagaaaguaagaaagaaaggaauacaguuuaaaauucacguaggaauggaguuuaaaaacuccccaggcaaugugaaggugaguuaggacugggaaccacaagcuaaaaaggagaaccacagagaauucuuucugacuuuggggcugaaaugaagcugaccgaggcauucaggugguuccagaggcuggaaagucucauacgacagguuuuuuucucacaaaagagaagugaaauaaguaccuuauuauguuccaacaauaucaagauacaaaucuaucuuuuagaaaaaugcuaaauaaaaacacagucagagagagacuuccaccacuauaaauaguuucuuauaaaugccaccuagagacaaaauuaucauuucuaugauccuaaccaaaagagccuugcaugucuuggaaauacuuugcccucuaaagcaaccagaagaacauuccuucagucuauguguucuugugcuggauuuugaaacuuuugagcauuugcucccaaagugaaauuuaaaaggcuaacagcagggacaccuggauaacuagaaaacuuaccuauugauaucacaggcugcuucuccaaauggacuguauauaauuucuugcaagcauaguaaaaauccuauacuugcuugaaaugaaaugaaggaaagccuaucaugaauuucuuuuucucuguguuaaugaaagacacgagcacaccaugauaagcaggagagaaugaccuaguguucauccuucucuucuuguccaacgcagguaacuauaggugggcucuggguagaguauaugauugcugcauauuucuaagaaauaaaguuaauuuacaggcuaccucaauccugacacucuagggguaaggcaagcaugcauguauguauuucugguaaucaagagggagaaauagcagugaaaaauagagcuuggauauauaucuuaaagacaugccacugauuucaaaauagggcaagagcacuuaugauuuaauauaauuuuguuggaaaaaguuaacucucuccaaggaaauacagagcuuagcaaauaccuuauaaauaauacaaaggcauacuauaguguuuaguagaaucuuauucacccauucugauuuggacaaauguuaaaugagacaaacaggagaaaaguuuauugauuagguaaccgauuaaaauuuuggugaaaagcagaaguaguaaguuccagaaacaagaaauaaaucauguauaucaacaagaggaaugaaggcauuuugugcaauccuggggaauagauuuucuuagguauuucauaaaaucauugacucuagggcaggaaaaaacccuacacacauaaacccacagcauucuuuuuccugccuccacaguuguaaaggcccgaugauaaaaccuguuuccuaagacuuccccagaaugugauucaacacauuuucuauuuuuuuaaaaaaaaauuucugccacuuaauuucaugugauaauuuuccccaaugacuaaccaaauaugcuucacuauuauauaaaucaauucuuucuuaaugccacaagugaaagugcaaagguagcuaaugguuuucuucucauaaaaaucacacuuuggcuuuuuccuuucauauguaauuaaucauauuugugacaaucuuccaaacuuacuugaaauuuuucugaaucccuuucaaaucaggacaagaacuagaaaugucuauacagguuuaauaugaaguaaagaaaauguuuuucauuuucuugauuuauuucugaauucagcuugcucuucauuagcgcuacauagcugncuuauuauucgugguccccuaugacccccugaucauuuucccugagggugcauauuuauucacuaacuauguuacaaucaugugaucugcuggauuuuuucugauagucuacucuagauuuguucuaaauuaauaaaucccauuauuuuuggcuucuacuacuucuauuuauuaaauucauucugaauaugaaguuuauuuucaaaggaauucauaauucuuuacuccnngcuugguucuaacaaugaauuuaauaagaauuguauuuaaucaauguuuaaauauauuaagggcaaauuuuguaaaaauguuaguguuccaagcuuuccauuuccccacaaauuaauuuuuuuagccuuuccccuuaauccacuuucuuaaaaaauaaaauuuuuuuugugaugcagaauuaugugaacaauaagaaaaaaauaauuagaaagguaggaguaaacuaaaaacaaacaaacaaacaaaaaaaaaaaccaaaaaacuaaggcugcagacuuaauagaacuaccauagcuacuuaaggguaaaugauuaagagagagacaacgucuggcuucugagcagagcacagagagaaagaucaccaggaagaaaaaagauaacagggaauuuuaaggacaguugccauguguaaugcauaaaauaguuuucaaaauucuuggagagguaaaaauaaaauuuagauuuauuuuuuaauuauuucacuugcgaugcuaucuuaagauugaaccacauggggccccagaauuuauuuagguuauacaaauauccuccaauucugaugcugauuauuucauaugcagacuucaguuaccuuuacaugucauaaacacacauaccccagaaauaaacuugaucaucccauaaauuuucaagagcucucagccugcuguaaaugaaauuucaccauuaacucacaggucgaugucugggacaaccucaaagacugcuugaguaauuaauaaauuuauaugaaaacauuggagugaaaaugucugucagugucaaauacauaagagguaauggcugauacauaguaaugcaguuuuaaaccauuggcaacauaucuaaacaaagguaucagagaaaaauaaaagaaaaccuuguaacuuguaugauaagccucuugcauaagauuauuaagaaagucauaagcacuuacggcuuuauuccuuuucuauauagauagauugcccagaaaaacguggacugaaccucagcuggaaucugagggcucugcuugucuuuaacagcuuagcuacauuguuagagagcaacacuacauaauacagcaugcccuauucuuaaggcaauacauaaaauuuuaaaaccugaagcuaaauuaaaagguuaucacccuucugccuaauguauuauauauuuguaaaugauaucugucucuaaaaaagauguaccacaaagcaagagcauaugugaaacaauaagagagaauguaggaguuagaaacacauuuagguauguaggaaacacaaacuucaagacauucccaaggaucuaaauaaccuauacacaaauauagcaaagucauauccuaagggagaggauuugaguucuaaagccggagccuaagguaaauguugcauauagucaaacuuaccauugaagaucacuuuaaucaccuguagggugcaaguuacauugcuuuguguauucaagacugacagugaauauuugagaaaaucaguugaguuagaauaaagaaggaagcaaagaaaaguccaccuacagauauuaggguauucaaacaaccucuucuuuaagaaacuagcaaaucuccaccucugaguuuuuaucagguaggugaugaagugcaaagcuguaaacccuccaacagggcuuauuccacuguuuuaauauucacauuucauaacuuggacauaugcauuaauggauguauuugucauuguuaagauuaaguaacauaaucuuucuuuuuuuuuuucuuugagauggagucuugcucugucgcccagccuggagugcaguggcaugaucucagcucacugcaaccuccgccucccagguucaagcaauucuccugccucaggcucccgaguagcugggauuacagguaugcaccacaaagcccagcuaauuuuuguauuuuuaguagaaacaagguuucaccauauuggccaggcuggucuugaacuccugaccucaggugauccacccaccuuggccucccaaagugccaggauuaaaggcaugagccaaugagccuggcugauaaccuuauuucauaagcaaaagcaucauccacagggucugguccagagcagauacucaauagggugcuacauuuuaaucuaacucuuguuucaucagacccacaaacacauugcucuuuaaaauccuguagagaagaauaugacaaccugcaccuuuucuuuccaagauggcauuuccaguuaggguaccucugaacagcuguugcuugcacauuuuaggcauggugaagaucuacaccugaugcuggguuccuaagugggcauauggugaauccacugcacacagaagcacuucuuuaugcuuggaucacauugcagaagauuggaccccugacuggggcuaccuuucccaagccuuaacagcacaucaggcucaaaucacagggcuaucaaaugaggagauccccuuuuccaaaaaaagcaucccuaucaacucucccaggaaagcacaugaacucauguuauccauucauucuuaucuuggaaaauacacccacaagccccuuuuacugccacuuacaguaggaugccacaaaaauucagaaacuggaauccuuuuccgucccuucuccuuuccuuccucccuuucuucuuuucuucuuccuuaccuugaaauuucugccugugguaaaaccacaggaagaaggaaagucaaaugaauuuuccuauuagucgacauuucugugauacacucauuuuuuuugguccccguaugaacucccuccaggguauuucuuuaugggaauaaaguaugccaaaugaaauaaagaacuugaagcacaauuuuauccuugacauauguagagagaauauguuacuccugaauuuauggugcaaugcaacucagucacuuccuuuuccucuuuccccuaguuugcacuuccuacuuauugcugcauaccaucacaaauuuauggagugccaauggcuguggccucuaggcagcucccaaaugacugaauccagacaucauugucuucaguuccccuuuggcauuagucuauuuuccaucccucuuccuuuauugaaaucugcuuccaauuauuuuucauaagaugguuuagcuuucuuuuauuuccuuuaaguugaaacucuuuuauuucuaccuuucauuucuaugcccuccugggccuuaagcacaguucuucuacauuuacagggguuuucauuuagaaacuauugagaacuuuacuaucaaauuguacuuuuuaagauaauuuuuuugcaauuuuaacuaaaaggagauuuuuagacuuuuggaaagucauggcuccaggucucagaucucagcuguagguuuuaucacuuugcaagaugaugacuagaguuacagcacauucuuucaacccaugcccaaaacuucaaagauggccacccuucaaccccugaagauuucaacucaguguuuucagaaaauuggagguccaggcuuuggagucagacagauauggguucaaauccagccucuggcacuuaauuugaauacaaccuagaguaagucauuuaacuuuccugagcuuugauuuccuuaucugaaaaauaagaauauagauacuuaccucaccauauuguuauaaagaugaaaugagguaaucuuuguaaaauauacacaaugucuagcaggugguaagcauucaaacugguagcuauuuuuuauuguuaugaguuaaaauuuuguauauaauggauuuuuuuuccaagaaagcucaucaagcugaccuuaaguagauguuacucccaaauaccacccaauuccaugucuacauacuugagaaguuacuaaacacuuuaaaauugaaauugaaaacuagggacaaacauagauuugaaaccaaaggaauagguaaucaguuauaaauuuggauauaacauuaugagccucuauuucagaaaauacauuccuuuuaaaguauauuuacuauaguuauccaugcagacugaauauuuuuaucaauaguugcaaaaccauuuccugaaagggaaaaccauguaauuauaacuagauuuucacauguuaaccuuuuauauaagggaagaacaagaaguagauauuugcuaagagacugggaagaaagggaagagaagggagagagggagagacagagagaaugagaaugaaagcaaagaaauuugacaaggaauacuauuuggcuuuuggcccuuccguguaccaacguagaugugugauuauaccauuuaggauuguugucaauucuuuccauaggaacagacugaacaaugagacaucuaccucucaacccaaagagaauaaaauugucauuucccuacaggacuuuuguuaauacaaaaaugaaauauauauauauauauauauauaaaauuauuaugauuucaaaaauaaagccaaauaucuaaaugaaaccaugaaaauaauuagcuccgauccaacagaguaagugagguuuuuacuuuggaagauaaguaaauucuuucagagcaugagaaugaaaaauugauugauuccgaucugaucucuaaaaagagcagucugauuuacuuugguaucaaacagaccugcuucuaaaugccauuucugccauuuaccuguugggcaaauuucuuaccuaugcacuuggagucuucacccuuaaaauagguaugaaaauagguagaaaauaggcuugccaugcuuucucucucucucccuauaucccaugucucuccaaggagcaauuccuaauguaauugaucaaauucaagcauauggagucuuauuuacuaaguggcauggucacuauacaauaaacgugacuucccccacuucuacuucuucucuucuaaguugaaaaaacucuaaucucucaggucaggcuaacuauuuccuucccucuuuccugccuucuuucuaauuugaggcaauagcauccaugagcccaggcgaugucagggauucuuguuuuuaucucaacacuuucauucuuccccauccccucacaggcccccauucagaauucuuaagcaugcuauuugcuugagggggcauuuaggaagucccauuuaagaccucugccagcucuaaucuuaucucuucagagaggccuucgcugacuauccaaucuaaaguaccuaccuuuaucaguguucuacacuggaagguauugggcacaggugcaacuaauaauaaagugggugguacuuuguugccauuuccauguuagggccuuugugucugcacuucucucucucucucucucucucucucucucucucucucucucucaugcucugcaucuuuaaaucacuaaggucucagcucuaauguuaucucuucagagaggccuucccugacuauccagucuaaagcagacuccucauucccaccaacucacuccauuacauuaaucuuuuauuuuguuaauagcucucauugcaucccauuacuuucuucuuuauuugcuuguugcccaucccuaccuccuucccaaacacacuuauuaaaacaccaugaagacaaaaagguauugugcucaccacuuguuuauccagagccaggugccuguccaaaguagaugcacaccugccauguccuauggccaaccagguccaaugaauuccuuuauaaagcuccucuccucagcugacccagaacaccagcugcuauacugaaggcuuucacacuuucagaugaggugucuuuaucuuauaaauuucuuuucucuaagcagaauuuauauaaccuacucauuacuuugaauagcaucuuauucaguauaccuuauugguauuuuucaguaaacccugguauaaggcacacagcuaagugaauguccccacauaccuauaagagaguggcuagaugccuuucuuacccacagggaugguuucaaagaaaccuuuuacacucacucccauauacacacauacacaaaggaaagcucacauuugcauuccagaucaucuccaggaggagggaggagaaauacucuuuuaaaagagcaaaccuaaaauuauaaugcucuugaaaacauuaguaguuaacauuuacuguuaagaaagccacaaucccagaccaaagauagcugaguggcaucuuaaauugaagauaguuuuuaagucagagcuuagaaagucucuuggaaaucucuuuaauucccccacagaauaaaauaugguacagauucucaggagguccaauagaggcuuuccucuagcauuagaacagauccuucuuugaucaaggaucagaugaagucauuggugugaauuuacuaggcauauauuuuuucauauauaacagaaaaugucaacacuggaaucucacucagcacuaagaugcucacacuaagagguucaggaaaaugagaaugacucccagaacccaucucacauuuucuaagaggcauauauucauugaggggaacgucuaacagaaugaccuauauuauuuacaucaguacuuccuacucucacuuuuuuggccaauucugugugauuaaauuggcaaaaguucaaugcacacaaggugcaacucaauuauauuuaagaucacucauuuaugucauaaagucuuucucaaaaaacaaaagaugccagccccacagaacuuuaucaugucacauagaccccauuaaugcagucuaucaacaauauagacagauuauuauauucagggaaguucccucaagaauugccuuacaaguucaauuuaaaaaaucaaaauaaaacaagccaguacugagucuuucuaugguauaguuaaacuuguaauauuuuauacauauuuuuugaaaguagccuugauauaaauccugaaaaaagaaaaaaagcaaaguccacauuucuauaagugucacgaugauaaauuuuauguaucaacuugacugggccaugaggugcccagauauuuggucgaacuuuauuccgaguauggcugugagggugcuuuggacacacuuuuaauauuuaaaucaacagaugcaguaaagcaauugcccucccuaauguguguggacuucauccaaucagcugaaggcuugauuaggacaaaaaaaagcugacccucaugcaagaaagaggaaacuccucuuaccugauagucuucagcugggacacugauuguguccugccuuuggacucuaacugaaacacuggcucuuccugggucucaagccuguugaucauuggacagaaacuacaccauugggucuccugggucccuagcuugccaaugccagaucuggggacuugccagccuccauagucacaagagccaacuucucauaauaaaucucuuucuauacauauggauacacacauccuacugauucuguuucucuggagaacccugacuaauacaaauauuaaacccaaauaaaaacccaaaugcaaguauuaaacccaaacccaaauccaaagaugaacaacuuucuucaucagucuggcaccuaacugcaugucucuuuaugaaguauguaauauuuuuucaugagcugccauaugucauuccaucacucgcucuagaacucuuuuaggcacuuaaaacuuuguauauuauauuaaaauuuaauguaucaagaaaggauauagugagaauaaacugaaaagaguaguuacuaaugccaaauauaaggcagucuugaaaaaaagaaauauuccucuguaaucucaguacuuugggaggccaaagugggaaggcugcuugaaaccaggaguuugagacaagccuaagcagcauagugagacccuauccccuaaaaaucaagauuuuuucaaaaaaagaaauauuccauuuuuucaguaaaaauauuaaacaaauuucaaaaggcagaauggacagcuuauacauauaaacauauagggauaugaaacacauaguuaaauaucuaccuauacuuuuuauuucauuaauuuaauuggauacuuaaaaacauguacuuuacucaaauucuuaugugagcaucucaacacaugguuuauucaaauucugaugugagcaucuccaccauauaagagccuccuuuuuagcccuccaacugaguuuuccagaguuuuccacaaaacuccaacugaguuuucuucccuugguucaaaacaggacacuccuugaaucauguaugaugguguuucugaaaguugucucugaaggcacaaguaccuauuuauauaauauuagcagcuuuuucuucuaaauaaaaauauuucuuugaacagguauauauuuugaugucuaugauguauuugucucuuguauugcuuuuuaaauagacuuuucaaaaucgcuguuuggaacaacauccaacaguuggaauugugaagucauagccccuggaaucaugacuaacuguguucaauuucccugcuccucuuuuauggauccuagcagaugaccuucacgagcacccaaaacaaaccuugggugaagccacuucagcccacugugacuuccuaaagcaguauuugaaaggacccaaauauaaagcaaggucgucucuucugagggauaauaaauucagggggaagcaaaccucaccuuuguauuugaggauaucugguguauuuuagugcaauucugccuuuaagauaaagugccagcugacuuaauggcaguugugaucucugcuucauuucaucuuuuaucuaaugauccgcuaguuaguaaaccugcaaauccugaaagaaacauaaguacucuuuuucuuugcaguguaaucaccaacaauaaagcuuuauuuuuuugcauuaacauucaacugcaauguauuuaaauguuccacauacacaaaaacaccugauuuuucccaagauuuguuaaacauagucccuuugguguccuuaguaacacugcaaagaugucuucauguaaaacuuaauuugaguccugauuaccuuacugugaaaaaccguaaacaccaaacaaaaguaagcauaauauccaaaugccuaaaacauaauacccagguugaaggaaguguaaauguucagauucaccagugggacuagaauguaaacuucuuggguugugguuccuccaaaucaucuggccaccuggguaucauaucccacaagcauaugguaacacugauagaguaagcucaaaguguuccaacaccaggacauuucauggccacaucagaccaauuguauuuuucacuuccucucuuucccuaacuuuucucauacaaagcuuccuacauuuccuuuggcacuuaguaauacuuaaaugcaucuucacugucuuauucaguguuuuuagcuuuggaagguguaucacuugggauugcuuucagaugcauuaauugcaaucuagcuaaccaacagcccaacagugauuuaaacacagaaagcuuucuuuuccggauaugcaugugugcauauuuuguuuuguuuuucaugcaacaagaugucugaagguauaaucugacacugagcugguaucucauggugucaugaaugccccagccuacuucuauuuuuuuuuuuuuuuuccucugcuguccuucagugaggcuuucacuuucauugucauagacggcugcuggaucuccaaguuugacacauucucccuaggcaagaagagggggaaaggcaaaggggaaagaggaugccagccaagucagucucuuucuaaaagcuuuccagaaaguuccauccagugacuuccacauacaucugcccagccacaaaugggucauacagucuuuccuaacuguaagagagugugggaagcuggauaugagcugagcauugcugcuccaaacaaaaucagauuucuguuaggaaagaauggauguaaaguggaucuuaggaagggaacaaccaaugccuaccauacacaaguauuuguggugagcagacauggcuaagugccucuuccuaucuagggagguucagggaauuacucaagaucucuuuugugccagggaacuagggagucagucaucucauuugcuuucauuuccucaucucugaaauuuccuacuaugguauuccucuuagaacaccauuuagaaguguuaugguuuucuguucuuaauccaaaugugacaaaauguauucuccuucuucucugauaacaaaacccaaauucugacgggcagcaugugcuuagccuuagauaaugaauaaugacuggucuaacccaaucauggcgauacuauguucuuuugccauugauugguauucaguaguaggcaugugaccuagaucuaaccaaugaguggacauacacuggggggacucaugaaagauuuuucaccuuugguaaaaagucauaguugcaagaggagaaagccuuuucuucauaugccucuucuuuccuguuuuagaugcugucauguuaacgcuuugugcuuagagcuguagaagccgucuugugaccaugaggcaauagccaaaagaggaaagagccugaguaugaaagacacuggguccuuuaugauauuacugaguugccaaacuaacccugggauccucuaccuccuguuuucucauaguaauaaauaucccugugauuucagcacuaucacuuuaauuuucuguuacaggcagcugaaagcauucagaacucacauacuaucuuaacaucaucuuccauguguuaugggccaagaguauauucaagagugacuacaaaacuacauucauugucguaucccugugggacucccuuaaaguucuaguguucuguaguguacuuuccacagccuagaaggauauauguuucccucucuccagcccuaaggaacucuuaauuuaagacugacaagaugaaugaguuacaaugagggugaauccaauucaaaagacguaacaacaagcaagaaaagcaaagaaccuuguaaacacccauguuauggagugugagaguguaagcuuaaggaggcuuuuauuuuggggagaagaugcaucaccucuguuugaaugagagaaauuaaguuguaauuaugaugguguuucaguuaaauuauuugauguggaagacaaggagaccauucccaacauguuauuuagcaaagaauauggaggagaggcagaagacugugauggaaaacguucagaggccaucaaccaaaaugguaaugcauucgaggcagauaaaguugcuucuugcuagacagagguggggugagcccugacauacgucuucaaaauugcaaaaggcacagaucugggggggaaaggggguugauucaccaaaucucagaauagcagaauggcaauaacccuacuccaaggcuuccaguuuuccucaguuuaacuccuuuugcauacugcagccaaagagauuuuuuuuaaaaugaagaucacucagacuguguccucuuccucuuaaucuccccaaaggaagaaaaaaacaaugaucaauggcaaauggcaguugcaaugaagcaacaccaagaacgagcuucgugcucgggagagaacauugcauaucuuccugugguuuccagugcucuacacacuuggggaaacuccuuuaaguaaugaaccacagaaaugaccccuggaaauauaaucuucaaagugaucuuuuaaagauccaaauauuuccuguucccacucugcccagagaucuucaguggcucacuacugcuuccaugauaagauccuaaaaccuugucacaauccacaaggccuucauuguccaucccugccugccucacugucuuuaucucccaccacacucugccuucucuaugcucccaccugacaacuucuucagugcguggacccuauuguacucucucaggccucaaaaccauguaacauccuggacuuccucuucacuggucuaaugccuacucauacuuggcuucugagauuguacuucacuccacauggagauuauccacaaccaugccccacuccaaaaccagguuaccuucccaaugugauauacuugccauagcacucagcuuccuuuuuuauaauacucaucacacuugugauugauugacucucuucuccuuuacauuguaagauccauaaaggcaaggaucaugucugucucuuucugauguguaacaagccugaacauacauacaauaaauggccagguguaauuuaccauuguguggaugccaucuugggaggggggauucuaauaguucaagggcauguaugaaaaacagacucaugguaaaauaauaagaauagaaaaaaguuacucagagugguuuaauggcugggguauaccuuuuacuauuuuacuuagacaucaaaggaaaaucaguguccucccuaucauguuccaugauuuuguacaacugaguuuagagcacaagcuaagguaucagacagcauuugacagcccagcuucacuacuuaucagcugugugaggugauauaaucccucuaaucccuauaaaccuuaguuuccucaucuuuaaaauggggauaaugacaaaagcuuuucaauaaggguuugugaggauuaaauuagauaauacauggaaagcuuucaucccagugcuugccacagaguuagcaugcaauaaauguuauaaagaguucuuuauuguucugcccaucaacaucugagacagaauauaaacacaacugcuccugggccugguggcucaugccuguaaucccaacuuugggaugccaaagugggaggaucacuucaggccaggaguucaagaccagccugggcaacaaagcaagacuccaucucuacaaaaaaugaaaaaauagguggauauggugauguaugccuguaguucuaguuacuugggaggcugaggcaggaggaucaacugagcccaggaguucaaggcugcagugagccauaaucaugccucuacacuccagccugggcuuuuuaagauuccaucucuuaaaaggaaaaauaaaucaacuggaucacuagccuauaagagcuuaacaauuguuagguaguauuacuauggguguuauuguuuuguuauuuguggcaaaaaguacuagugcucaccugagcacaugacuuccuuaugaucagguagguccauguuugucuuggucacuacuccagcccagugccuagcacagugcuugacacaugguguguaugcaaugaacacuuaaugaguacuuaaagaucuaaccaguaugauagugcagauucucuuguaagcaaaugaauagagaaaggcaguauuccacagagaaggagacaggaaaaaagaacaggcuugauuuuacuaaaaagaaaaacacacuuuuaagcaguaaaauuagaaguucccauuucaauggcacaaaauagagaacucacugagaauugugugcuauaacauggucaaagcagaggccgauaaugaagggagcagcauucagaaccaucacauguauggucagcuuucagacccugaaaacucgauuaaaacauuccaggaaaccgcugcacuuucauucuaaaggaagauugugaacucuguucacauauuacaccccuucauauugcuuugucuaccaguguggccuuuuaugaagugagggcuucuuucuucuaccuugcuccaugacaaucaaacccaaaaugccuuccacccuuaaaaggaaguuuugguaagugccuuauuauaacuaucacauaugacacaaggcucaccacuaaucggagacagaugagaaugaauuacuuaaauaggacagaaauagccauucacuucaagaaggucccaguuucuugaaagucuguggcauugagaccauuuacaguuugcugucaagauuccuagcagugcucauuaccuuggcuagcaaucccucuggacuacagaaaacuuaucugaaauauauauaaucacaggcugcaaugccuaagugcaacaggaugauuuaaaaagcaccaugauaguguucccccaggacauucaucucucccugucuauucaucuuugauccagacaaaaacuuggaaugcaaucuguauauugauauucccuaaaaaggauuucaccagcucuuuaggaagaauuguuuuagcggcucuggaagucuagaacauucugcauuugugguauuuacagcuuuuguuucuauuucauaaaaauaaagccccacuaagagcaguauucaauuccuaucccaauaggaguaucgaauagugguuaagcacauguuuuuuggaacgaagcagaccuguguucaucucugggcuccucauagaccucuucauaaacuuaggcaagguauucaaccuuuuugagucucagcuauaucagguaaauuacuaugcgugcacagaagagcuuaauaaauguuagauguuaaugguauuaauauuguuuugcugcuguuuucaguuuuucuagcagagauuauuaguauucacccaugugcacagguagaccgcauuuccacccaugcacacagguagaccgcauuuccaagcuucaguggaguuacguggguccaaaugacugaguuccgaucaauggaauguggcagaagugauguacacccuuuccuggaugggccuacagaaauccucuagacucuacuccucacucuccuuuucccuucucaggcacccugaaggcuacuuguuaaagaauuuagagcuacaggauggaaagaaccuggauccuaccuaagaaccuccuaggagagccacccuucagaaacauuugcaguggauucugaauacgauuuuuuuuuuuuuuuuuuuuuuuuuuuuuuuuuuuuuuugccgagcacgguggcucaugccuguaaucccagcccuuugggaagcugagguggguggaucacuugaggucaggagcucaagaccagccuggccaacauggugaaacccugucucuacuaaaacuacaaaaauuagccaggugugguggcacgugccuguaaucccagcuacuggggagacugagguaggagaauugcuugaaccugggaggcggagguuccagugagccgagauugugccauugcacuccagccuggugaagaagugggacuacaucucaaaaaaacaaaaagauacauauauaugauauaucugauauaugauauauauaugauauaucugauauaugauauauaaaugauauaucugauauauauacauaugguauauaugauauacaucauauguauauaugguauacaugagauacaucauauguauauaugguauacaugagauacaucauauguauauaugguauacaugagauacaucauauguauacaugagauacaucauauguauacaugagauacaucauauguauacaugagauacaucauauguauacaugagauacaucauauguauacaugacauacaucauauguauacaugacauacaucauauguauauaugacauacaucauauguauauaugauacauauauaucauguauauaugauacauauguacauauauauguauauaugauacauauguaucauauauaucagguauauaugauacauauguaucauauauaucagguauauaugauacauauguaucauauaucagguauauaugauacauauguaucauauaucagguauauaugauacauauguacauauauaucagguauauaugauacauauguacauauaucagguauauauguacauauguacauauauaucagguauauauguacauauguacauauauaucagguauauauguacauauguucauauauaucagguauauaugauacauauguaucauauaucagguauauaugauacauauguacauauauaucagguauauaugauacauauguacauauaucagguauauaugaacauauguacauauauaucauguauauaugaacauauauacguauauaucauguauauaugauacauauauacguauauaucauguauauaugauacauauauacguauauaucauguauauaugauacauauauacguauauauccauauauaugauacauauauacguauaucauguauauaugacguacgucauauauaucauguguauauaugauguacgucauauauaucagauaucauauauacacauauauccuauauguguauauaugauauauguauauaugaucuauauacauauauaucauauguucuaugauauauaugauauauaucauauaugauauauaugauauauaugauauauaugauauaucauaucauauaugauacauaugauauaucauaucauauaucuuucuuuuuuuuuucaguuaagcuacuggguuuugacgaagcucauuacagcaguuagccuacuucaggguuucucagccugggcacuacugauauuuuggacuacagaauucuuuguuauggagggcuguccuaugcauuguaggguguugagcagcaucccuggccucuauccugcuagaugccaguaguaaccucuccaguagccaugacaaccaaaaaugucuccugacauugccaaaugucaccugcaaaaucgccuccgauugagaaccagcagcccacacuggccaaaacaucaccaucauugcuaucaucaucaucauaggauauugauagucuagucucucauguuccccuugaaaucacugcaaaaggacucaaaguuccaaaagagguccagcccaguuuuuuuaggagaaaaaagugaaaugacacuaaaauuuaagaaaagguaagggaucaagcaguaaacucaaaguuauaggagaccaaaaaacaaaguaagaaccaaaauaaauauaauccuuuuuuaaaaaagcuaguuuguguagucccagcuacuagggaggcugaggcaggagaauggcgugaacccgugagguggagcuugcagugagcugagaucgcgccacugcacugggcaacagaccaagacucggucucaaaaaaaaaaaaaaaaaggccgguuugaucacuuugguaaccuagaauaaaaugauuaaaacaaaaacaaacccaaauaucugggucuaggaauuucaaugugucuaacaaaugcuuauagaauaucuaccaugagauaagcauugggcugaauauaacuugguaaauaaaacagauauaaucccugcccucauagagaugaaagguaaauaaaaauauggaguuuuuuguuuuuguuuuuguuuuuguuuuuuaagacagugucuuguucuauugcccaggcuggagugcggcagugagaucauaguucacugcagccuugaacuccugggcucaagugaucauccguacuagcuaggacuauagguuugcaccaccaugcccagcuaauuuuuguauuuuuuuuauagagacgcggucucacuuuguugcccaggcuggucucaaacuccuggccucaaggaauucucuugccuaggccucccaaagugcuugggauuacagucaugggccauugcacccagccaaaauaugauggauuuuucaaacagcuuaaacacagucaugaauugaccacugcaauaggcagacuucuaaagaugucccugcaggauucccaucccugggccgggcaugguggcucacgccuguaauaccagcacuuugggaggcugaggcaggugggucacuugaggucagaaguugaagaccagccuggccaauauggugaaacccccugucucuacuaaaaauacaaaacuuagccaggcaugguggugagugccuguaaucccagcuacuugggaggcuaaggcagcagaauugcuugaacccgggaggcagagguugcagugagccaagacugcaccauugcacuccagcuugggcgacagagugaaacucccucucaaaaaaaaaaaaaaaaagauuccugucccugguuauccaauuaaacacuagauuaggugcugccaugaagagacuuagcagauguaucaagguuacuagucaaccgacuuuaacauaggaagguuaucuugaauuaucuggguaugccuacccuagucacaugagguuguaaaaacauaaguggaagguggaagaaucagucagagugagaaagcagaagaggaugcaggagcuaugcugcagagggaaagucagauuccaaacacaagaaagaaaaagauaagaugaaucauugaugguucuaaaauguaggaggcucugugugaggaccagaaagaggccugagggagcuaaggguggagcccugccuaacagacauaaagaaaauagggacuucaguccuacaaccacaaagaaccaaauucugucaauaaccugaacgaguuuggaaguugguuuuucugcagucuccaguaagaaacacagcgcugcugauaccucgauuuuagcccagugagacauguauugggcuucugacugccagauaauaaauguguguuguuuuaagucacuaaauucaucauaguuuguuaugacaguaauagaagacuaauaaaccauuaugcauuaaauaucacagaaaagaaaggguuuaagaaaauagguauuaaaguaugccuuaucaccuuaucauucaucaaucugagguuuacuaaacacuugaugggugcucauuaguggaauaaauuaaugcacucauauuuucauucauuuguuaaaaauaugcauacagugccuccucuuugauggucccugggugagguauugagguuacaguagugaaauagguauuauccucuguuuauaacagcucauaauggaaguggaggacagaaacauguacauucaacaauaaugcaaagaacauaauaaagauauuaacaucaucauuauaaaacuaucaguaaaagugugaauaagggaguacagaauaauaauuacagcugacaucuauugaguacuugucucauuucccuucacaacaagccuaugagacuguauuaguccauuuucauacugcuaugaagaaauacccgagaugggauaauuuauaaagaaaaagaaguuuaauggacucacaguuccacauggcugagaagaccucauaaucauggcagaaggugaaggaggagcaaagguacaucucauaugguggcaggcaagagagcaugugaagaagaauugcccuuuauaaaaccaucagaucucaugagacuuaaucacgagaacagcaugggaaaaaccugcccccaugauucaauuaccuccuacccacugggucccucccaugacauguggggauuaugguagguacaauucaagaugagauuuggguggggacacagccaaaccauagcagagacagacccaugauucauaccaucuugcagauuaagaagcugagguacaggcaggugaagaaaccagccuaaaguuacuaucgguaagugguggagcuggaauuuuaacacaggagguccaacuuuagagcccaugguuuuaaacacuucauugugcugucucucauugcagaagggugaggaggccucacagaagggcugagauuugggaugaauaccuucaucaagaaaaggaggagccaguagaagaaacugcauugguaaagccagagauucaggaagaagguggaugguguggcauauucuggaacagggcucuguauuggcaaggagggguggcagaugagguuggagccuaaguuguccugacuugaaagacuugaaccucucagcaguuugaauuucguucuaaagcuaucaaaagaaccuauucaagagcaugauacgguaaaucaucuucagcaacucacauaucauuuuuaacauuguuucaggggauauuaguggacacucuuaggaacgcaguguauagcccacaaguauaaugacacuuauuaauacaacuuagaaaacacccuuugaaaaugcaucaaaacccuaaaagauucgauuaacucuauggaaaugaggauaaaggguagaugcauguaagaauccagcugucuucuaucuacaaagcucuucauauccacaaccacagagacacugcucagcuucugaaucgccuuaguucacaauaaaauagaaauaaaucauaauaaaauaaaauagggaauaaaucuaucuguuggcuuugagaaaauuucucaguagcaacaaaccaacugcucaaaucagaaucccccaaaauaaauaaauaagguaccuaagagggaaugcauguguugaccaaaaaacuaaaaaauucucccauuucugucugacguugaaaaaaaucauagguauuuggcauuuuagccuaugcuguugaaugugguagccacuaauuauauguggcuauuuaaauuuaaauaagguaaaauuaaauaaaauuuauuuucucagucccauuagccccauuucaaguccucaacagccauaugaggccacuggccacuguacuggucagcacauguaucagacauguccauuguugcaggaauaucuguugggaaaaaaaugaacuacuuauuuagauaaaaguagugauuuguuagacaugccuaauaaaauucaguuuauuuuaagauuauguaauuaaauucagacuuacuuauaagagucugaauuuucauuuuaaucguuuguauguauuucauuccucuuaguaugaagagagucuauaucaagagacucucuauggagacaggagccaguuuguauuaggccccagcucugucuugggcucugugcuaggcauuucauaucuguuaugcuacuuaaggcucaugacucccugugagauaggcaugcuuauucucauuuuucccuaaauggggggcugugacaaggcugaagcaaagagagggcacaacaucuuuucaggguuaacacuugagaaacaucuauuucuucuuaaguagcucuacugcugcuuagagaaguagaguauguagacaagacaguuaaauuuuccacagaugggguuuacuuagagggagauaagauuucuuuugcacacaauuguagauuuuuuuuuaaauggucaaaauccuccuguucuagcaguagcuaagaagugacucggggaagcauucaacaaguaggaaagaagucugcucagauggaggcccugaaucagagaugccugucaucuguucccaaaggcuccaaacuccugccacaaauacacugaggguuccucucucuauaacuucuucucuuuauuuucucuggaaggaauguacuugauacuuauuuuuaaucugagucuccuuccacaaaaaguguagaggaugugcuacccagccccuaaaguuuugccucuugguauucacacuugugaagucauuuuccauguggaagagggcugaccuguguaagcaauaagaugcugcagaaauguaugacuucuguggcuagguuagaagagccaugaguccuuaaagcuuucccccuuuucucucucuugaguggcugucucuggaggaagccagucaccauucuaugaaguuacucaagcagccaguggagaggcccacauggggaggaacugaggccucccaccaauacucuccaucaagcugccaggcaugugguaccuuagaaguggaucuuacagccccagucaagccuucagaugacuauagagccagaaccacucuacuaagccugucccaaauuccuaacucaccaaaauaacaugagauaguaaauguuuacugcaguuuuaagcaguugaguuuuggcauaauuuguuaugcagcaauagguaccuaacccagaggguuuuuccagcuuugccuaugggcaagucuacagaugaaacaagcugcuuuucauauuuagugcucucucucacaauuaucaggagauauaauuaucuuaccauccaggcugugauucuugcacacaagcaccaagucauccauuauugcagucucccuucccaugcuugaugaauaacuggguuccugugauuuuuccucuuuucuuuccccauugacuguugaaauuguuugccucaacuauugagucccuucucuucaguuugccuccuuuucuuuuccuccuacaugagcagaagccaggaaauugaauguauucgaucacaaaguaugcaugacccucagcaacaugagccuacaauagucuuuuuaaugaccagaggaagguugugaggacucuuaguuaauuuguuaugaacacccacucccauaaggaagcugcuauguauuuguggaauaaauuaaauaaaaucagcaaauuugcuuauuaucuauuuccugcccuuugaacacagguuuacccauaaacuacauuuguuacacacuaacugaauauggaaagcacuauggguaaugcaaaaaauauagcuugucuguuuucaguguacucauaagcaaauauaggagacaucacaaagaugcaaauauguauucauauucacauacaugcuuaaguagacauuuacauaucaaagacagugaaggcuaagggccaaaugaaugguacacacaaguguuaacagaucuucaaaagaagauguuauggcugugagcugaauugaucagggcagccuuuaugcaggaacaaagucuucagaagguuuaacuauggcagauacuauuacagauacuacuuguuucauccaguucuccuuuagccccaagcauagagacuccugcacaucucagccucuuaugagugggcaggaucaugugacuagcucuacuuaguggggcacgagaaaaaguaacauguuucauuucuuaagucaaagaaaaaacuauguuuaauucuccaaucuuucucccccaaaaguucacaugcucugggguaacuagaggauguuaguggcucccucagccugggucuaucugaaugacuacaauaagcagagcccccugacaacuuuuuuugggcauguaccauuagcaagaacuaaaccuuucuuugugauaggccacugugaucuggggacucauuuguuacugcagcauaacuuagucucuccuaacuaaaacagagauucccaaagauggagaaaagcagagcacaguagagguagcuuauaagucaugucuuauaugaccuuucucaaugacaaaccugugugcucaccaagacauagcuuguuaugacauaucugaauagaauugaagguuuuuaaauaaaaacauaagaagguuggaaaggcagcagaaugagcuacugccugugggugaucuuuacacaucucagaauaacaggauuauugaugccuuggccagaagcauuccuuucccucuguuuucuuuuucuuugagauugcaagccauauauuuccauuuggaaaacaguauuucauaaccucuaaaccuaacaugaguccugugaaacccuagucuacaguugaauggccaaaaauaaagacuugaaauuccuucaaagcuaucccauuuuacaaggcaaugcuuucucucucuaccaagaaaguguuccugcuugauagauuccccucucuugcuguauauuacacuuacugcucuccugucacucccuauucucuuccuaguuguuugugccuuauuaaauuccacauuuugaaacaaccaauaagaaucagaaagccugaagaagcccuuucucauacaaucagagcucccuuuuuaucuaggaauaaauuauauuuuccaaucaauucaugagugggauucauugacaauauacucucuuuguaacauauuucugaaugaguaguaaauggucuucaauaaggauauggcgauacauuuuagcuaaacuguuucauaccgacauuaacuccccuguuaacuuacuuaggagucuaaagacacaaucaaauagcuguuucugacuauuauucucaaagcgaagcuccaggccguaaucucaggacaugcaugaaaauaucaaguaacaacucaaaggcccauuucagcuucaaauaccuuugaaaauucgugaguuugaggagcagagugggauagcaggcgaguggaagaggaggcuucugagaaacuuaauuaucuacauuuuagaauguuucagucuuuggccuuuuaauacuguaguauagccuggcuucugucauucugaagggauuucccagcuuaacaaaaucccaaggaaccaaccucagauuggucucuuaccuaaggaaagauucuggcaacacaacaggaaggauuuggaaaauuuaaugaagauuuugaaauaccccuaacacacuuaaauuaaagauaauaccuauuucacccaaaucuccuaacccccuguggaagaucaauucuaauuuuugaggacaauuauucauguguuauuggcuugaaguacagaauguauuaguaagucucuucaguucuaaguaacagaaaccaaaucaggcuagguuaaaauugaaggggcaucauuagaaggacccaagagugucucaaggacucagaggcaaagaugcagccaguuccccccagugccgggaaccagaaggugggcaggaacucagggaauacagcccccuucuaucucugcuucucaauucucauagggaaauaugguuguccacagaucucagguuuaccugucauaguucuagccacaugcaaggaaugacugcauaucucugaauuccaaauuucagaaagugagaccuuggggugggagauggggcacgcuuggauucggugucuaacucuaauucaaacaacuuuugccacggagccauguaguagccaaauauguuucuaaggcccaagggaccacucuuacaaagauggaagauaguucacuaaaaagaagacaugcuuucuagacuccacagccaccccagaagugccaagauaaauaauagggagccagaguuuaagcaagggccaccaucacugcaaguugucucauccaacuucucccuuuauaggaauugacaugacuucaaauauucaugucugacaccaacgaagaggaaugucuguucuugagcucuuuuucucgguucccaaggggcccucaguacccugcuuuaccauuuaguguggauucugacaaaagaacaaauuaaguacuuugauuugauucuuaauuuuuccuuauaaagacuugcaauaaauauuguggguaccuagaaauaauccaccauagugcacaacacaaucuguugacuuaccuuagcuuccauuuuccuucuuggucugacauauaaauucaccuugcugcucaauucugucaccuacuauuuucagcauguaugagcaacaguaaagugcaugcccacagaacucagaaaugagaaaacuaauauugcucuguuauaugcauaauggaucaauacagagguauuuaaacacacaaagaaaaaaaaaaacaggucagcaagacuugacuuucaacugauagagaauauuaacauguuuauggguagaaaaaguggucaguuguagaaaaauauacaaagaaaagcuacaaagagauguuggcaguggccauuuaagcucugucuagggaaaggaagccuuuaguuaauggccuucaaguauucuaauguagggacacggcaccccuacuguggaaagagaugcaggagguggaagguagcuaaggccuuggaguuucaguuccacaggcaaggcuauccuuaucaugagaacugagcagcaugaagcuaucuguagucugacagucauauuguauguugugucaaaugaaaacauagcaucacucaauuccuuuuguucucuucucuugcuaaacacacaacuaucugaugcucuggcuucccauggaccucaggccugcuuagaggauggaaugcaauagucccacuagucugugcagugggccaacugcugguuguaaaaucacaaaggggccuucuagguuaccgcgucucacaaacuuggguaauguaauuccgucuugaagagagagucccccauggguaagaccauggaccaugguaaaugaguguaccccaggagaacugcuugggaaauagucacuuagccuauucuccuggugaugccccagacauugucaacauggaccccuuggagcauuuccucguugaugucuacauuuguuaccuuacucuuaauuaaauuuucuaaaaagauggcacaauaggagcacugagaacaugauuuuuaggaagaaaaggaaucccauguaaacccguuuccaucugugguucuugccuuucuguccuuauccauagggcagcucauucuugcauaucugcagcucuugcaugccugccauuuuguaucuuccuuuuucucguuauaucagaagcauuauaauaaguuacauuagaacccguuuugcauauuuuaacauugccuucacagugaaacuauagagagcuuuaugguggcacucuagugaauauucuguucugcuucuguuacaugacuaccuuaggaaaagucuccgagaacuccugucucccaugauuaucucuccuaaucaggcuuucuacuaucaaacuacucagcaaaaggaacucaccaaccuauagugcuaccagaagucuaauaacauaacacugucaccacaacuuuuucagcacuaaacaugaucauuuuuaaaaauaguaaguuuauuagguauauaaugauacuuuccaaguuccagccuguuuauaaaggacucuguauaaauaaggaaggggcccaggaauggugacauauuuaacguguaagucaggaugcuaaaugucugacuguauuuguuuauuuuuuucugaaauggagucuugcucugucacuuaagcuagagugcaauggcacaaucauggcucaauguagccuugaccucccaugcucaagugauccucccaccucagccuccugaguagcuagaacuauaggcacacaccaccauacccagauuuuuuauuuuuugaauguauuuauuuauuuauuuauuuauuuuuuguagagacgaggucuugcuuuguugcccagguuggucuugaacuucuggacucaaaugauccuccugccucagucucccaaaggauugaaauuacaagugugagccacugugcccagcuccuauuauauuuuuaaaaggaauauacugaggaaaauacaaauggaguucaacugauaaaaagaaaccucuguaauaugagcaggugaauacaauuuacaagaucauacuucaguaugaauucaguaggaauugcauguuuugccugcugugugucccuaagggugacacacuccugaaugggacuuuaguuugccauaagccugcuuuguuuuguuugugguagaaauuccaugcuaugaggaaaugcuuucauuucuuuugauaucucaugagcgcuuguugcaaaaaacauuuguaggcaaacagcuucacacauauuaaaaacuuguagcagaaaguuaauucccuaacauaaguuguccagcucagggcucuauaauccuguaauucauuuugguuccaauaaauacguacuuucugugagacccuuuggggaaaggguaauuagauauuucacaucagugggauaucuuuccuucuuuugcucccccuccuucuuuccuucuccuuuucuucucuuuaauucuucuacccagaaaaauucucaaggagcaaaaauacauuacucucugcauuuuuauaagcuggccaguuuugcuuccuggcuuuugaacagaaaauuaugccucaaaaauaaucccacauuauucucuaaauucauuuuccucagucauuagcccauaacggcaauuuuccuuuugaaaauaaagaauaaugaucauuuauugagacaaauccucaaucagaaugauucaaagagaauacaaauuuaaugaucacccugagaacccaaguaauacaucucaggaaauaauaauaaaauuuaugauggccuuaaaauugcuuaacuccuuucaggaaacccugaauuauaggguaguaacauaaccaaggacuggcaacaacucacaaaagucuagaagaguuuugccuuugaguucauagacaaagaugcuuaaauuguuccccguucaaaaaauaaagauuauuuauuauuuacuuuccugugcaccggacacuccugcaacaugacuauaacucuugcguucuuagauuugaucuucaaggucucugaaugaugaaaaaacuuguaggguagcaugccaaccaacuuggguuuuuugucuguuuuuguuuuuggaggaggggaacaaggcagggagagagggagagggagagagagagagagagagagagugagagaucacacuaccaggagcuucauaaagaaaccugcaaugcagaaccaaaguggaugaaagcaaaaggauacaacuuuucccuccagaugauuuuacugggaggaagaaagauuugaaacuauugagugcuuuuucugauaaccaccuauggcucucuccaaagacacacauguaaaguugggcaaguuguuuucugucaugucaggaaaauauuuaguagcagucuuacaaaaguaagcacucagcgccgucccagggagcuguggauuugcugugcagccuuguuuccuucaacagguuccuuuguugcuuuguguguucucccgacaaagggccugcccuucuucuacagauggguuuaccauucucucugaaugaagacuauucagaaguacacaaaccaacaaaccauccaagcugccucuaucugaugguccugguauauccagaguacuaaauaguggccuacaggaugggaaauucacacugacugacuccacaggagacugagaaagcuuaacuggcugauagcuguaaaguccuuugaaggaacaagcacuguuuaaaauucuaaguaguaaucuuauaauuugcuaauggaaagaaauauaacccagcuaaugugugccucccauuucagagaguauguuucaacagcaaagcccuuuacaauauuuagauaaacuucgauguauagaaagugcaacagcaagguaaacagcagggcuucccgcuauggcauuuuaaaauguggugggugaaauuugucacuccuaagcaagugccuauaguaaaaauaaaauaucacuauuuauaugguauguguuaaaaauuguccacucuccccaacuacaccagaucaaaaccucuuguuuuuuaaauuaugaaauuauugaacuguauugagcacaccccuacuuaugaguuguguaaccuggggcaugauauugaaccccucugagucauuuccucaucuaucuagacaaggcuaaugguaauaccuacauuguagggcugucguuagaauuuuaaaauaauuuaauaaaauaaaggcuaguauuuauuaaacucuaaauacauguuugcugcuaucagcagcagcagcaucggucggcaaucacgccaacacuccucaaagaaaacaguucugaaaaggcugugugcauccuaggucugaagauuuucuuggucuaaagagucucuugggcuagugaccaaauccuucauuaauuucaagagcucugggaacucucugaaacugaauguggaaugguauaacuacuggucugugcacauuuuucuagaaaaccucacaucuuucaucacauuaagagguuaagaaucauugccauauguagucauuagcuuaccuuuaucuacuuucuacuucuaacggagaacuagaguccuguuuagaacaaguaaccaggacagggacagaagaaggagacuaugcaucugucacucuugcugauuagucuccacccucucccagcuucugcgggccuccucucccaagaguugcgauccuagacccaccucccaucugcagucucaaccuauccucuucuaaggacuaaucauggcauauggcaggagagauuuaagacuagcuaggucaaugcucuaagcucaacaucaagucaccucugaggcaggguguugucauggaaugaucaugaccucugaaauaggaaggucuguguuugauuuggcuugaccacuuacuggacgugugaccuuggaaacguuuacuuaaucaugucuuuugucaccuauaaaauaaauacaauaagauuuacauugugagucuaugagagagaaaugagauaauauagagaauauuuuuaaaaugggagcauaugucaggcaacaguagaugcucagcaauguucuuuucuuaccugggcuucaaccuggcacccuuggucaccuucccaggacccaaaucccucuaggaauaaacucuggcccuugcuggcuucuuuauucuuccucccaccuacauacuugaacccauccaaagaaauaggucugacuaccuuggaaaccuuuucugaugcuuacuacuuguccaacauucauuuuucuguaccauguguguagauacuggauuccccauccuagaauucuacccaccucuugggcuacccuguuacaaugugugacugacuauccuacucccacuuuccaaguuaaccacuuaauugaauggcugcccaucaacauacuccuuaaaugccaaguuaguucugucaaacccaauccacagacaagccuuauccucaaaccuuuucugcccucugccacagugcuaacugguucauugugcuuguucagcaugcagggaccuuuaauuuaaugggccucucccauuuuucacauaucaugaaaguuaucaaauuuagguuaauuaaguuuaagacauccauaguuauucgagugaaaacuugaaggcagcauaauggauaauaaugguaaaaugauaauuuuugagcucuuaguagaugccaggcauaguccuaagcaguuuaaauauauuuuuuucauaugauuuucauaacaauccuacauaguagauuaugaucauuaucucuacuuuauaggugaggaaacugagacuuagagaaguuaagcaaauggccaaaaguuaugcagguaguaaguagcagacauagaauugagaagacagcccccauucuaaauaaguaugaaaaauuucagggugucaauuuuuagcuaaggaaaacuuauucauguguguguguguguguguguguguguguguguguguguguaaaugaauagauauucauuuacuuauauaucuauuucccaggccucaaugcaaucagagaucucugaagaagugaccauauuaugaacauaaauuuuugacuucauaacuuuacagugauaaauaaccucagguuaucaggauccuaaccuuaaaccaccugagauuuuaucacuguuccuuuaguaagcaagggauuuuucaacccugagacagauaaaaaauagauuguauggucaaugaaauccauuauauucauacuuuuugguugaguuuagguaauggaacaaucugagaauuuuguaucaaguauuugugauguuuaagaggauuuaucauauuuaagaaucugacagauugccccugcaauuagaaguacaauugauuacugacuucuaauuuuagguuaaaaaguuuaacagaauuugauguuuuuaaguaguacugagauguuuaaauaacugaauuuauucuuuaugagucuaguauauuugauucaaaacauggcuucaaagcuuagaaagguuuugcuuguuaagguugugagcuuguacugccaaguauucgaaguguuuacaaagaaaguaaaauuguuaaauguguaaaguuauuuuaaaauauugaugaauacauuuaacaaguaaauacaaaaguguauuuaaguagacauuauucuuuuauggcauucauaaauucauaaauugcacaagauaaccugaguugcucuaaaugcuuuucaaacuuaaguuuaggggagcaacaucagcaagauggcucacuagaaacuccagcacucaucccuuccacagugacagccaaaacaaugaauaaacaacuacacuuuaauguacauaacugaaggagagugcuagaauacaucaaaggaguaacagaaacccuggugagcacagaaacucaggacagccacaaagagaauggaaggaaacaucacaacuccaccacccuauccccagcugagaugagccagaaacccagaggaaacuuucccuauaggaaaaaggcaagcaagaggauuccaguagccuccaccaacaccuuggacacccacaguccucacuacuggaguccuuguagucuucacuggcacuaaguccagcugagggagcugccuacaggccacacagccacacucaccucagagaaggaacuaauacugugcucuauucccuguagcccacauggcaacugugcuauaucaucuuagaacuggaacuacugcugaagugugauuuucucugagggugagcaggcuugacaccccugccuccauaaggcuaagcugccuccaaaccaccccaaaccaguggccacagccaagcugccagcagcuguuaaugccuuuccccauggagccaaacagugaaaacugcucuaccugcccucccucaccuucaccugcccucucccuucaccugcccucuugugcuagagaugaagcaauacauucccuccuggggaaacagugcuuuggcagaacagcuccaucugcuucucuccgcugcaacuguacacugcuucuaggggucugagccaaaauggcacaguaucucccaaggaaauagugcuuugguaggacccuguaucccagguaaauggugccugggccacacagaacagucaugccugaguuaaagugucacauugccccuuggggaaucauugccuuggucaaguuaaacaacugugcaucccagggcugagcugauguaguaucuugugucccaaggaaacagaguagaacaugaccuaagacagucuacccuacuggacaaucuaguacccugcuuuccugaagcuggacuagcccacuagagucugaacugcuaagaccugcuguuuccuggggaguggacucaucacugugcuacucccugcccuccaggacccaaacaauacccaugcucagucauucuaggguacuugcugccacugcgccuggccacauggagucugggauacagauaugccccaccauuccaaggucuaaauuuaccacuacauaguucuucauucucagggaccuaagcugccacugaacccuauuggcuuaggcuccuaaauuauagcuguaccaugcaugcugugcucaaaccccuaaaacucugcuucuuucccagagcugagccagggcuguauccuauuccccagggguagaaucacagcuacaaccugacccacugaaucaaagcugguaggggcugccuaacagucauagauucuggcucugugggaaaccuauauuugacccagcuacagagagugaaccuguaccccaggacccaagagccacaauaggcuugugaaacucugauauuagcacccugacuccauagccacuucaaguaccaaucccuggaacucaaagcaauggaacugcuuguaggccauguaagagggauccucuuguuuaauuauccccauugugaggaaaaucagaauaggaggaccccaaaagcccugccacugaggacauuaacaaccuauguugucacugccacuaccauaccccuuuuuuuuuaauuauacuuuaaguuuuaggguacaugugcacaaugugcagguuuauuacauauguauacaugugccauguuacugugcggcacccauuaacucgucauuuacauuagguauaucuccuaaugcuaucccucccccugcccccaccccacaacaggccccggugugugauguuccccuuccuguguccauguguucucauuguucaauucccaccuaugagugagaacacgcgguguuugguuuuuuguccuugcaauaauuugcugagaaugaugguuuccagcuucauccaugccccuacaaaggacaugaacucauccuuuuuuauggcugcauaguauuccaugguguauaugugucacauuuucuuaauccagucuaucauuguuggauauauggguugguuccaagucuuugauauugugaauagugccgcaauaaacauacaugugcaugugucuuuauagcagcaugauuuauaauccuuugaguauauacccaguaaugggauggcugggucaaaugguauuucuaacucuagaucccugaggaauugccacacugacuuccacaaugguugaacuaguuuacauucccaccaacaguguaaaaguguuccuauuucuccacauccucuccagcaccuguuguuuccugacuuuuuaaugaucgccauucuaacugguguaagaugguaucucauugugguuuugauuugcauuucucugauggccagugaugaugagcaccaccauacacuuuuacagccuaagucauucaggcauccacaguuacuguugacacugaaugcagcugaagaaacugcauagauacuauaccacugaaccuaccuggaaacaaagucaccacacuuuuccuaauuagcacacuaagauccaacuacaggugaaagucuuucucugcaaaagccacucuagaaagucuggaagaggcaauuuuuccaccaaaugcauagacauugauguagaaacacaagaaauaugaaaaagcaaagaaauaugucaaugccaaaggaacaaaauaacucccuaguaacaaacccuaaugacaagaaaaucaaugaauugccagaaaaggaauacaaacuaguacucuuaagaaacucaacaagauacaagaaaauacagauagacaauucaacaaaaucagaaaaagaauuuauuauauaaauuagaaauucaacagagauagauauuauaaaaaauaauucaauuaauaaaauaaaaaauacaauaggcagcuucaagaacagacuuaaguauagaaaacaaucucugaaccuaaaaauagguuauuuaaaauuacuuagcuagagagaaaaaaaaauaagaaagaaaaagaguuuuuaaaaaagacuacaagacuuauaggacaccauuaagugaacaaauuuucauauuauggcaguuccagaaggaaaagauguauuaaaaaaaaaaccuaauuuaauuaucuaauagcugaaaauuucacaagucuggauagagauguguauauacagauccaggaaacucaaagguucccgaauagauucaagcccugaugcacauuauaguucaauugucaaagucaaagacaaagcaagaauucuaaaaacaacaagagaaaugugucacaguacauuuaagggaauccccauuagacuaacagaagacuuucagcagaaccuuauagaccaggaaagaacagaaagcuacauucaaaguacugaaggaaaaaaacugucagucaaggauacuauauccagcaaauauauccuuuagaaaugaggaagaaauaaaacguuucucagagaaguaaaaacagggaauucaucaccacuagaacaguuuuacaagaaauucuaaagggacuccugcaucuggaagcaaaaaaugauuaucacuacuaagaaaacacacaaaaguauaaaacucacugguagaggcugagcaugguggcuuacgccuauaaucccagaauuuugggaguccaaggugggcagaucaccugagguugggaguucaagaccagccugacuaacauggagaaauccugucucuacucaacacacaaaauuagcugggugugguggcacaugccuguaaucccagcuacuugggaggcugaggcaggagaaucacuuguacccaggagguggagguugcagugagcugagaucgugccauugcauuccagccugggcaacaagagugaaacucaucucaaaaacaaacaacaacaacaacaacaacaacaaacucacuaguagagcagauacacagaaaaaaagagaaaagaagcaaaacuuaucacuacagaaaaucacuaaaccacaaugauaaauaauaagagaagaaagaacaaaggauaugcaaaauaaccagaaaauaguuaacaaaacgacagaagcaagucaugacuuaucaauaauaaccuugaauguuaacagaauaaauuccccacuuaaagacauagacugacuuaauugauuuaaaacaaaagaaaacaaaaacaugauccaacuauaugcuuucuauaagaaauucacuucacuacuaaggauacauacagauuaagagcaaaggaauagaaaaagauacuccaugcaaauaaaaauaaaaagcgagcaggaguagcuuuacuuguaucagauaaaacagacuuuaagugaaaaaacuguaaaaagagacaaagaggaucaucauauaaugauaaaggaaucaauucagcaagaagcuacaacaguuauauaugcauccaacacuggaacacauugauauauaaauuaaauaguauucaauccaaagggagagauagaccccaaugccauaauaguuggggaccccacucucaucacuggauaggccaucuagaaagaaaaucaacaacgaaacauugaguuuauacugcauuuuagcucaaauggaccuagcagacauuuacagaacauuucaacugacaguggcagaauacauauuauuuucaucagcacauggaacauccucaaggacagaucacaaaggccacaaaauaagucucgacaaauuuaaaagaagugaaaucauaucaaguaucuuuucugaacacaauggaauaaaacuagaaaucaauaacaagagggacuuuuggaagcucuaugaauacaacaugcuccuguauaaccaaagacucaauacagaaauuaagaagaaaauuuaaaaauuuaugaaaauggaagcacaacauaucaaaacuuaugagauacagcaaaaacagugcuaagagaaaaguuuauaacaauaaacacaucaaaagaguagaaagacuuuaaauaaauaaucuaacagugcaagaacaaaaaugaaaacaagaacaaaccaaacccaaaauuaguacaaggaaagaaauaacaaagaucagaggagaaauaaaugaaauugagacuaaaacuuacaaaagaucaauuuuuaaaacuuuuuuugaaaagauaacaaaauuaacaaaccacgagcuaaacuaaccaagaaaaaugucccaaauaaauaaaauuagaaacaaaaagagagaccuuacaacugauaacccacauauacaaaagaucauuagagacuaguacaaacaacuguacacccacaaauuggaaaaccaaacagaaacaaauuccuagacaaccuaacaagauugaaccuagaagaaauagaaaaccuaaacacaccaauuacaagcaacaaguugaaucaauaauuuuaaaaauguucuaucaaagaaaagcccaggaccugauagcuucacuacugaauucuaccaaacauuuaaagaagaacuaaugcccauccuucucaaacucuucuagaaaauaaaagagaagggaauucuuucaagcugauucuacaagaccauuauuacccugauaccaagccagauaaggacacaacaaaaaaaggccaaaaucccugaugaacaucgaugcaaacauccucaacaaaauacuagcaaguugaauccagcaucacauuaaaaagaacauucaccaugaucaagugggauuuaucccagcgaugcaaggacgguucaacauaugcuaaucaauaaaugugauacuucacauuaacaaaaugaaagacaaacaccauaugaucaucucaauagaugcagaaaaagaaaagaaaauucaacaucccuuccugauaaaaacccugaacaaacuaaguauagaauaagugcaccucaacauagugaaggccauauaugacaaauccauaccuaacauuauacugaacagggaauagcuaaaagcuuuucuucuaagaacuagaacaagaccaugaugcccacucccaccacuguuauucaacauaacauuggaaguccuagccagagcaauuaggcaagagaaagaaauaaagggcauucaaaauggaaaggaagaagucaaauugucccuguuuacagaugacauaaucuuaaauacagaaacccauauaagcuguaccaaaacauucuuagaaugagacaacaaaaucaguaaaguugcaggauacaaauuaacauacaaaaaucaguaccauuucuauacaccaacaaugaacuagugaaaaaauaaagcaagaaagcaaccuuacuuacaauagcuacagaaagaaaauauaaaauaccuaggaauaaaucuaaccaaggaagcaaaagaucucuacaauuaaaugacaggacacugauaaaagaaauugaagaucugguuacaaaaaaaggaaaauaucccauauucaugaauuggaagaacuuauauuguuaaaaugacaaugcuaccaaaaacaauuuacagauuugauguaaaccuuuucaaaauaccaauaucauucuucacaggauuagaaaaaauccuaaaauuuauguggaaccacugaagaccccaaauagccaaagcaauccccagcaaaaagaacaaagcuggagguagcacauuaucugacuuuaaaauauacaagaaagugauaauaacuaaaucaucauguuacuggaguaaaaacaaacacauagaccaguggaacagaacagauaaaucagaaguaaauccuuuaauuauagcaaacugauuuuugacaaaaugccaaaaacauugagugugcaaaggacagucuauucauaaaugaugcugggaaaacuggauauccauaugcagaaaaaaugaaacuagaccucugucucucacauauacaagaaucaaaucaaaauggacuaaauaauuaaauguaaggccucgaacuauaaaacuaagaggaaaacauuggggaaaaugcuucugggcauuggucugggcaaagauuuuuuggauaagaccucaaauauaaaggcaacaaagguuaaaauagacaaaugggauuauaucaagcuaaaaagcaucuguacagcaaaggagacaaucaacagaaugaagagacagcccacagaaugggagaaaauauuugcaaacuauccauuugacaagggauuaauaaccaaaauauauaaggaacucaaacaacucaauagcagaaaugcuaauaauucaguuuuaaacugggcaaaagaccugaauagacauuucuuaaaaggagacauacaaauggacaagaggcauaugaaaaaaugcucagcauccguaauccucagggaaaugcaaaucacaaccacagugagauaccaucucaccacaguuauaauggcuacuaugaaaaagacaaacaauaacagaugcuggagaggauacaguaaaagaggaaugcuaguguacugauagugggaauauaaauuaguacagccauuauggaaaacgguauggagguucuucaaaaaaacuaaaaauaucuacaaugugacccagcaauccugcugcuggguauauaucugaaagaaaggaaaucaggauauugaagagauaucugcauacccauguuuacugcagcacuauucauaauagccaagauauggaaucaaccuaaguguccaucagcuauggaugaaaagauaaagaaaaugugguauauacacacaaugaaauacuauuccgcuuauuuuauacaauuaagccuaaaauauauuuuaaaaaauaauaaaauccuauuugcagcaacauggaacuggaggucauuauuuuuaugugaaauaagcccaacacagacaaauauuggcugggcuaaguggcucauaucuggaaucccagcaauuugggaggcugagggaggauuauuugagcccaggaguuugagaccagccuggguaauauggcaagauucuaucucuauaaaaaaauuaacuggcuguccuagcuacuuggaagaccaaagugggaagaucgcuugagcccagaaaauugaggcugcagagggccgugucugugccauuuuaacuuuacuccagccuaggugacagacugagacccuuucucaaaaaaaaaaaaaagaagaagaagaaaaauaauaagaaugacagacaaauauuacauucucucacuccuauguggaagcuuaaaaguguggaucucauggagguagaaaguugaugggugcuacuagagccuggaaaggguggcaagaggggugaagagagguugguuaauagauauaaaaagacagcuagauagaaggaauaaguucuaguguuugauagcacagcagggugauuauaguuaacaauaauuuguuacauauuucaaaauagcugcaagagagaauuugaaauguuccuaacacaaagaaaugauaaauguucaaggugcuggauauccuaauuaccuugauuugaucauugcacguuguaugcauguacuaaaguaucacaugagccuauaaauauguauaauuauuauguaucaauaauaaaaaacauuaaguuuaaaauauaucuuuaauaaauuaaacuuuuguuaaaagcccaaauuauaguaaauaaacccuucugcauacaaaaagugaucuauuagccacugaaaaucuuauaagagaguuuuuaugacagacuuaugagcaauaauaaguauuuuaaaauauaaaucagaucaugucaugccuuggccuaaaacucuucauuguuuaacaguuacucuuaugagaaauuccagucucccagccaaggucuaugaaacucuucaaaauugacucuuguccacuucuaccuccucaccaauuaucaaccucacuaccccagucacuuuggccuuuuuuccucuuucugauacaucaugagcuuauuauggcaacaagucuuuuauauuuguuaacuucucuaccuggaguacuuuucccaaaauauuuugcaaggugggcucuugcuugacauuuaacucucagcucaaauaucaccuccuccagaugccuccucuaauuguccuuuacaccaauaaccucugacacauucauauguuuuacagucuuaggaauauccucaaugccugacuuaccauauucauuuauuggcucccauauuuauuucccccucucccaaauaaaauaaaagcucaaugagagcaauaucuugucuuuccuaaaccauugcuuggcacauauuaaaugcucaauaaauaucuguugcacaaaugaauaaacuuaaauaaauaaaacacaucuuugccuuaauaccaaguuauuuuuaaaucauauccuuauguaauaucgaauccauaagacucaauuaucugggguuuauuugacaaauuugauuaucuuauuuggggguuaauaccaugaauggcuaaaaauaggccaauugccaagcagagcacacaagcaaauaugaucccuccccaggaugcuugccauccaaauuacaagcauugaaaaaucuuggcaaggcgccuaugcuaauaagaaagugauccaauauucaugagaagaacuugaaaaacuauuauuuuugccugcaaucuucuuggcuuuuccauaauuaauaugucauuaucaucagaaggcuaagagaucaagagugguaaaagcaaccuuucauguaauacucauagggacaaugguauuuagcaaauaucacauugacuucugguaagagaaauaauccagaaucugugguugcuagaaaccuaguauauggaaaaaauagaggggcaguuggcaucaagacagaaagguaggguuuuaaagcugaucuagagguagaaaaaaacacauucuagagauuccugaagaaacaaauuccaaguacucauugucaugaaaaacgguaugauggaguccuacccucugucuguauuguucuuuuuuaaauagaucuuccugguuaggucaggaagaagcuauucuugaaugccaguuaauacauuccuccauuuacucaacauucuaucccuacaccaaauuagcucaguagaaaggcuaucuagacuaucuacuaccuaggucauaauacauuagcaaccuguacaaaugucuuuucagaguuucaguuuauagcaugccgugguuuguuauccagggugaaucuaggaaacaauuagaucuauaaucucacagcaaacuucauuugacuauauuugcaaauguuaucaacuauguuauuuuuuuaccaucauauauauaacgauugauauaaaaaguuuuucuuacaguuaggaaaaauuugucucuccugacaaagugguauucuuccuuuugcaacuaauggcaguuauguaacuugcuucucuuagauggccuuggccaucuaagaagcucagagcagaacuaacuuguuuaggucgucuagaaugacuucuuccgaucccuauuuuucucugcuuaaacuuguuguucaguucuguuaggacuuuuguuuuguuuuguuuuuuacauauaugccuuuucucauuaguugguuaaaauacgcuuuuaaaguguauaagauaaaaauaguagagccagacacggugccuuacgccuguaaucccagcacuuugggaggccaaggugggcagaucaucugaggucaggaguucgagaccagccuggccaagauggugaaaccccaucucuacuaaaaaauacaaaaauuagccaggcgugguggcacacgccuguaaucccggcuacucaagaggcugaggcaggagagucgcuugaacccaggaggcagagguugcagugagccgagacugugccacugcacuccagccugggcaacaagagugaaacuccgucccaaaacaaaaaacaaaaaaaaagaguaaauaauuuugaaauuuuaagcucccuuuuaccaaaaaaggguucugacuucuggccagaauguaguaaaugucaagaaaucagucacagcugagguagugccaggaauuuggugugggggacaggaggagacaagcaaagacuauuuaaaaacaaugaauuuuagccugucuauaaguacucuuuucuaugaaaacauaaaaggaaauuucccuuacaaauguugauugauaaacaugaacgucuauauggaaaauaaugcgauaucugagcuaaaaggacucuuagugaacucugauccaaucuccuugauuugaggauagggaaaaguguaaucccuaaaagauuaaaugauauuuccaaagaaacaacaaguugguaauuaaguccggccugaaaucuggggcuucugcuucccagguuaugagcuuucuaacacuccaagaacugugaacccuggagggaagguuguaaucugacuuuaacuccugaggacauguggauaugcccuucaggguccagggacauuuggguugcacauuaacaguuaaaauaugcuaaagcaccgcauuuucuccaacuccauucaaugccuaagguuuauuguuuguucaguuuuagccaacuauauuuccugaguguuucaaaaggcagcaagguggcgaggauacaagggaaagccgcuacacauucaacauaggaauacaaagauuauaguagaauucuacgcaucaaauuccaauucaaauuucuucuggggucagugucaguaucucccacuuccuccugacacauccugagcugaagaucccuuuuaaauuuucuuucuaagaaaaaaaaaaauauagguuuauugaucuccuuuaaaugauagcuuuagaauaacaugucaaauuauuucuguuucuugacuuauucuaggaaaaaagacaaagaaauaagauauucauauaaaugaaaaguuucacagccggcaaccaacuaauugguauauauuuaaacacauuuaagauauuacuugauuacauucaauaggcauaauguccauauaagaacaaugguuuuguuuggaacauauaaaagugauaguucuguaacauguauuuauuuaacuuuuuauuuugagauaauuauagauucacuugcagugguaagaaauaauauagacagaucuuuuguauccaucacccaguuucucccaaugguaaaucaagauauugacauugauacaauccaccucagauuucaccauguuagauauaaguucuaaauuucucaucaaagaauaaauaugccaguauguucaauucuuugccuucuacuuuuaaacuuaacuuccucguaaaguaaccuuuuucgauuaccuacuccaccccgacucauuccaauuccuacuccaccccaacucauuccgaucaccuacuccacccugacucauucugauuaccugcuaccugcucugcccugacucauucuccacgcugcauaaccauuuuuuuucccuccaaagcacucacccccucacucucuuuaaauuagccaauuggaauuaguuucgccugcguggucuaauccuagccaacaggggaacgacacggcagcaggggccaugugccucagggauaagaacaccuuccccucccuuguccaagugugcgcucaccauuguuccaucuguaagggcguacccuucuguagaaguaacuugccuugcugagaauuaaaagaaaauuuuauauucgaugccguuucuuuugcggcaccgaaacuuuauauauaacaaccacuuugacauucauuuauauaaagaucaauuuuuaauagcuacaaucuauagagcacuucuauaugccagaccaacugcucacugaugaacaaacauucuucuaguucauuccuacaaaaaacaauuuaccaguggaggcaauagugaggacuguagcuuagaagcuuucaugcuacaauguaguauaugcuacaguguaguacccuauagcuguaugggugguucauuuuaaaaauuguauaugcagccauuccucaauaggcucaaaauaaauauugacagaaauagguaaguaaaucaaaagagaaaaucaaagccaggaaucaaaagaagaggcaaauuggguuaauaugauucaauuuacgucugggcuucuugguagacaggacaaaaagguaaacagaaugagauaugcaauccuuuuugucaaaaggggaaacucauauugauccuuuaagauauagauguuuaaaaauaugucuaugucugugcacauacccuuaugcuagcuccagcucaguuuuuuaaaauaaucuuuucagucagaguuuaugaacauccaaauaaaacugugucaacacaugcuuaauacaucaguaaaacuauuuuuaauaauguacucuccuauugaauauggguugguuuucugacuugcuauggcccauugagugcacagaugucacaguguucuacuuccagguaguccuuaacaaggcuggcagcuucuacuuugaaacuuuccaaaaaauuagcuuccaugauguaaaaaaaaaaaaaaaaaaaaaaaaaaaggccaauccagaauacuacaugauaaacacuugugaagagacugaggucaugugcacagcaccaaugcacagauacgagugaauccguugaucuuccagggcagcauagccgaaagcugaaugcagccuagugauugacccagccuacaccaaauggagcggaacaacuacccagccaagccacgccccaauuccugaccuacagaaccuugaaaaauaaugaaucacuguugguuuaagcaacagaaguuuugagguagucuauuacacagcaaucaauaacugaaacaauaacccaaacugauaaccugaaaauucauuuuguaaaccugcaucuaaacuugguacaauaauuaaacauuuucugugcaaguagucccucuuauaugacuagaauguguggaaugccuaggagcagcuuuuccaaaugaauucaucaauaaacauaaaacauaaaaugaacugcucuaguuuucccagagauucugccuagaacagacugcccuaggacagaugauuaaguuaguuuggguccaauucaugacuacauaacauggaguuaguuaugucuuaggcuacgucccuucaggcaacuuggagccucccaggguuaaagaagcucugccaaaacucaaaaucaauagggccauuuaaaugaugacauccccaguggguaaagauauuugacuccacacaucaauggcaugagcuacugucaugggcauucgucaauagguugaagaucucauuaaagcuuuuuaauuucugcuuagugguauuaggauuuaauugaugccaaagacacugccugucacuauacagugauguuguggcagucaguagagaaugucuuacacacaguccuagaagaccuuccuagaaaggccagggcaguucuacuggcugcauuuccuggcuugacaggcuacugcuacuuuauaguagcucucucuauguuguucuaccuucccaucauccgugcacccaucuucuuuuaccagcaacccaauuuucugaaaaacuacuccaucuuuauucuuaguccauguugcucagaaggguuugauucuacccacagcuucaggcaugggcacaccacccagaucagguugaucacccuggacauauaacucaagacagugucaaugagaucaaaacuuugaacucucaccaauacuauuggaaaugagaaacucuauuguuucccacuggguugcuaaacugguagaauggaauggguauauauaacugacagccuuuuugccauuccagggagauaaacccuaagaacaaacaaugcauagaucacuugaucuucuggauccagcaguucuagaagucauacgugucuauauuuuuucaguauauaagccaauaaaauaucauuuucaucuaggcuguuuugaguuguauuugcuaucucuugcaaucauucucagaaacugccaaaagaugggcugcugcacaacuaugggaugauggaaugccauuuauuuucugggacagugcaauuuauuacaauuuauuacacucccuuucugagccauagaucagaaaguacccgggcguuaagacaacagcacuucaaaaaacaauaucauacuugaucuucauaaaguuaagugagcaaacaaggaaacuaagacauuaaugagacaugugguucaaaagucauccaucaaaucaaauauggcaccaagacuggaaaccaagucuucaugaaaugcgagguuucuguugcuugaaucaauggaccuuaaaggugauuuggucuuauggcuccccaaugucaguccauggauugggaucuguugccagaguauguucaaaucaucaauaguccacagaguaaugagaaaaauaaagaaacuuugauagguuuuaauggagcaauuucauuucacuuuuaaagccugaaauuucauccuuccagguuuguuugguuuuuucuuuugguguuaacauauccucuuuuugaaauaauagcaauaguagauguaaaucaucuuuuuuggcuaaauauaaaguaagcaagcccauagccuccccuggaaggcacugccauuguuuccaauacucucagcuuuaacacugacagcuacccuugcucucuuucucacugacacccaccaacucaaccagcccucucccaccacacacccuuucucaggucaccucugugcucuccacccuuggagcuuuaccucuggguaauucccuugucuuuuguaauguauauuagaguguauauuagaguguaauguauauuagacgucuauaacuccugcuauuacucugcucagcaccuucuuaggacagaagcagcuauccuuucuccugagaaggugggaaaaaggcaaauuaugcauacuuauaaauaaauauuuguuggucucaaacaaguaaauuuauaaacauugauacuaacauuacuggaagcauaaaagcauuagaaagacauuaaaugcccuacaguagagugaaaauuaaauucugccaucuaggagaauaguauuuagucauuaaaguuaugauuauaaauacuuuguaauaauaugcguaaaugcauaugauauaagguuaagugaaaagauacauaacuacaaaauacaacuauguuaaaauauccaugcauggauuaaaaaaauacagcuuuaacugcauaguggaguuaccgguaaugucuacuuuuauauuuauagaaaucucuguuguccagauuuucugcaauggguacauaugacuuuugaugggguucagaacaugcuaccacaaaacauggcaccuuggcauuuugaauauuuuaagcugaaggagucugagaaacagcaugugcuggaaggacucucugaagcaggucagaagccccuugugugagaggucccucccuaaacccagagaaaaggagcauccuuaucucugaagauggagggacacacggagaagaaacuccaggaaccagccuugguaaguuuccccuaguuuacuacacuuaguucauaugcuuuuccacaaguuuccacucuucaucaaaccuaguauaaaagcacucagguuuaacugauucaucagauuuuccuuccuuaugaaugcucuagugacacauaaaacuuguauuaaauacauuuguaugcuuuucucuuauuaaucugucuuuuguuauagagcccuagccaagaaacuaaaaugguuaaagggaagauuuuuccuacacuuuaaaguguacaaauauauauuuauuaaaguuaguuccaauuauuauguagccaauauuuacugauuacucuacucuguagaugccaagaaagccauacucuuuccugauaguuuccuuugugugacaagauuugccacagauguaggcaauguugguauuauacuuuucuugacagcuagaauaacuucugcuaagcuaggcaaccacaucucuccaagccauccuuaaugccuaaugacugccacugcaccugaccuagcuccagggcugacccuuucauguuuaccccaaggccaugcccaucugggaaaccaccugggcagguaccuuccaaccaaauuaaagucaaggauuccauccacuaucacuaaacuagcacaaaccaagagagagaaaucaaggcaccacauagggguuaggacaaguaaucaaagucagguagaaaucccagaagggugguauacaauuuauauuucccuagugaggcccauucuagaauaaugggaaagguucacuguugucagaaugccaagaaugaauucucugaaucuggccuucccugaaaucaacacuuagguucugacaaccucuaaauucauccucacuaacuacaucaaacauuuagcaugcuuuuuauuguggggauggggguugcuuuuguuugauuugguuuaucuggcaucugaaacaaaagaugggaaaggaugacauucauucuuaaccucguguauaguuaaccacaucaaaaaaggcuauuguuagauacaaauaaacguuaacauacauuaguuccaaaaggcuaaagccuuucaggugaacauuauuggacacuuucuccccugugccagacaaaacuaugcauggcuuauucccagagucaccccguccuuuccaaggcauucuaugcugccucagggaugcaaacaauuaugguacuuccaggagagaaggagcacauaaauucugucaccccuugaccccaggauccaauuucacagcaaugggugaaaggauuuuuuagucaagagaugaugugagacgcacagauaccccuuggagucauuugggugacagcauuaaagagaaugaaaugagcuaucuugaaauggaggccaagugcagucacugcaucuggaaaguuaggcuccuugauauucaaagcucuggggcucggcaaaaaauucaaagagcuuuuaguauucaaaacaaaacaaaaaaaaacaaacaaaaaaacaaaaaacacucuuuaaaaaauuaaaauauucaaaacuguggaaaacuugcaagaaucauaucaugaacaucccauacugucuucccaagauucauccauuugcuauuauuuugccauauuugcuuuaucucuuccuccuccucugcuccccuucccucaaacaaacaaaugaaaagugguuuuugcuaaaccauuucgguguaggugugaacauuaaaagcuucuaggaauuacaguagucucucacacauacaaugaucaaaaucagggacuuuaacguugauagaauacuaucuuacacguaguccauauuuacuuuucuucaaucccgaguguccuguauggccacuuuccuccagucuaggaucgcacuggcuuuuagcugucaugucucuuuagccuccuugaagcuggaauacuuucucagccuuccuuugcccaucaugucauuaacauucuugaagaggacaggccuguggcuuuucagagaaucuaugcuggucugacuguuauaugaggauuagauucauaguacauguuuuugaaaggcauacuaccuaagugauagcauauccuucucauugcauuacaucaguuggcaccugaugaaacuuggucccauucuugauguguuaaccuugauuccuuaaauaagguguuuucugccagauuaccucacuguauguguguguaugugcagguauuccucuuuuucccuuuuauaauuaauaauguaugggaagacuuuuuucugacuguguaaacacccugcuaaucaacaagcuuucacucaaugguuuaacaccuauugacaauucuacucugaaucaauuauuacuauaauaguuguaaaaaagugauuuuucuaacucuauuauuucuuucacagcaauuaguugguuuucuagugcaagaaacagcugcccuuucucccuucuuuccuuccuuucccuccuuccuuccuuccuuucuuucuuucuuucuuucuuucuuucuuucuuucuuucuuucuuucuuucuuucuuucuuucuuucuucuuucuuuugguuauaucuuacucauuugauucuuaagugucccauuucaagcugguuccugugucauucagacagguccucauuuuuuuuuuaaucaguuuuuauuuucuggcacaacaaaauguuccaggcuuuucuuguccuuucccugcucugaaacugcaauuagucauugcucuaagcagggguccccauccccaaccuccaggcugcagacugguaccagucuguggccuguuaggaacuggcugcacacuaggaggugagcagcgggcaggggaaccuaacugccugaucuccgccuccugucaggucagcugcauuagauucucauggcaacauuaacccuauugugaacugcgcauacucauuaugagaaucuaacuaaugccugaugauuuuagauggaacaguuucauccugaaacuauccccgcuccccugccaccgauggaaaaauugucuucuaugaaaccggucccuggugccaaaaagguuggggaccacuguucuaagggcccuuauuuuuaguggggaaugcuauuuagaaagcaagagcugggcacucaguguguucacugcugcuaggaguguuauugcuugcaggcccuuuaagaggacaaguaagaauuauaaauauauauugagucaugucuuccuauugauacuucuaaucuccauccaauagcucaggcucuuccuugccuuuccccaauccacaguuguacugcccuccuuccacagugauaagccugacuccccacaaaauaauacauuuacuuaauccuacaauggauacaaaguaauuucagaauugucccacaaauaacacaaccaagaacaaauguauaaaguucaagauuucuuuccaguacuucuguuguuugauugaaggccaugcccaucugggaaaccaccugggcagguaccuuccaaccaaauugaagucaagguacugcauucaaaauaacuugaaucaguauuuuuuuccuauguguaaucaugucauccauuugauauauaguuagguucauuuacucuguacucaauuucccccaucuuguuauuuaauguuauuucggaauauacaaaccaugaacaugguuucaaacucaaaacuauauaaaaagguauucagagaaguacuacaucacugucuuccuucccuaacucuucuaaugcuauucccacccuguagaugaccaauuucauaucuucuaguuuauccuuccuguguauccuuuugcaaaaauaaucagacacauagauaaagacauuuuuauuuccccuucuuucuaccugaaaugcagcaugcuauauauagucuuccacauuuugcuuuuugcacuaccaauaucuucuggugaucacuccaaucccgauucacagggaucuuccucauccuauuuuacagcacacuacugcauuaauguauuauggcucauucaaacaaucuccucauuacaacauaaccacgaugaugcugcacauauuauuaugagagaaguugaacauauuuucauauacuuaaggacccuuuuuuaucaauuuuugugaacuuucuaggucuuugcugcuuuucuaucggauuuauggucucuuuagucuccucaacguguaguaacuuucuauauauuagcaauauuagcauuuuaucagaaauacaucuugcaacuauuuccuccugguuuauuacgugugguuuaugguuuuuugccaugccaaagaggauuuuguuuaauuucuaacuuuacacaaucagauuuuacuacaucugaaguuugaauugugaaaaaccuuuccuugugcuuuuccuuuuuguuauaaagcaauuucuuauacuggcuaauuuuuaaguaucccucauuacacuauacaugggaauguauguaagaagaaaauccuauuugccuacugaccgcugggcaacuucaaaacugcaugaccuuuauuucugcaggcccuucauuuccuagcugcaucccuuucauuuucccuaaccccagguuuccucagcaggccagcuucacuagagagcuguaaacuaaaccuaaauuacuaaagaacacauuacucacucaucauaaccauaggaaucuuucucuagagcaaauaagaauuaguaguacaaaucuguuuuauaaucacauacuuucacaaagcaagaaucaccaauaguauacuuuauugucucucauugauggguacauuuucucuuauuauuuuuauuaucaaauaauccauguuuauuuuaggauaaaauuaaaacuacagcuaggcaaaaacaaaucaagauguuggaacuguuaauauuuuagggcauauauguaaacacacaccuauuuaaaaacucucuucuuuuuauaccuauuaaaaaaacccucuguucucuacuauacuugcuauuuuguaaucuguuuccauuuucauuuaauauaaacaucuuuccauguuacuaaguugucugcaaaggcauuuuaaaaggcuacaugguauuauacuguauaaagacauaaaauauugaaccaaauauugugcucuuaggauuuaaaaaaaauaucguaaacaacucugagaaaauuuacucagacacacaccuucaugaauuuguucaaaugcuucuuuaagauaaauaccuaaauguggaauugcaggauuaaauaguacacaagauuuucaggguuuugauauacguggucaaguugccaccagcaguguaugguggguucccuuuacccacacugaacccacauuaguguuaucuuucucuguaauccuuuuuaucuccugauuuagcaagacuaaacaacaguguaaaguucugcaaaagcaccagauaagcaaauuuagaacaaaacauuacugaugucugcccaaaacucuguaaaccuguuccuaggcucuaagcugucuauugaaauguccuaagaaaccauuucacucagagaagaacauuuuuuucacucuuccugcacagcucagucuuuacgauguuaaaauccuguacaacuuccuaacagcccuucacauucuucaggagcccgaguuugguucugguuauaaaugcauaggauagaucccauacgggaagcauagaccuaagaaauuuauggaaaggaauuuaugggaaagcuucucucaucagggcuguaccaauuaaaaauccauaaauaauucucccuugucaguuucuguauaaacacauuggccuuagaaauuuuuacuucagguucuagucuaauggccuacacuucuaaauuaugcuuuuaauugaaaaacaauaacaugcauuuuuuuuccagaaccaucugugcuuucccaagaacauguaacuacuacagauaaauccgcuacuuugaacacccuaauuauccaguuuaggguuccaaaagcuuaggaaaauaaugccauuccugaaaaacaguacgugaucagaaacacuugcuuuaaaauucgauauuuggugugugaagcuucuuaacaaguguuuauuaaacugcauaauuucaaagccuggagugguauauugcaauguuuuccucggaguugaucacauuugcauaucuuuuuacacuuccugugaaauuaauauugccuuuuguaucucgaacuuagcuaauauaacuugccauuuuuacuuuucacugcuaugaguaauauaaagugaacccccaaagggaccccugcaacgccuacauaagcuuuauucucucacuguuguauuuuuucauaugaauauauuaaaucaagauuaauaaaccuuugcagaauccacugguccugcaaaaaggcaagauucauaacgguaaaggcugcucagcaaauaaaggaaaccugcuccuaaaacuggagccaaaggccgggguucauggagcucuugucacauccaacagugugccagagacucuucaccucacaagaagucuuucaacagucacucaauaauaugugcaaaaguggcuuaaccaccaggauaccaaaacccagccggugauuaucaggcugccuuggcucagggauacaucuuugugagaugccaaaaacugaccauaaucccaggauuuuaaaaauuucagcugggcuuauggggauggaaugugauaauaaagaaacaggaugguaggggcugaggaaaaguggaacaugaugagaggcuccuaaaagcaaaucaaacacagaaaagggaaaucucucugaacacugcauaccgcacugggcacaggaguccucaguugagcaucccccacucauugggccccagcagcuacuuugccuagcuaagaaucugcucaaagcucagggaaaccuaaauggcaauacaaagaaagaguugggggcagcuucaagauagcaggcuacugguacaaauacuuugugaggucagaaaggcucacuaucaugacuuguacugcugucauugauucuccuacuucaagaucaucuccaacuuggucaagaggcagaguaauggggauucagggccacaguuagggugcagcaaaugagguacaaaauuuaaguagaacuaaaaacaaccucaguagccaggugugguggccaugccugaaguccuagcuacaugggaggcugagauaggaggaucacuugagccuaggaguuugaggcuauagugcacuaugauuauaccugugaauagucacuguacuccagucugagcuacauagugagaugcccauuucaaaagaaaagaaaaaaaaaagaaaaauccucaguaaucaagauaauaauacuucagugcaaucuuuuuagaaaccaaaaaaaucauggugaagaaaacacaauuuuaaauaaauauuaaugcccugccaaccauauuugagccugcauggacacuucuaccuacauuuuuaauauauuuuaaaaauuaauuuuuuuggagaaccuuaaagucauugaagaaauacugaaaaauuggaaaguagguauauuaaaacuuacaauauuaaauguaaauauuuuauuuauacuaaaaucagaauucauuauaauuucacuuuccugacucuaaugggacaaaguaauuuuauuuuuauguuuugagauagagucucucucugucgcccaggcuggagugcagucgugcgaucucagcucaccacaaccuccaccuccuggguucaagugauucccuugccucagccuuccaaguagcugggacuacaggugcaugccaccacgcucggcuaauauuuguauuuuuaguagagacgaaguuucacuguguuggccaggcuaggggacaaaguaauuuaaacauguuuucaaaacuuacuucuuuguuugucuucuuuucaauggaagaauuaccauguuugacauucucuuaucaccuagugacaaucauaaaugauuuuuaauuaaacaauuuacuuucuuuaaauuaauuuuauuuuguuuuuccuuagcuuuaggcuccaaaauggcuuggcacuguacuaauccuuauuuaaaacuucaauguuuuguucaucauggauuuuucuggcauuuauuugauuuuugaaaaaaauggaauuaaacuauuugucuugaucacuaaguauguugacauucucuuaaacugugcauuaccuuguuccauccaaaucaaagucaaggauguagccaucucagacaaauaacauaacaaugacuuuaaguguggaaagaagccuaagaucuuuuauuaagugaaagaaguauguggcagaauaauauguauaguaugggcucacuugcacuuaagaaaggccagaaaaacauuuuaaagaauaacucuaagucauuacacaucaaauaaacauugacggcaaaagguaaaaaguguaguuacugaagcaagaguuucuaaaucauggugcugcaaaauaauacacuggguguccaaguagcaguaacaacuaaguauuacccucugcuaacaucugauaucuuugaaagauugucucuacaauaaugucauucucauucacuuguagcuagguacuuuuuuuuucuagagaaagagaugggauuucagcauguguacuaggaugacaagcaaacacuguagguucaaggaaguucaugggcaucucaacaauaugugugguggugaaaaauacacugagaaccacucaucuagcugcuacugauccuauuccauaagcuaggaauacgucauaaguacuguuuuguccucgcguuggggauuuuuguuuuguuuuguuuuuuuguaccuccucaguauccuccucuguuaaguaauagcauuuuuguuugcuuuuuagccagguuuauggagguauaauuuaaaaauaguaaaauuuacacuuuuaguauauauuuauaugaauucugacaaaugcauauaguuauauaacaaacaccacaaucaagauacagaacauuucuaucaucccaaaaaguucccauguacuuugccauagucaaucuuuacccuaauucuccagccucuggcaacugcugauuuguuuucccuauaauuuugccuguucaaaaacaucauauaaaugcaaucauaaaccauuuaugucugacuucuuaguguaaagcauuugagauucauccauuugaugcauaucucaguaauuuaugccuuuuuauugcugaauggcauccuauuuuauggauauaccacaguuuauuuauccaugguaauaggauuuggauuaugauuucacaaaucacccauacuuccuuucaggucaugugguuuauaaagggcugacccgaaaguuccagagaugcccauagccaggccugaucaaauaacauauucagucauccugauaauauggaugguuuagagcugggcacaugguuugauguaacaauuuucgauucaagacaacugacagaacuauugguaagaaguuacugaugguauaauggaaacuguuucugguagcuauugcaccaccacaagggagccccaacuugaggauaauaaagccaacaggaagcaaagugcaacuaaguggaugagauaccuuccuaaccuaguuugagcaccuggauccagacaugccuaaagaucuaccuguagaccugucaguuacaugaaccuauaaaauuccuucuagccuaggccaauuuugauuauaucccucauuccugaaacuaaaaucucuugacucuacagcauagaaagaaaucuuucaucaaggagguuacaagagagucuuggaaacaagacacaaaaaaugguuuugacaucagacaccccaacuuuaccacuuacuacuuccuaaguauacaaugucaagaauucucuuuacuccuauaaaccuguauuuccucauuuccaaaaugcagagaauaauuccuuacccauucuaaaauauuaucuugagaaucaaaaaaacuaaguugguucaaauacaaaagaaaaauaaaauguaugauuauuauacacacaaaauaauuuguauaugaaaaggagauauuaagugaugacggugagagagaaucaagaggcauuauaaggaucaaugcagaacuccagugcuuauauaaggaucaaugaacaauaauuguaacuagagguauuucuugaguauauucuuguguuaggcauugugucagguauuuuaccuacauuauaucauuuaacauucuaaauaucacuaaaguaacuuuuuaaacccauuuuugauuaggcuuagagaacauaaaauacuuuuuaaguuaaaguacuaacuggcagaggccaaauaaagaccuaaaucuggaccacugaaacuagugcacacuucuaaguuagauggaaggcaugaagcaaacacuuuggaaauuaaaauucaguuauaaaaaccaucacaacacaauuaauuuagcaacuacauuccuuuauacauaauugugccgagugcaucuaacucauuaagauguagaauguuuaugcugucauauaauauuaucacaugguaauaaaugaaguugcacuauaucucuaaacaucuggauuucagagccaauuuuacacauuuaauucagcuauuuggugucuuaaacacauagcaaaaauacacaaggaaaaaaugauuguacaucuggcaucaagauggcuccaagaauuggacugccaaugaggaagucagguuuuucuagccuauauccucuggaggauaaauacccaaaauaguacuguuuccaaaguaaccaaaaucaagaaaggagacuccacaaaggaaacaagaaugaaaaagacaggccuagcccuuuucaaaagcugagccuucccucccaggauccaagguacuuaggguuucucauaccugacaaccuauaaacgagaaagaguaucacuuguuuguccuuccauuucucauuuuccagcuuuggugcuuaucagguucuccagagguagcaaauuuguaagacauuucaucuauuuagauuuucauuuauucauccauccuuucaguuacucagugaugacuucuaucugcugagcccugcacuaaugauccaaaauucccaaucuuccugccuaggagagauagggagagguagggaauauggcuucuccauuuucuccuuuuccuuuaguaaccaaccucuacuggaauuaauccuuugaguucagcugggccuugagauccaacaugauuuguuuuaaaaaucaaggcaacuauuaauguaaaaacaaaacaauacaaguauuaggagaaaacaugagagaauuucuguacaacuagauguggggaaagccuuucuaacuauaacucaaauccaaaugcaaaaaaaaaaagaaaaaaaaaagauugagaauuucaauuaccugaaauuuuuuaaaauuugcauagcaaaaaauaccauaagcaaaaauaaaaaauuaagugcaugauaggagaaaauauuuauaaaauauaucacagauuaagcuccaaucacccuaauauauauuuuaaaauucuuggccaggcgcaguggcucacgccuguacuuccuagcacuuugggaggcugagguggguggaucacaaggucaggaguucaagaccagccuggccaagauggugaaaccccaucucuacuaaaaauacaaaaaucagccaggcacgguggcaggcgccuguaaucccagcuacucaggaggcugaggcagagaauugcuugaacccgggaggcggagguugcagugagcugagaucacaccacugcacuccagccugagcaacagaacgagacuuggucuaaaaaaaaaaaaaaaaaaauucuuaaaacccauuuuuagaauaagaaaaauagaaaaacaaguaguucacagaugauauaggaauugcccuuaaacauaugaaaauaugcuuaauuuuacuuauaauaagagaaaagcaaauuaaaacuacacuaagaauuauaaccauauuacucuaacauaagagguuaucaauaggagaaccugggugugguguacacaggaacccuuuacuaucuucacagcuuuucugcaaaccgaaaacucuucuuaacaaaaaaguugauccaaaaaaaguacauugagauacuauuucuugccuaugagauugucaaaaguugaaaaacuugacaauauacucuauuagcaaacagaguguagagcaacaguuccucucaggcauugcuaguuagagugcaaaaggguauaaccuguguaaagggaaauuuggcauuaguuaacaaacuaugugucuauuuccuuuucuaucuuucuacauaccuaucuauauauuuacuuaccagcaaugucaguuacagcauucacccugaacauacaccuucaacuguaugaaaaaacguggacauaaaauuauucacuguaguguuauuuccaguaaaaaauacuggaaagaaucuaaaugccauccauagauacaaucaauaguaguccuuugugugaacaaccaauauacacauagaacuacuauucaacuguaauaaggaaugaggaggaucuuuauaaaauuauaugaaauaauugccaggauaaaaaagcaaggugaaagaguauacauagcaugcuaacuucuguauaaaaaggaagcguauguauauuugcuucuuuuuauaaugaagacaugaaggauaaaccagaaacuaaugaaaauauuuucaaagagcgugaguaaaaauggagcuggaaggguagggauggagugggacuuucuugaacaauuuuuuuuucuaguuuugacuugaaccagguaaguuuugacuugaaccagguaaguuuugacuugaaccauguaaaguuuuacauauucgaaauaaaaaauuuaaaaaggauuuauaaagcaaaaccuaaacuugcauacaggcaggacauaaauggaucuaaugauauaucacaucaacguaaauaaucacagaggaaaaaaauaaauucaaauaauuucugaagacaguauucugaauguauauccuuaguggaauauuaggaaaaaaagaaguccaaauaaaucuugaacuuuacuuaauagauugauugucaggagggguauugauauaguaauucugaaacuauuuuccguguacuauaggauagagcaaaugaaucgauacauuaggaucucacuguggaauaaaggagauacaaauaugaaaugagggaaagugcggaagaauccugugauguugaauuugaaugguugaguuguacaugguaacauacaugcaucuaccuaucugucuacuuaucuaccuaucuaaucuaucuaaucuaccuaucgccuagcggcaauggcaccccaguagcaaugaacccaccuagcggccaaaacuuucuuucuaaauuccauucuccaguaaagggagacagggcuugacugauucuugauugggguagggaaaauguaagguaagguugauacaucuuuuuuuacuccaggacauacucaaagacugauggagauaugucaaaacgacauaggaacuagcaucaggggaucccacuggcuaaaugacagacaauuugagccucacaaaagaauaaggagcuaaguauaguuauaucauuuuguggaacuucauugagcugugugcuuauaauuuguguauuuuuuuguagguaugcuguauuucaauaugaaauguagugucuuuuuuuaagaaagcugugauacaagcagcaaauaagacauauaauuuacuuuagcagaaaggaagaccgugcucuaugaauaaauuguucugauuacacugauggucauccauccuacuauggaaacagagguggagaccucuuuugguaagaaacaacgucagcccagaaauguauaauaauacaaagagaaaaacaucauuaggcacaaaucaucgauggacaauagaacccaugagugaaagguucuugggacacaaaauaguuacccagucucaaaguaucaccccacagauacuaauuucaaggcaaaacaaaacacaaaacaaaaaaaaaccuuaaaaauggagugaccugaagaauauccaagaugaaacagcaucaccaaaacuggcacaaacaaauuauaugacucugcugugauccacugugaagcaggcaacauuaccuagauaguacuuuggccuacaaugaggaacaauuggacagauccacauugugugguauuccacaaucacugggucggaaucuucaaaaauacagacucaugaaagagaaauaaaaggcaggagaauauucuagauuaagaggguccaaagagacaaaauaacuaagugaaauguguaauccuugauuguauucuaaaaagaaaauggaaauaaggaaaaagagacauuacaagguaugagggacauuaauggaaacauuugaauauauuagauuacauaucaauguuaaauuucauguggagagugauaacaguauuaugauuacauauucaucuuaggagguauaaggugaaaugucaggggguaauaugauaucuaugacugaaaugcaaaugauuuuuuaaaguauaauaaaugagagaaaaaaagccaaugaacaauuacaacaaaauguuaauaacuggauccucaagggggaagaguaauugggauagacuguacaaaaauuaaucaaagauaacuagcauauuuugaaugcucacuguugucaggcccuauuuagagagguuugcaauacuaacucauuuaauccuugcaauaacucuaugugauugauaccacauauauccauuuuacagacaaaauggaaaccuauagaaguaaaauaacuugcccaggcuaguaaguggaguagcuggaauuugaaguuaauaaauuuagagucaaaguuuauuaucauauccacaauacuacucugcccuucaaauaaauaagucuguuuagaggagcaaacacauuaaucacaccaaucuuaugauuacaugcaacugauaucuccugugugccuaaugcagaauucuggaggguucaauugguuccaauuaguucuuuuuccuguaccagaaaagaagaucagcaauaacuggaauucugggguggcauggaguggggguguuaaauuuuacaaacacagcauccaaaaauaguauguucagucaugaguauuaucuuuaaaauagagaauauaaagaaagucugaagaucaacauuuaaaucaaagaaaaaagaacaaaaguacaggugcuuugagguuuagacuaugcugaaaaugccauuauagagcaguccauuuccucaguagguagccccaaaagaccccugacacaguagaaauuauaucauuauacaauuaaucaguuuucuuucacaauggcacaauggggugcccucuuuaacucaacagaguaaccagcucaccaacaguaucuagaaaagaggaaagucacagaauggaaaaauagacacaaaaagcuauggagaagagagacugaaacagacaaaggcgguuguacuauaaaagaaagcgagaaauggaaagggaaaugucagcaaucuaagguuaaaagagaaaagaucaggauauaaaaagauguagaagucucuuaugaaaaaaaaaaaaaaaaagggaggggaccagugaagagauagaaaucaugaccagagucgaagcuugaaaacgcagggcaacacacaaagagaagcuguaauagcagagccauucacucaaucauucauuucacucauucauuuaaugccuaacauaugaaggguacuuuguggagcuuugagagacacaaaaaugacuaagacaggaccccugcccucaaagagcccagcuguuccaaauauucucauuuugguaugcuccaauuuuuaauguaauuuuaauuauuguugucacaccuuagcuaauauuuucauacucaacauguacuuccagaaauugcagcaacuauaccaucuauaaaagaggguaaucuuggcagggagcggcggcucacaccuguaaucccagcacuuugggaggcugagauggguggaucacgaggucaggagaucgagaccauccugcccaacauggugaaacuccgucucuacuaaaaaugcaaaaauuagccaggcaugguggugugcaccuguauucccaguuacucaggaggcugaggcaggagaaucgcuugaacccggaagguggagguugcagugagccgagaucaugccacugcacuccagucugggcagcagagcgagacucugucucgaaaaaaaaaaaaaaaaaugaggguaaucuuaaauggauggcagcugccauacagaaugaguucauucguuguggaacggaaacauguuuacauuucugauaugcugauaguauauaaugcaguauugugaugugguucucuguauauauagaugcugucuauacuuuuuuuggauacagcacacuccacaucauucuauuuuauuuuuaucaucccauuccagagaggaggcaaaggacaaggaagucuaaaggauguggaaagacaaauaaggaaguuaaaaaacagguuuucauuuucuuuacaauuucccagagggcuucuaugacaaaaagcuguacugaacaacggaaugcguauuugucauagaguagcugagagugaauucuagguaaacauacaagggagaggcuccuagacagauaccauugccuaguaccuuucauuuaaaagauaccuagugauauaugacuugggaaaaccagaaauugaccucccagccugccucaguauauggucuuugcucuuaccaagguuggcuugcucccugaaaagaccugaaaauucaaguuugaaaagguguuucauauaccuaauuuagaacacaccccuccuagaucuauaagaguaggugagaagcauagaaaugaacaccuauuauuuugaaugcucaucuucugauuccuuuaaugcacugucccgcccuuuacccucuccccaaaucuuugugguucuuuugggauuucaauugaggugccccaucucuccgccagagauaggaaugugacucaaucuaaccaaucaaaaucuucugggggaaguguaugaaucugcaguuagagagaaggcuuuccgagaucuugggcacuuaaauucacauaagucugaagcugcuuagagauauuucuucccccaccacaaagacugugacugaagaaaagaugaagaccacauggagaagaggaggacugugaggggggugagagcagaggcgaauuuauccugaagcuacuacaucuuaagcuuacaggucuuucucucuuuuuuuuuuuuuuuuucccagacggagucucgcuuugucgccuaggcuggagugcaguggcgcaaucuuggcucacugcaagcuccgccucccagguucaugccauucuucugccucagccucccgaguagcugggacuacaggcgcccaccaccacgcccggcuaauuuuuuguauuuuuuagcagagacgggguuucaccguguuagccaggauggacuccaucuccugaccucaugauccgccggccuuggccucccaaagugcugggauuacaggcaugagccaccaugcccggcccaggucuuucucuagcgauguguucauauggucauuuauaaucuucuuauagagaaggcucuccaaacuguaugagcuuugggccacaaaauccuagauucaccccugggagagacaguugugaagauacaauaaggcacacauagccacccauaacagaagccagugucaccccacuggaccugcaauuaugugagccaauauucacccuuucuuuuuaucuugggauaauccaaauuugguuuuacccacuuacaaagggaagaaaccggagauuuuaaagauagaaauaaagucauggcucguaacuugcuggcaggaaaaaaugagaaccaaugcuguuuuugacuuucagaguaucuaucauaagcuaucauuuuguuuuuguccgcauuucaguaugugguuuaaaaggaaguuccaacaucauauuuguaacuaguuauaaggaaccggcagggaacagccuccagacauuuuucaaauauauuuuuccuuuaacuggcuauaaaggacaauaaggauuaaguuggcaccacaaaaagucgcauuuaaugauacccuuuuguguguuacccauuuaccaaacauggauuuuuauuucugcauucuauagaauacuuauucgccacugagaguuccauuuaaauucuuugcaugcacacacacacacacacacacacacacccuuccaccaccacuaccaccaccaucauuuucaucaucaugugauuucagaagagcagucaugucuacaguaaagguauuugagagcuaaacaaagccuccuggcuagagauccugguaucuuccuuuaaacccagaucauucaugguauggguucccugcagagcacugguuguggccccaccaagcacugccauuuccagcacugucaguuucuuuaaccuucaagagaacacagaagagucauucaaagccagcaagugaagagauguccuggcagucuaauuucaaacaggccucauaccagagucuuuuuuaugguuuuuaaaagaaguauuuuaugcugcucugaugaaaaccucuaacaguaguagcuucugucugacaaauaccauagagaaugaaacaauaagucugaagcaaagggaggggguaaaauuauuuuuguuucaauagccaacacacaaugaaaacaagaaacuauagagguuuaaagaauaaccgauauuuauucugguaaagacuuuucucauaucagcacuuuaccacuguaagaugcugacaauaauuaugugaauguugcuauaaaaaaauuaaaucucccaucucauggguuuaaagguguuuccgccucugccuuacacacacacacacauacacacacacacacacacguacacacacauauuucagguaccucugucaggaucucccaacucaauuauacugcauggaggaaaaauauguauacuacuacuacuagaauaagaauaaacuaguaaacaaacaaauagaauacaauguaagcugcaguacauguaaucugaaggccugaagcucaugugugcuagguuuuugauugagcagugguggggguaaacguggcacagcaguuaucagccuggacuguggaauccgaucauaccgggaaaugaauccuggcuuacucauugaguaaccugguaacugaaccucccugaggcccagguuauucaucaacaaacugaugacaguuaucccaugggguuauuauagggauuaagugagaaaauguuauauaaaggugaggaguggcagaauaugccaccccaaaauaugccacuuuggcaugaggauuauuuugagcugaaggcaguugagaagaagcagauaugagagaagcucucugucuucccccuauuugccacaaaacaggauauagauuuauaaaggugcccuccccaccuaucaggaaagaaaaaguuaaucaucagagauaacucuagauauucacuagccagaagagacaccagaggaaucuauguaacaagcuuuacuaacuagcccuuccauuaguucccccauauauuuaccuucucacaauuugcagaaacucaaaguccuuuccuuugucuuaccauuucucuaaaaauuuauugcucuuuuuuaaaaagcuauauaaggucacauuuuaaucaccccuuugagucacucaucacuggguacuuccauguguaugugcaaguacauguuaauaaacuucuguuuuuucuuauguuaaucugucauuuuucacucuacuuuagagggccacagcuggagaaccuaggaggguagagggaaauagauuuaguacaaagagcuuagugcagagccuguuucacaaugaagcacucuguaggugaaagcauugccaugauuaaugauugccacaaagcauccauguugguuaaacagacaccaugccuaagggcauauaaugacucugaggaaagcuagacuugaagaaaacacgacuugcccagccaaguaccuuggucaaaacacauauuuguuugacucuauaguguugagacuugaguaucuaauauacagaugaaugagccaguacagaauuugaaauuucaacaaaaaggcaaguauaaucugccugauaauaauaagcaacuuguaaaucuuugaauggaugggcuugccuguuuucacccaugcuacucaaacugugaaccacagaacagaacaucaguuucaccuggggacuucauagaaaugcugagucuuaggucucacccuagaccuucuguauuccagaauuauaauaagaucuccagaugauuuguaggcauauuaaagucugaaaagcacugcuguggaccacaaaauuuaauguacugcuuaucccacuuuggguguguuucugugaucuuuacaacuuaauaaaccacccccaaaaguuagugacuuuaaacaacaauuuauuuguccugcuucuucaauauuggcagggcucagugagacggcucaucucugcuccauaugguguugacugggguaguucaacacagacugcaagaugcaagcuggcuucccuucauucacaugcccuuggcugaccuggcugggacaguugggggcuggcugggccucucuccaugucuuuguuguucuucaggaccucuuuccaaauggaguggucucucuccugcagcaugaucagacuucuuuaagugauggcaccaggcuccaagacagugaagucagccaucuuaaagucuaaaucuggaacuggcacugugcauuucugccauuuucuguugaucgaauugagucaaaaggcaaacaaaugucaaggggagaaaaaagacuuuauuucuugacgggagaagaggucugcacagacaguguggaaggauuuguuagcaacaguuuuugcagacaagcuaccacagaguaucuguuacuuuucacuuucuucaucucucuguucuccugauuggucaaacagccacuucauuucaauuacacaacuauaugcgaggucccauugggagcauaaggaauuuuaagacaugauaucucccaucaaggagcuuguuauaauacaauugguaaaauaaggaauacauaucuugaaauuuuaauaacaauaaaauacuguaauaauaaaauauuuaaguagcagugccagauaauaacagaaaugauguccuaaggccaugaaccauuuauuuaauuaaucgugcacacaauaaccauccugaguguucagaagagagaauggaaggggaggagaauggccauggaaggacgguugugcagugaguaagacuugcauaggaaaaugaguaagguuuucaaaaaaaaaaaagguccaaugaaauacacacaaaggauacaacagaaucaaggagccaagggaauggggucauagggacacaaggccaugaaugaguaucugcauguucuucaaugaugauuaucaauucaauguuccugaaagaauuuccugccucauaacguccaccuuuacuucucccuuuagauauguucauaagcuauuuguggaauccccaccagcaauauaaccuuguauuaauaaugaaggguuuuuaugaaccuuauaaauuuuauuauaccuuguagagagggugggggaacaaacaaacagaaauguaggcauugccaaauggcaacuuguaaacuucacuauucauuguguaggaacuaacacuuuugguauuguuaaguagccuuguaaauuucacucucccuuagaaaauaaaaauggaaugaaaggugcugcuuagaagaaacguauaaauuucaaucuccacugcaggaaaauaagcucugauuacacuacauaguucauacaccucaauguuccgaacacuuguuuuuuuacagauucauguauaaugacuugguuuuccaacaacagagagugaaauuuacaaguuguuauuuaacuuuuuuaggaguguauuuuucuuccaugucuuuuuuuucuucuuugccccuacucacaccagaaaccuaauaugagcaaugggauuucugaauaguaccauacauuaauuccuucaauaacaaugauuaaaacauuuuaaacauuguucucagggccuccugauaccacauauaaaaguggggaaugacacagcuuuuggccacacaguucaaaaaauugcucuuuaccuuguuggggaagaagagggcuuauuaaaaguuuauaauaagcaguauuacuaguauuuaacuucuauuuguuguugaaaagaacugagccuauaauuucagaggcuuccgagcauuuucauaaauauacccauuagauauucaauagccaguggauuugaaugauuuugccauuuauucgaacagauagcuguccuggacaggaaggauagaagcauuggaagaaaguguuagaacuacauuuccauaaagucaugacaagaaauaaagaaagaaggggagucaccaccucaauacuagaagugucagcacaaugauauccucauaaaagguguucuaaaagaaacuuuuagguguucuaaaauaaaguuauaaaugccauaccaagaaauacugucaaaacaaaagucaaguacaauacagcccagaaagaaccaaauacaucuuuacaucagggaguaaaaauauacauagauauaauauccacaauugucuuaauuuauagcuuuuaaauagauaauauacauacaaagugaaaaauugaaaccacaccaaaguacguugaaaaaugucuucccacucaugcuguuaaugaucucuguacccucuucaacauaugcauaugugaacauauacacacauuuuaaauuuccaugacuacaaauaauggcauauucuaacccauuuuucacuuaaaaaugucauagagaugguucuguauagacccauuuuugugauggucuaauuuuauuacaaagauuauaaaguauagauauuccauaauuuauuuacagauucuccuauugcuuggacacuuaagcuguuuuuaaucauuuguuguuaaaugcaaugccauggcgaauauuuuuguacauagaauuuugugcaccugcaugacuauaguucuaaaauaaauuacuagaaauggaacugcuaggucaaaagguauauaugcauucuauuuugauaguuagagccaaauagcuuuccaaagacaauauaacaauucaugcuucuauucaugauaccaauacaucuugcauugaaggaauuccaaaacaaccaaaaguucaucauuuuucugccaacugauccuuucucucuuaaaaagagucgggguaaaaaucacccauuuuugcuuauaaccauaggcaguuauaaucauuauugcccaagauucaaggccauuucauuacccacugcaucaccauccucacugugguauaauucuaacuggucagagagaccuuuaauuugcagaccuucucagaagacagauuaucugcauucugcagacaucugcagaaagccauccacaagugcauauuucauggcugaauauuuuuacauaacaucagcuggaacccaucguuccagcauucucgccaagugucacaaccugcucuauuauaucaauaagcaguuucaauuagucauuuucuucccauggugacgacagcuauaauagcaugcaguagucugaugaaguuuguaauauaaaguggagaugggaguauuaaaaggaagagaauacagaauuagaaucgcauaaaaaaauccaucucccaaauagucauuuggggaaaugacaacauuuuugaaacaguguucaagaaugaauacaaaaaugcaauuacuuuugaaaagucagauaaauaaauuugccaugggaacacauucuugccccagauagaacccuaguuuuuacuggcuaauuagucauuaagcaccaucucaaaaacaacuguauaugaaagaauauuggguaaauagaaauaaaacuuaaggcuuaacagaauuguaaaaugaaaauaaaugccaacagagaauacuacuuugaaagcauuggauaguaguaaauaaauuagaaggaaugacacaguugcucugcccucaaaauuuaucccuaaucuguuacuacuuccuacuuugugugcuaagauuaccaggcuccaaaccaugcuugccuucccuggcacacagccagagccuucugacuggccaccugccucucuucuuguccccuucagccucuucuuuacacagcagcugaaaugauuuucuaaaaaauauaaaucagaucgcaucauuuccuucuuuucagcccucuacugguuuugcucauaauuaaaaucuaaaaucuuugccauggcuggcaaggccacauauggaauccaucuaccacuucuuucuccucccuacacuggccucuaucaagcacauucccaacucagacccucaggucuugcugcuuccagcuaaaagguuagacccccaaauauucagauguuuuuccuccuucacuuuauucagguauguccucaaaugucaccucaucacaaaggauuauuugaccacccuaucuaaaaaauaacccaaaacucuuuaucaaaugcaugcagauuuacuuuccuuauaucauuuaacuccacucgacauuauaugauguaguuagauguauaucuguucauucuguauauccccuacuagaauguaacuucaaugaagaugagaagaagcaaagauaaaaaagugcaucccaaccagacagaaaaacauacuaugacugugaacuacacccauugauaugguuugguugugugcccaccuaaaucucaucuugaauuguaacucuuauaauucccacaugucaaaggcagggcuagguggagauaauugaaucaugggggcacuuccacccauacuguucucgugguaguaauuaaguuucacaauauuugaugguuuuauaaaugggaguuccccugcgcaagcucucuugccugcagccauguaaggcaugccuuucuccuccuuugccuugcaccaugauugugaggcuuccccagccaggugaaacugugaguccauuaaaccucuuuuucuuuauaaauuagccagucuuuacuagcagugugagaacugacuaauacacccauaguugagaaaacagcaucuaccugacuuugguuaaauucauucaacucagcaaacauuuacuaaacucuuauuagauaagaaauuccagaaacauaggucccagugucuaucuguuauauaguuuagagacaaaaacuugcauauaauuugggaggcaagacaugaaauauaaacuacugaaaugacaacuaaaaagaguuaaugaucaaaagccaacaugaguagggcaggcaauaagugucagagaguucugaggaggagagauuuguguaggcugagagggugaaggaaugguucaaaaagaaggcuggagaagaucugggaaaggaaaccaggaggaagaaggcauuuggggugagagcacagcaggggcagacacauagauuauaccaguguuccccaaacaucaaagcauggaaccuugguguuacaugguccacugacaggacaaaccaaagaauaauaaaguuauaucucuuuccauuugauuuuaaucuuucuaauacaugcaaugaaaaaguauuaauucagcauuaauuguuaaacaccuuaguaacacuugccaaucugaauggcauuauuuuacuuuuuauuuuuuguacuucucuuuaaacuuuuacucccuauuuaugauaagggcuuuuauuuauggaauaacauauaauuuuauucauauguaaacuucuauggguaaaaaaaagggaguugcuuuaauggcagucaaucauggacuaaauaucugggucacuaccuacccagacacaaagcagagucaaccuuuaaaguaagcaaagggggcucaguggaaaagagaagaaaguuaagcucuugucaagaugaugcagggggccucaugucaggcuaaggauucuggaaaauauucuguaggacugugguuucccaauuugcaacaaggucaaauuccuugaaaacacacgcguuauauuugaguguggcaugcuucuuauuuucaagacagcaagaaauauggcaaucuucaauuccauuauaccauuucauuauacaaacuuaaacacaaaguggaaagaaguaaauacaacuuuauacuauaugugaauuacaaaagcacaaucacaaccacaguuuuuuuuuuuuuuuaaagcugucuauaucuauuaugauaugggcaagaaacagaugacucacaaaauacucaaauaggguaaucugcagaaaugcuuagaaaguguauucaugguguggagaaaccaaggauuaaugcaauacccagggacaaggcgggagccuacuuauagaguucacagagaacugcccaagcaaagagcaaagcagagaguggguaggaaaggauaaauugaagauaaccaauauacaaacaaggcuauuuucacauauuucaaauacuuaccaggucuucgaauacuuuaccugucuaaucacgagcuguauauuuuuuauagggaauaagagugcauaggccaggcgcaguggcucaugcuuguaaucccagcacuuugggaggccgagauagguagaucacaaggucaggagaucgagaccauccuggccaacauggugaaaccccaucucuacuaaaaauacaaaacuuagcuaggugugguggcaugugccuguagucccagcuacucaggaggcugagggaggagagucgcuugaaccagggagacagagguugcagugagccgagauugcaccacugcacuccagccugggcgacagagcgagacuccgucucaaaaaaaaaaaaaaagagugcauauagcauggacuuaaaccucagcuugccauucacuucuaugugaguuucuuaagcucaaugaauuuaauuuuuucaauaaaaugggagauaauaacaguauccacuauaaggcuggugugagaagcaaaugaauaaauguauguaaagcacuuagcacagcauuugccuauaauaaauaugcaugcuuugggaaaaugggggagggucaugugagcugccaaaauagugaagagaaauuuaugagagaaaagcuuaagauugcagaaauuaucaauuuaaauugcauuagcuuaguauuucauaugaguuguccaaaacaucccauauuauucaacuauuccauuucauugauaaaauacuucaaaggcauacaaagaaggaaaauagucuagaucgguagaggcaggugggguuauagugguggugaucagugguaguggcagggaauagacaguaaaggccuccuucagaagguaauauuuaaaauaagaccaacugaaacauaaaaggaguuaacuaagugaggugaaaagugccccaagcagaggaaacccaacaugccaaggaccuggggaagaggaaaccuccuggauucaacauauuccacgaucaacauguggaagaguaaacaaggcguggggagaacugcagcuggagcgguagaaccuuuucagucauguuuaaagaauuuaaauuacauuuaucccaaggguaaugagaagccuuugaaagacuuucaagcaggaaaaaggcaugaucccaugaucggauuaucaucauuagaaaaccacuacuaaagagaacagggaggcauuagagaguuuugaguuaaggacugaacaagaaaaauaauguuucaaauuucauuuuuauuauuuuauuguuuacaaaaauuguaaacugccgcagacgauuucucugagggcuaacuguauaaguauagguucauuugguaacucacucauuccguaagauauuuauuaagcaccuaaugcauacaccggaacugugcauagauaggggacggaggagaaaacucacaaauaagcagucuaaaaagugcuaagacuugaaaggcaaacgacacuucugagugguggguaaaauuccaaagguggaccaggcagugucuuugcuaaaacauuuuucgguauggcugaaccauaaaaugcaugggccguauugaaccacuccuuucacaagaauuuacugagcacugacuauaugcugguauuguauagcuuuggugacauggugguguaugagaaaucacuuaaaauauaauagcaauaacuuuuuuauuguaaauaaggcuggguugauuaucaagagugcaugagaaagaaaaacagagaagugaagaacagugccuucacuuaaggaggguucgaauggcaauaaaauacuuuuaauuaaaacuucucugcugagaauagacagccuuugaaagcuuguguaaacauaaaugaacuacauguaaauauauucaugauauuauagcuuuuuaaauaacauuauaacuuuuaaaaugucaaauccuuugaauaugaaaugccauccccucuccccaaaaacaugaccaccaugaauuauccaguugaucuuaaaucaaaagccacuuacuuaaaagugaaauguucauuccuuacacuuacuagaaaaacugcuucaaauaugaucagaccuucccuuugucuucagagaauuccgcugcugaaacagacccaacaagccagccaagguccaucuggggcagcuuagggaaggggcaagacauguucccugcccaacacuaucuuuuccaacuuagccccugaucaugccaagacaucacaguguaauaauaguaauuuaauaauguagucggccaggcucugcccacaguagaaagcaugagaaaauaaaugaggcuugaaagcuaaacagagagaaacuucuccaggcacugccugcagcagggagauaccugguaaugaaauacccacugaucuccauucauuacacaggaggcaaaccuuaaaagagagucuagaaagguggaucucucaaaauagaaauaaauaaauaagcucaccugccaugguggggucucugaaaaugacuuggaaggacugccuauagaauuuuuguggggaugcagcaaaguuuugucagaugucaagggagguaauuauucccgacuugcuugggcacauuugcuggauaaauuggccucuuuaccuucaucuccccaugcgggcaccagauaaagaaaccguguuuaaacucuacaguguucucucuggcuuuuaccaugaaaaagaaauaaaaaugcauccugggugcuuggcaaaucagcccagugucagauggggacccauuaucuuugaccuucacauuugugccccuugggacucacagaaaauccucaaaaacucuuuuggguaaagauauaugaugucuaggagguacccaccuucaggagaaagaaauugccuuugcaauauaaaaguugcaaaaguugaaguuagugauuucuuuauuuuuuauuuccauuuuugucuaucugcucaaauuuuuaaaauuuaccuacaaaugcuggaagccuuguuuacucaaccauguuaucaacauguuaagcuaucagccauuucucucccuucccugcuuuccucuccaaucaccaagacaacacuaacauuucuccaucuuaccuucuuuaaagaaaaauucuuacaguuaacugucugccaucuacuaccacuuccagaaccaguaaugaaaugucagaggaggaacaguuaauuaaaauuguggaauccuacuuugcauccucucacagucaauacauguacaauuagagaugccuuucagcaugugguauaacuaguauaaguuaaacuuugaauaacacuugaucauuaaaaauaaaaaaucauuaauguuaagcaaauacgcaguaaacaucuugcuucauuggccauaaaacuccuuuagcucagcucaacuagugugguagauuuaauauugggauucacuuagauggugcuuuuuaguaagaaaccaaggaacaugucuacaaucugcaagugguuuaugggaauaaaaacugugccuaauuaucccacauggguuuaccuaaguugucauuuuuuuacaaaauuucucaaguuucuccacaaacguuuagggaagaaaugacauagaauggugguuaaggguucagacucuggagucaaauguuguguguguuucaucccugccucugcuacuugcuaaacaugacacugccauaaccauuuuucuucauuucucagagccuccauuucccuguagguaauaugaagaaaacacuauucauucacagggcuacugugaggaugaaaugagauaauguacacaaagcauuuuaaauagugaccagaaccuuguaaagauuaaguaaaugcaagcugguccuccuaauugauaccuuauucauucaauaauuauacuuccuaaaagagucugguaauuauguauuuaaaacauauucacgagguggagccaagauggccgaauaggaacagcuccagucuacagcucccagaguaagcaaugcagaagacgggugauuucugcauuuccaacugagguaccagguucaucucacugaggagugucggacagugggugcaggauagugggugcagcacacugagcaugagccaaagcagggcaaggcaucaucucacccgagaagcacaaggggucagagaauucccuuuccuagucaaagaaaggggugacagacggcaccuggaaaaucgggucacucccacccuaauacugugcuuuuccaauggucuuagcaaacggcacaucaggagauuauauccugcaccuggcuaggaggguccuacgcccauggagccucccucauugcuaggaaagcagccugagaucaaaguguaaggcggcagcgaggcuuggggaggggccccugccauugccgaggcuugaguagguaaacaaagcggccuggaagcucgaacucgguggagcccaccacagcucaaggaggccugccugccucuguagacuccaccucugggggcagggcauagacaaacaaaaggcagcaaaaaccucugcagacuuaaaugucccugucugacagcuuugaagagaguagugauucucccagcaugcagcuugagaucuaagaacggacaaaaugccuccucaagugggucccugacccccgaguagccuaacuggcaggcaccccccaguaggggcagacugacaccucacacggccggguacucuucugagacaaaacuuccagaggaacaaucagucaggaacauuugcuguucaccaauauccgcuguucugcagccucugcuggugaaacacaggcaaacagggucuagagugggccugcagcaaacucuaacagaccugcagcugagaguccugacuguuagaaggaaaacuaacaaacagaaaggacauccacaccaaaaccccaucuguacgucaccaucaucaaagaccaaagguagauaaaaccacaaagauggggaaaaaacagagcagaaaaacuggaaacucuaaaaaucagagcgccucuccuccucgaaaggaacgcagcuccucacaagcaacggaacaaagcuggacggagaaugacuuugacgaguugagagaagaaggcuucagacgaucaaacuacuccgaccuaaaggaggaaguuugaacccauggcaaagaaguaaaaaaccuugaaaaaaaaauuagacgaauggcuaacuagaauaaccaaugcagagaaguccuuaaaggaccugauggagcugaaaaccacggcaccagaacuacgugacgaauacacaagucucaguagccgauucgaucaacuggaagaaaggguaucagugauggaagaucaaaugaaugaaaugaagcaagaagggaaguuuagagaaaaaagaauaaaaagaaaugaacaaagccuacaagaaauaugggacuaugugaaaagaccaaaucuacaucugacugauguaccugaaagugacagggagaauggaaccaacuugcaaaacacucugcaagauauuauccaggagaacuuccccaaucuagcaaggacggccaacauucaaauucaggaaauacagagaacaccacaaagauacuccucgagaagagcaacuccaagacacauaauugucagauucaacaaaguugaaaugaaggaaaaaauguuaauggcagccagagagaaaggucggguuacccacaaagggaagcccauucagacuaacagcagaucucucagcagaaacccuagaagccagaagagaguggaggccaauauucaacauucuuaaagaaaagaauuuucaacccagaauuucauaucuagccaaacuaagcuucauaagugaaggagaaauaaaauacuuaacagacaagcaaaugcugagagauuuugucaccaccaggccugccuuacaagagcuccugaaggaagcacuaaacauggaaaggaacaacugguaccagccacugcagaaauauaccaaauuguaaagcccaucgaggcuaggaagaaacugcaucaacuaaugagcaaaauaaccagcuaacaucauaaugacaggaucaaauucacacauaacaauauuaaccuuaaauguaaaugggcuaaaugcuccaguuaaaagacacagacuggcaaauuggauaaagagucaagacccaucagugugcuguauucagacccaucucacaugcagagacacacauaggcucaaaauaaauggauggaagaagaucuaccaagcaaauggaaaacaaaaaaagcagggguugcaauccuagucucugauaaacagacuuuaaaccaacaaagaucaaaagagacaaagaaggccauuacauaaugguaaagggaucaauucaacaagaaaagcuaacuacccuaaauauauaugcacccaauacaggagcacccagauucauaaagcaaguccuuagagaccuacaaagagacuuagacucccacacaauaauaaugggagacuuuaacaauccacugucaacauuagacagaucaacgagacagaaaguuaacaaggauauccaggaauugaacucagcucugcaccaaguggaccuaacagacaucuacagaacucuccaccccaaaucaacagaauauacauucuuuucagcaccacaccacaccuauuccaaaauugacuacauaguuggaaguaaagcacuccucagcaaauguaaaauaacagaaauuauaacaaacuaucucucagaucacagugcaaucaaacuagaacucaggauuaagaaacucacucgaaaccacacaacuacauggaaacugaacaaccugcuccugaaugacuacuggguacgucgcgaaaugaagacagaaauaaagacguucuuugaaaccaaugagaacaaagacacaacauaccagaaucugugggacacauucaaagcaguguguagagggaaauuuauagcacuaaaugcccacaagagaaaucaggaaagaucuaaaauugacacucuaacaucacaauuaaaagaacuagagaagcaagagcaaacauucaaaagcuagcagaaggcaagcaauaacuaacaucagagcagaacugaaggagauagagacacaaaaaacccuucaaaaaaucaaugaauccaggagcugguuuuuugaaaagaucaacaaaauugauagacugcuagcaagacuaauaaagaagaagagagagaagaaucaaauagacgcaauaaaaaaugauaaaggggauaucaccacugaucccacagaaauacaaacuaccaucacagaauacuaaaaacaccucuaugcaaauaaacuacaaaaucuagcucccucucccucucccuuucaucuccgucucccgcuuuccacggugccccccucccucgucuccgucucccacuuuccacggucucccucuguugccgaggcuggacuguacugccacgaucucggcucacugcaaccucccugccugauucuccugccucagccugccgagugccugggauugcaggcgugcgcugcuaagccugacugguuuuuguauuuuuugguggagacgggguuucgccguguuggccgggcuggucuccagcuccugaccuccagugaucugcccgccucggccucccgaggugccgggauugcagacagagucucgcucacucagugcucaauguugcccaggcuggagugcaguggcgugaaccuccaccucccagccgccugccuuggccucccaaagugcugagauugcagccucugccccgccgccacccugucuaggaagugaggagcaucucugcccagccgccaaucaucugggaugugaggagccccucugccuggccacccagucugggaagugaggagcaccucuuccuggccuucaccccguguaggaagugaggagcgucucugccuggccgcccaucaucugggauguggggagcgccucugcccggccgccccgucugggaugugaggagcgccucugcccggccgcccugucugggaggugaggagugucucugccuggccgccaccccgucugggagguggggagcacccccgcccggcagccgccccgucugugaggugggcgugcccccacccggcagccgccccgccugggaggugaggagccccucugcccggccgccaauccaucugggagguguacccaccagcucauugagaacaggccaugacgaugauggcgguuuugcugaauagaaaagggggaaauguggggaaaagaaagagagaucagauuguuacugugucuguguagaaagaaguagacauaggagacuccauuucguuuuguacuaagaaaaauucuucugccuugggaugcuguuaaucuauaacauuacucccaacccagugcucucugaaacaugugcugugucaacucaggguuaaauggauuaagggaagugcaagaugugcuuuauuaaacagaugcuugaaggcaguaugcucguuaagagucaucaccacucccuaaucucaaguacccagggacacaaacacugcagaaggccacaggguccucugccuaggaaaaccagagaccuuuguucacauguuuaucugcugaccuucucuccacuauuguccuaugacccugcgaaaucccccucucugagaaacacccaagaaugaucaacaaauacuaaaaaaauuaaaaaaaaaaaaaagaaaaguucaaauaaaguguaugaaagaacuuuaaaaaaaaaaaagaaaaaaaaagugcgaaaauuagccaggcaugguggaguaugccuuggggucccagcuacucaggaggcugaggcuagaagaucacuugagccugggaggcagaggcugcagcaagccaugauugugcuacugcacuccagccuaggugacagauggagacucugucucuaaauaaauaaauaaauaaauaaauaaauccuauuuuuaaaugcuaaaaaaaaaaaagaaaaucuagaagaaauggauaaauuccucgacacauacacccucccaagacuaaaccaggaagaaguugaaucucugaauagaccaauaacaggcucugaaauugaggcaacaauuaauagcuuaccaaccaaaaaaauccaggaccagauggauucacagccgaauucuaccagaagugcaaggaggagcugguaccauuccuucugaaacuauuccaaucaauagaaaaagagggaauccucccuaacucauuuuaugaggccagcaucauccugauaccaaagccuggcagagacacaacaaaaaaagacaauuuuagaccaauaucccugaugaacaucgaugcagaaauccucaauaaaauacuggcaaaccgaauccagcagcacaucaaaaagcuuauccaccaugaucaaguuggcuucauuccugggaugcaaggcugguucaacauacgcaaaucaauaaacguaauccaacauauaaacagaaccaacgacaaaaccacaugauuaucucaauagaugcagaaaagaccuuugacaaaauucaacccuucaugcuaaaaacucucaauaaaugagguauugaugggacauaucucaaaauaauaagagcuaucuaugacaaacccacagccaauaucauacugaaugggcaaaaacuggaagcacucccuuugaaaacuggcacaagacagggaugcccucucucaccacuccuauucaacauaguguuggaaguuauggccagggcaauuaggcaggagaaggaaguaaagggcauucaauuaggaaaagaggaaauccaauugucccuguucgcagaugacaugauuguguaucuagaaaaccccaucaucucagcccaaaaucuccuuaagcugauaggcaacuucagcaaagucucaggauacaaaaucaaugugcaaaaaucacaagcauucuuauauaccaauaaaagacaaacagagcgccaaaucaugagugaacucccauucacaauugcuucaaagagaauaaaauaccuaggaauccaacuuacaagggaugugaaggaccucuucaaggagaacuacaaaccacuacuuaaugaaauaaaagacgauacaaacaaauggaagaacauuccaugcucauggguaggaagaaucaauauugugaaaauggccauacugcccaaggcaauuuauagauucaacgccauccccaucaagcuaccaaugacuuccuucacagaauuggaaaaaacuaccuuaaaguucacauggaaccaaaaaagagccugcauugccaagucaauccuaagccaaaagaacaaagcuggaggcaucaugcuaccugacuucaaacuauacuacacaaggcuacaguaaucaaaacagcaugguacugguaccaaaacagagauauugaccaauggaacagaacagagcccucagaaauaaugccgcauaucuacaacuaucugaucuuugacaaaccugagaaaaacaagcaguggggaaaggauucccuauuuaauaaauggugcuggggaaaccuggcuagccauauguagaaagcugaaacuggaucccuuccuuauaccuuauacaaaaauuaauucaagauggauuaaagacuuaaauguuagaccuaaaaccauaaaaacccuagaagaaaaccuaggcaauaccauuuaggacauaggcaugggcaaggacuucaugucuaaaacaccaaaagcaaugguaacaaaagacaaaauugacaaaugggaucuaauuaaaauaaagagcuuuugcacagcaaaagaaacuaccaucagagugaacaggcaaccuacagaaugggagaaaauuuuugcaaucuacucaucugacaaaggacuaauauccagaaucuacaaagaaucaaacagauuuacaagaaaaaacaaacaaccccaucaaaaagugggugaaggauaugaacagacacuucucaaaggaagacauuuaugaagccaaaagacacaugaaaaaaugcugaucaucacuggccaucagagacaugcaaaucaaaaccacaaugagauaccaucucacaccaguuagaauggcgaucauuaaaaagucaggaaacaacaggugcuggagaggauguggagaaauaggaacacuuuuacacuguuggugggacuguaaacuaguucaaccauuguggaagucaguguggugauuccucaaggaucuagaacuagaaauaccauuugacccagccaucccauuacuggguauauacccaaagauuaugaaucaugcugcuauaaagacacaugcacacguguguuuauugcggcacuauuuacaauagcaaagacuuggaaccgacccaaauguccaacaaugauagacuggauuaagaaaauguggcacauauacaccauggaauacuaugcagccauaaaaauugaugaguucauguccuuuguagggacauggaugaagcuggaaaccaucauucucagcaaacuaucgcaaggagaaaaaaccaaacacugcauguugucacucauagcugggaauugaacaaugagaacacauggacacaggaaggggaacaucaaacaccggggccuguugugggguggggggaguggggagggauagcguuaggagauauaccuaaugcuaaaugaugaguuaaugggugcagcacaccaacauggcacauguauacauauguaacaaaccugcacguugugcacauguacccuaaaacuuacaguauaauuuaaaaaaauaauaaaaauaaaacauauucacauauuuacguauucauguauuuaaaauauauucauuuauuuuacacuaugugcaacucauuuuucuacuuaagaauuagagagaugacauuucggaggccccuaauuccaaaugcugccgccuguuuuuaguacagaucuguguuaagcaaaggaaaaugaagcggucaaaucgccucagaagcuuccggcuuccaccccuguuuguaaacgaaacuccauauuagucaaacuacacuccccagggagcaccuguaaaagucccugauuuacagaaguauuuacuuuaggguauggaguuuguuuuuucagguuuaucucugggagagcuuggugaagcugacaguccagcaauuuuauuaaacuguucaauuucagcauuuuuuaaagagcauauauaaagaacaccggcaguagcuauuuaaauuucccaguggaugcuagaaauaauaaaaggacacuuaaaugaccauuuuugagcagagccaacagcauguguccuaauuauccaacuaugugaaaaauucuguggauuuuuaccagagcacaagggugugauaugcacaauucagaacacuaacggcuaccucacuaggguguagagaacuuuucaagucuaaauauaaggucccagucugccaggguaaguuuuucugcuacuuucccucuugaugaacuuguuagacaugauaaauggacaacaugguaagaaguugauaugguccacugauaagccucugaugaagaacaaguaaauaaaaaaccauugugcuaagugcucuccuucauuuauucucacgaucacauucugagguagguauuacuaugcacauuuuacaggucaggaaagcaaagcucacacaggauaagugccuuauccuacaguuuaaguauccaagcugguguucugauuuuccuccacucaccucuuccuaucucuucuccacccaccucuuccuaucucuucuccacccuucucugcccugcugguggucucuuccuuacugaucucuacagacucaucucccgugcccuuugguuucuauagggcuaagacaauggcaggcagcauuaagggaucagagaauuggaggaaagagucuggggguaucuauuccccauuuccucucuccuccccucacacugcacaacugagacuuuugacaagugcccacauuuuucuagcuuugacuauaauuucugucaguggcccuuuuucccuaauuccuagcuagggcucucauuggauucuuguaauucuguucucugucuuugcuccuucagacuuuccauaguugcuucaccaucuuuuuugguucccuuaaaucuacccacaccucugucaaucuucuguucauuaaacucucuuccaaccucucaguuuuggugucauccacuuucugcuggagaaaggaggguagccccuagcaguugguaccuccuccucucuagcuucccuuucaucuacccacaaccaaccacucacccuucccuuguagccagucacaccacaagcaagucugugacucagcaaacuggcucccagaaacaaacccuaggagcauaauugaagaugaacccaaagauacaguuauaaguaugcucguggagaauuuguaauuuuuuaaaaaaugguaguuaucuaagaggacuugauuaaucaaugaagggacauucauaaaaugaaaaauuauaaaugauuaaaaauaauaccauaacuuauauuucaugacaugaacauauucucaauauauuaacuucaaaagggaagauacaaaguuguguguagaauaacucaguuuuucuuuguaaaaauuuuguauacauggggagaaaaugguccaaaagagaccauccaauagaaauacaguacaaggcacauaaguaauuuuagugucaguaguuacguuuuaaaaaguuaaaagaaaccagugaaauucauuuagugauauauuuuaguccaacauaugcaaaauaauauuuaaucauguaagcaacagaaauuaauaaugugauauauugaauucuucuuuugcauaugaagucuuagaacuccgguguguaguugacacucagagcacaugucaacucagucuugcuacauuuuaaaagcucaagagccacaugaggauagugacuaccagauuggacagcucagguaagccucaaaagcggguguguagaguaggaaguugaauguucuucacuuucuuauuauuuuucuccuuuuuuaccauuaccauuuacuacugaugcaugucaccucugcaauuagaaaaacaaauuauuuuuaaacacuaagagcaaggcuuuuuucuucugucucuggaacacuuuuuggcucauguccuuugcaauucacagacuacacacuuacuaguauagaaaggugcccuccuuucuuccccucccuuuacauuuucuuuggauagcuaccuaucuucagcccucaggcauaagaguaagaaucaaauguugauuuucuucagaguggcugcugagccagcucccacucuccaguggugugacccggaaucuaucaggccucacaccacuguuuuagcagcucugaauggcuuguggaagggcauggaauggggccagaaacugcuuaauuugagguuaauuaaauagugaugacaagccuuaaucuccaacuugucaucagauuguaaacacugauugcagcugcagcaaucugcaauaaaccuauugagaggaaucuugaccagaaugaaauaaguacguugguuacccagaugaggcugggagaggugagaucagagaaaucuaggcuuuugcaguaccaggagaaauggagaccugaaaagagggaaauucaugggcgaaugugucaauucugauuccuguacagcccuaucaaaaaaaagaaaaaaagaaaagaaaaaauaacuggaucccaugcaccuggaaauuggaaagaacaagggcagaaauauaaaaccacuaaacuaaggaccuggaaaaagcugaaauagcuuuacaucuauuagccauugaugagguuuccaugaaaaaauaugucugagccacugcaugcccugaggccgcuggacagaugguuauaccaccagagugagcuacagcaguggcuuucuagagugcaggcaaggaugacaguuacaguguguuaggucucuacugugucucaagcacaucacauguaacguauaugauaauucucaaaaguacuuuaugagguagcuauuauuuucuccauuuuaaagaggagaaugcuaaaucucaaaggaguauccuaccuugcuuaaguacauguaacaaauggguugaacccagacugucuaaugcccuaaugcaaauucuaaaucacaagaaucucugccuccagcuuugaggcaauguugaagugggaaaggggaaagaauagucaaguuccugaagaagaugggaaaaaaugagucaaaaaucuccaaagaauagggaagcacaaagggcugagguaacaaaugccagaugaguaaacauguucauaacacugcaccccggaaagugccccuccuggcuccauuuucauggagaaugcuuucucauucuucaagauccagcacaaggccaauuuucaccucuucugugaagccuuccccaaaccuccuagugagagaggcacuuuaaaaaaauaugugagaugcauugagagacagauggacaccauaaaagcugaacucaauauuacaugugaagaaaauuuacaaaaaaaucuuaaucugagugucagaaaaauuggaguagugaaagaaccauuacaguuauugucaaauaguuaauuaacuauuauguagguuuaaauccauguauucuuccuuaaaaccuuuuggaacaagauaaaucauucucauccauucauuuauucauucccuagcacugugauaacacuagagaaauaacaaugaccaaaaacagacacaauuccacucucgagguacacauguuuaaaagggaaaacagaguaaugauacaaaaaucacacaaauaaauggacaauuaugacauguguuccaaauaagagguaaaugagauguuauuauuuuauccaggauacaggacuggaaucauuaaagagaauacacagggaaauaagcugcaguucauuauuuggaaaaaguuucaaacaauccacacagaaauggccccacacaugagccugcucucuucugggcauuggaugugucccggcugaggcagggaagacaagggugcauccgucgauaacuucucaagucucuucugacucuaagaaacugugacccuaucauuccaaacaaaauauuuucucagauaagaauuagaauuggcuagguugaauuuccaggagacuuaggaaauauguacagagaauaaucacuuccuaaauagagaggggagucaagcaaaacugagucuucuaaacugcucgguagcauucuccuucucuucgcacauggacacacuucugcuuuaugcacugcccugacagcuuccugaggacagaggcugauggucuugcucaucacugaaucaucaaugcguggcacauauuaaauauuuguuaagugaguaaaugaauaugguacuaaaaugugcauacugacagaaacuuuuuucuguuguggcccuuguaggugaacuuccuugaauaauuaaugaacaugaaagucagucaaucacucaccuccugauuaauagucagggucccuuguccaaacagccacuuaguccauuaaaaauuaauaauuuucuacagaauaaauauaugcuguacaugguacaucaaggguuccacuuuuaauacgcaauuaaguaaugcagaaagacuaggaaucuauuaacuaagaaagagcuccaugaacuugcccuccaagucaucauucauuuacuauccauuucucuuccaauuuuaaaaaauuauuuagccagaaaaaaaguaguucugaaaacagaguaaauaacaacauguugucauauuuuggcuaacauuugcaggccgacacaauguguguuuguuaaagauuugagauaugcuauuccuucugugaaaugacgaauacauuagggcagaucaauacaaaacugaagcucuauauguaaaauguuaagggucuauucauugaaaaauuaugagccauguuauagaacuuaggucagaguuaaauuauugaucuacauucauuuuuccccuuuccaugugacuaucuuuugauuuuuuauaacauacauuauugccuauguagaaaaugaauccucuucuucuagagcuagugugucuggugacugacaauuuucuaaaauuaacuguuguguugguagcauuuagauuuguaaauugaacuccccuugcauaaacauuuaaacauugaaaauaaaaucuguaaacuuugguagcaugaacucaaagggaaaagaggauaauuuucauuuuuuaauacaaagaaagcaaagaaaaaaaggaaagguuauuuuucuuaacaucauucuacuacuuuaugguucuugauacauuucauugaugaggccaaauuguauucaguugacuuuuuacaaaugacuaaacuguauugcuaagcaaagggauguaaucaacacuuugugagcugaagucucaauuuucagaccuaaagcuuacucaagauguauaaccucaaauucuguaagcagguuagaugucuugaaauacaaagacucucauccccuaucagcccccaaagugacaaaggaaugugucuucaaugaagauuuucucucaucugcugaaaagggaaaaugugcaaauauuucaaagaaauguagauuccacagacccacauuaauucaugaaaaaggaagcuaauguaagaguucuuaguaggaaugaucuuugauuuggggcuguauuuggucaguaacuuuugccuacuaggagaauauuuucucuuuaacgaaguaguaucagacacagagggcucuucauuuucucuaauggagauacaaucauuuagauucgugcuccaaaugaggcagaaauuaccccuaauguguaguuugaacauuuguaucaaaauacagugaaaugcuguuucagagucugaugagaaaaauaugugagcucacagaaugucugccucucucaggugcagaaguggucuacugcuuuuuuuuucuuuuuucuuuucuuuucuuuuuuuuuuuuuugagauggagucucacucugucacccaggcuggagugcaauggugaggucuccgcucacugcaaccuccaccuccuagguucaagcaauucuccugccucagccuccugaguagcugggauuacaggugcacgccaucaugcccagcuaauuuuuguauuuuuaguagagaugggguuucaccacauuguucaggcuggucuucaacuccugaccuugugauccgccugccuuagccucccaaagugcugggauuacaggggugagccaccacgcccggcccucugcuacuuuucuucacauugucacugcaggaaucaccuggcucuagggggauaucccacagucucacauaaauaccaaucccugucgcuggaacaagggggucccagccucacagaaggccugagggacucuguuucucuacaggucagcuccaaagcagagggcccuuugcaccauaaaucaaugucauccacagaaaacuccaggagaaaguuaaauaccagcagcaaacaaugucucuuguguagcagucucucaccacuguuucugcuaggugacaaaagcagugagaaaagcagaggaagcaagggcugaagacagaaaagucaaagaauugcagaacuugagaguuggaaaggggcagaguccaaauaggaaaagacuuaagcuuccuacuguguugugcuauguagaaugcuguaugaggaagggcagcaggcuuucuccccagaagcccagcugaaagucauccacacuuuacaugguccccuauaccaggcuucagcccccuuggccuugguuuucucaacacacaguauggaauccauuucucaugagauggacuucauuaaacacacucaugagaccaacauauaaaaccagaaugucaaaguaguagucuacgauuugcaguauagcuguugcacagaugucagaaagaccaauacauucauucccuuccuguaaaugucuucccugcaaaaccaaauccuaaucaggcagcaaucugacauguaaggaaucugaacaagaggaguucaucugaugaacugaauguuaaacagcgucaggggagauggagucaccaaugggaaagaauacccaaugucccuuggcugcagcucucuacauccauugccguaacagaaauggccuugccaauagaaaaacaauucuccaaguuucucacaggaggucccguccccuccaaagagagcuacauguguauucuuuguguauuuuuaucauugagaaacauaauuugaaugggaaagccuuucuuucguucuaaaaacccugcaucauuuuucucauugcagguuaaaauauguucauuguaaauaaugaacauacggaaaaggguaaaaguuauucuauuucuuccgcccagaaaacuauagguggauaaucuuucagucuguuucuauguauacaucuuagguuguccauauaaaauuaucauuuugcagauaaaaagcagucaauuaggugcaauucuacaugguccaaucucauauacauacgcacauuacauuaaagucaaaugacaccuuaacuucuacuuuguugcuuuucuuugaauuaacuagggcucauauacaguuuuccauguuacucgguaauaccauaauugauucucuugcacgcacuuguuuaccaaaacuucucauuauuuccuuagggaauauucacagacauagaagugcuugguuaaaggauuugcacacacacccauucaugcauauacugucuaagguugcucucaucauuaacagcagaguugaguaguugugaccauacuaccaaaaaaccugcaauauuuacccuuuaguccuuuacagaaaaagguugccaacccugaccuagaauccauaauuaacuagauacagaauccagacauccauucaacaauaggacacagacuuccuauuuuuaaaaaauucaccgugacuacaagcagaucugcauuuaaaauauuuuauucccauuaguauuuuuaauugguccaaaugcucuaugugauauaacuucacuaucauuagaauaguauuaaagaauacuauuagaaaaauguagcuccauuauuuuuacuacagaaauuauuauaaccgaagacauaaaugcgaaccaaauaaaacaaaauaaguuguaaaaauuccuuucuucaacaauugcauaauaaucuauaauacacauagauauacauguucuuaaauauuucauguaaaaauugguuacuauuuaauaauuaauuuuagaaacauuaaaagaaauuuaacuucugggucuuugauuugaaacagcuaagaauuuuagacugguuuccauuuuuaaucaugaucaagacucagaaacguagcuaagaaaaaucauauuguacuuuuuauugaaaaggaaucacacagaccaugucugaauuauuauaaaggcuucauuaauuagauuuuaaucuacaugacuauaccauaugcuaaaaaaccauccaaacaaacucuaugaaacgguuuuacugcuauuacuuaaagagccauuuaaaagaauuucuacgggauaaagacugggugauuuaucauaguuuuaugcuccuuuaaucugcuccaucuucccauuguaaaauaaauauugguuuuaaaauaaaugguucugcccagguuuugaugagaaaaauugcccuguaaaucacaagcucacgugugccaaacucuaaguccaauguuaacuagccuauucugaagaaaaauaagucaauuuuauagaacaaaaucuaaagaagacaauuacuuaaguguauuuucaaagcugcaauguaauuaaucugagauaugagcuucuguaccccaaguuuuuuaauucucaaaauaagaacuaguggauaucaaacugguccuccaacuggauuuuuuaaaaauggguucuguacuauaguuuuuauuauauucuuuccgaauccaauauacaaguuauguaacugaaaauaaauacaaugaggguuauaugauaaugucugaggguuauaugaugacaucuuuaucaaucacuuuuuucauacacagagagccaaaucaauuuaauagucagguucuuagaauauuucauaguguucugaaaaauugaccuuacaguauacauauuuuccuauaauaagcauagugguuaaaaugcucuggaaguuaugaaugguuuaaagcagugcuucacaaacuauuuaggauguaaaacuaguugacuauauuuuucacuccaauauguuguggguuggugauacuuuuauaaaauacaauaaaaauugcacuuggauuuagugguagugucaaacugcuaugacagucucuaaaccagcacuguccaacagaaauaucauaggagccacaugucugauuuuaagcuuucuaguagccacauuaaaaauguaaaaagaaacaguugaaauuaauuuuaauaauauuuuauguaguccaauagauccacaaccuuauuucaauauguaaucaguauacaaauauaauggagauauuuaacuuuuuaaaaaaauuaagucaucaaaauccagcauguauauuccacuuacagcauguccccauucagacuggccacauuucaaguacucaacagucacauguagcuaguggcuguugugugggaaagugccauuuuaaaccauuacucccaaacucugcaccucccucuucaugaacugguccacauacaacacuuugaguaguacugucuaaacuacugcucccuuaaaaauggcaccuucauuucucuucuauaauuuucuacucuguguuuuaaauugagggcuccauuccagauaaguccaacacuuaaagaaauuaacaaacucaugauugcagcuaacuuuauacauccuuucaggaaaggaauuugcauuuauaagggauggauacggagguccccucugcucucccuucucuagaagcaaucacuauucugaaugauauugguuucuuucuuuccuauccauguuuuuauacuuuuucuacugacuauguucuuaggauuuaaauaaagcaaagagaaaauuuguuugcacauugcugagauauaugaauuuaaugcguuuagcucauacaaauccugaccauauuccauggcaaccacugaaaccgaaucacacaccuuucuacguuugcacccucugauccccuauucguccuucauaccacacugcuuugauauaucauuuucuuucugcucuguauuuagacucuguuccaccuucuagccuggauaauuucuacccauugagaucaaagcuuaaauaucacuucuucaaguaaccuuuguugaucugcccuuugcccugguaaaauuagguucccugucaaacacucucacuuuuccuauacugcacuuaccaaaauuguaaauaguuucuguuguuguuguuguuuuugagauggagucuugcacugucgcccagggugguacaauggcacaauuggcucgcugcaaccuccaccuccuggauucaggcaauucuccugccucagccucccgaguagcuggauuauaggugcccacagccaugccuggcuaauuuuuguauuuuuuaguagagacaagguuucaccauguuggccaggcugaaguaguuauuuuuuuuacugauuuguuuaaugucucucucauucauaaaaauauguuagcaccagcauaauuaaaaguauacaguagguauccacaaauauuaauugagugaaugaaugaauuuucauucucagaagccagacuuaaccuggucauuauguuucucaaucucuagucaugacacuagcuuacaauguguauaucauggauauauauacauaggguaucccuguuaauuagaagguauauuuucaagaguauggccauaaagaaguuauucaugguauauucuuuugaccuucuauuuucaauugucucuauauuuagcucccauuuuucauuucuaauacuguuuguauuucucucucucucucucucuuuguucuucucucuuuguaguugaucaaguuugacaagugagaaugugcuguuuuagucuuuaaaauaaucauuuuuugcucgguugaucuucucuacuguuucuuuguauucuauuucauuuuugguaauauuuuuguauuauuccuucccucuacuguauuuggguuuacucugcuauuuuauuuauaccuuuuuaauugaauccuuaauucccuaacaaugucuccuuccguuucuaacguauacauuuaugagucuauaaauuucccucuauauaccucuuugugucccacaagacuuaaaguauguacuaauuucuaucaucauuuuucuuugacucacaaauuauugacagguacaguuuugaguuuccaaauguauaaaguuuugaaaaguaucaguuucuaaucuccugcuuuuuuccucugaaauaaagaauuaguaaauauaauuuuuauucaucagcauuaagacuuucuauguguguauauuaucuguuaguggaguuugaaguucuauauaugucuauuuguccaagcuaaccgguuaugugguuuaaauauucuuuaucuuuucuaagcuucuuagcuuguuugauuuaucagugucugagagaaaaaugguuaaaacucucagauuaugauuauauggguuuucaauacuucuuggugacugugucaauuuuuacuuucuauauuuuuaaaaggaugcuacuagguaauguaggcucaggauuaacucuuccuggugaauuguucuuuuaucauuaaauaauaacucuuuaucuguaauaauauuuuugcuuuuaaaguauauuuuguccgauauuaauagugucaccagcuuucauuugaaugauauuuauaugauguauuaugucaauuucaucuauuuucucuuaaucuucccaugcuauuauccuuaauuggguuguuccuuguaaacaguuaaagagaguauagcuguucucucuauccaacuuaagaaucuuugccugcagacagauagguuuaaucauuuguauauuggcuuugauuacugauuauuuggccucauuucaacuaauuaaucuacagcuuccuaaaagucaguaauuauggccucucacugaaccaaguacugcauaccauagcaagcauugcuguaucuaucuuacacucauaauuuagcuguucucaauaaauaauuuagacacauuggcaaauaauauucucuuaaagcuucaagcucauaaguacuuauauauauaacacagaaaauccccaacuaagauggcuaauccacuacuacucuuauuucuuuaccuauaacaugaaaauaagugaauccacuugucaucuaccuccaauguugcuguacuuuccucuucaaccuccucauuuuuaaaaauuucuaucgggaacagcucucauucugucucuucuaccuuucuucuucccuaucccagucucucaccuguuaccuugacaauugaauuaguaucuuuucucucccugccuucauccuaccaccuaacaauccaauguuuccuccaguuaaaugagggucgcauaguauaaguuaagaaauuugaacuuuacccuacagcucaguguuucucaaacugaacccaaaggcacaguaucauagcuccaaacauucuaugagaauaugcuuuagguuuuuaugguuuuauuccaauuaauguccugaagaaucuaaaugacaaccugauaauugagcuaugcuuuccaaaagcagugccugaguuugucuuuuuuuuuuccuccaucaacucuguucuguucucaguaucacuggaaccaaacaaucacuuuaaaugacagcuuuuaacuuucagugugucagugagcacaucuggcugcuagguuggcauguccuaaugcuaaaauugucccaugucugcuauugugcucuucuugaagauaauuugcaauggaaagauagugucauggaauaagacuuuaauuuauuaaguuauuuaauuaauggagacuuugauaugacaucauaaaaacucauaguguggcagaguaauggucuauuuuaauuguuaugggcuaaugagaaaagaacaaaggcagaauuaacauguaaaugaugcguuuauaucaaaugaaagccaaaugauauuaugggacagugcaaaaggaaguuucccaauuuuucaaauagagaaaaguggugagaaaauugagucaucauguggcucugaguaguagaggcaugccaaauuaagagucuuugccauaguagucagcacacuuuauugaugaaacauuaauuuaucaaauauauguuaaauacuucaucaauaaacagugaguguuaaacacuguucuaggcacuaaggauacagaagucauaagauagucaacucuccagugucacggaaguuauauucugacaauaaaaagaugaacaugaauuuauaauacaacaucagggagucguaagucuugugaaggaaaacgaagcagggcaaagagauggaggaugaugagggaggaggaaagcuacaguaggcaagaugaucaagggaggauucucugagaagaugacauuugagcagacaccuaagugcaacaggaggcaaaggcauacaaauaucucggggagaagauuuccaaacaaaagcaagagcaaauacaaagauguugagaagaacagcaagaaaaccaaugucaacagacugcagggagaaaggagagugguaugagacuagguaaaaagaagagggcugaaucuugaagagccuugaggucauagcaaaaagccugaauuuaauucuaaggaugauggggaguuacuacagguuuuuuguuuugcuuugauagagucucgcucugucacccacacuggagugcagugguacaaucuuggcucacugcaaccucugccuccuggguucgagugauucuccagccucagccaccugaguagcugggauuacaggcauccaucaccaugccccgcuuauuuuuuguauauuuaguagaggcaggguuuugccauguuggccaagcuggucucaaacuccugacaucaagugauccacccgccucagccucccuauuacaggguuuauacaguucaugcagaauaccagaaagggagauggggacuguggggauggauacagguaggcuuguagauuugcuagagaaaauaagguaguuucuucugauuguuucucuuucuccagugaaauaagaagugagacaaucaacugauugagagagcuggggauggccauuggagaguugagguacaggugaagauauaaaauaguuuucucagaaaguagaaguauuagguaaacaaugcaggaucaccguguagaacagaggauccacugcagucagcauaguuguguguccuccauccauccacacucaggcccaaaguagguggaaagcugaaugagggucauaguuuugccagauaagaaugacagagaaagaugagcaaaggaguucagugugcauguaaagaagagaagaaccauagcaucugagcugagcaaggaggaaagugaggauacaggaggaugacggauuguacauaaauccuguaagucaacagauuggaggccccacaggaucaaagaacuguuggaguagagaugcuaaugucaccugaggcagcagcccugaaaagauaggaagugguggucagagagugggaugcugugaaacauacuuugaagguuagcauggcauuucauaacaagggcacuauuggcauuuggggaaaacaauucuucaucgugcauaacagucucauguacugaaugacauuuagcauccuuaacuucugcccucuaaauaccaguagcacuccuuacauuugcaauuacucccuaggagagugguacuuccuagauugugaaccauuggccugggguaugacuaugagguagggagagauauuugcaagugagaaacucagggaccugauagaccagguaugaguauucucuguggauguuuuuacugagaaugaugaguauaaagacagggcgcuggggggaacgucuucaauaaauacagaggaguaggcuguagaagaguuuuauggcaugugcuuuaaaagccucugcggaggaagagaaaaggaacugucuagaagugacaaugaacaauaccagaagacaccaacuccacugucagacacugagaaaaaaacagacaccccuggagagggugauggggaagccuccuuaagaguuugccaagaguaucaagcagcuauccaaaagaacuuucugugaugauggcaauguugauaucuacgccauccuauaagauagacaauaggcacauguacuucuuagcccuugaaacgaggccagugugucugaggaugugaauuuuuuacuuugauuugaacgaauuuaaauguaaacagucagauguggcuacuggcuaacaaauuggauggggcagaacaguaaaaggugaaggaagcauucagaagacaaaauucuucuuaaucucugagucuugaggaaaagggcaagggcagguaugagucuagggaaguuuguacauuuguagcaggaagaggugaggagcaucuaauagcacaauagcaucagcauuuccaauaagcaggauuccaaaaauucauuuuaauuuauuucagccuccucucagacuaaauucuauaccauauuguuguggaagacccuuaaaaaaaacccucaaauauuuaaaauaucaccaucauguaagaauuauuucuucuccuaagaagcaucugguauuaauagacuaugacuaucgcguguuuucuaagaucuaagugucccuucccuccaaagacuggcuaucuauaucuaacaaaggaaaauguaacauuugaaaauucccuguuaaaagauuuuguugucauuuggaaaucauauuucuugcuguuugcauuucuauuaaaaauauaaagaaauuuguucuuugguaucccaaaugaaguaaaaguauucuaauugguugcauucacaagucuacaauuugcggcuuaacaaaauuauuuuugaaaaggucauaaccuguacccacaugcccacccaaccacacacacagacauccagaauggucuugugaucaugucuucagaaguuuggcugcaaaguuacaagcaacaacuguccaucugcacccaccaaccuagugaacaaugccagucugggacccaaggacuauuuacucaacagaagaauuccaacuucaggcaggggauaggcgaaguccagauaacaucuagauauuucuugacauugcauuugauuggaaauaaaggaaaaguaaagcauuucugguuaguuucuguuucuuagugucucuaguucccauuuuauuucaaucaaaauaucaaaauacucuuuagcccauagaggggacagaguuccuaguuuaauaaacccuaaaauauauaauuaagauaaagccucuguaggguuacucagcacaacacuauaauugcucagauucccuaguggauucuccagucaauuucucugcauccuugaggcaaaaucuuuuccuuaauuguccucacuuagaccaggugcuagguguccuuccuagccugcaggucuuacaggcccauucaucccuaagggggucuuauauauuaaccuugcuucugaacucuaagcacuggcaagucaggcagaaggcccaaaggaccuaacagcccauagguaacuacaauguugguaagguggauucugccagaugccagccuuggauccauuuugggucccuacagauuuaugcuucuacuauaaugaauuucauaauuucuaguaugugacccaggguugaacuaagaaguuauucuugcuuuccccuuuaguuuucccuaaugggacuuugaucaacaugaaaacuaaaaauauccuggugcuagaccauuaacacuaguuaacuauuccagacuguggccacugucaaagacagccaucuuguaauugaauuccacuggggacaagaagacucaaaacagaguaggugaauggauugcuuaaaguccaucucagcuacuaaggagaaugaagagcagcagaaacugaauuauuaauucccaacucuauucacaagcccccucugguggaggaaguauuaguaaugaaacagcuauaacaauaaccaaaauuuuuuuaaaagagaaaaggcaauccacaacaaaacaaucagccccugcagaaaugagagucaaguguagugauuagcaaauaugagcugcaaccugaaaaccacuuacagaugaagcaguaugaugaaugauuuaccaaaaggucaacaccgcucuuuugucuucaucacccaucaguuuuccaucgcccucaauuugucuggcacauaacagaaagcagggcauaaaauauuccccauaaaaauuaaccuuacuuugcaacauuaaaaaaaaaaacuuauaguuguauauaguugaagcguaggggccagcuucucaauuaguacuccuagcauacaguagaaaaagcguugacacuuaaagcccuauuacaagagguaauguucuuagcaaguuccggaacucucugcccuauucuugccuugcugacccacuauucucaagcgaaggaaggggucaguaaucccccuaccaaauaccacaccaaugguggcaggaggggagcaugugacagcauuuccccuuuuacucuccuggaggccaaacuucuuugcaaucucugcuuuuagcuagcguggaugccagccuuucaaccuugcuaugccugcaauacuuucugacagaugagcuaugagauguaccaccuucccacucccauuugacaaccuuuguacaaaaagaaacacaacgccaagggaaaguauauuuuuaggcaugagggauucugaaaaugaacauaucugcaaacuucuagauccccuuaaccagaccugaaaaagacauuaaucuauuuuaacuaaacugauuaaauugauuuaaucagaaagcgggucacuucccuccucccuauccugucgcugaauuuacuaauuguuucuccggcuuugcccaaucaauaagauauuuugcaucuugcagauauaauguaaguuaucaguuauuaaaaauuccucuucccggucucugguuaaaguggguaccuaaauaucugcuuauuuauuuacgucguuguuauuugcagauuucuuuuuuaaaaaaagcagaauuaaaaugaaagaaaaggucaaaagaguuuggaaaaaaagcuaucuacagggauguucaucacugcaucauuuauaauaguaaaacuuggaaaucuuaaauuuccaagcaaaagaagacuguucaaauuaauuaugguauagccauaaaguggaauacagucaugcaucacauaaugaaguuuugaucaaugacagaccacauauaugauaucgaucccauaagauuauaauggagcuaaaaaauuccuacugcuuagugacguuguaguugucauaaagucauugugcaugcauuaccuuuucuauguuuagauaugcaacuacuuaccuuuguguuacaguugccuauaguauucaguaaagugaugcucacaagaguaugaaauugucuaaugacacaguuuucauuaagugaggcaugacuacacuaugcagacauugaaaauuaagugguggaauauuuaauaacaaaaaaagauuugugguacuauuaaggggggaaacacauugcaaaacaguagauacuguaauaucauauuuauugagagcuguuaucuuuguauaccauugguuugacaaacauucauuggucagccaucuuccauucauaaccucuucucuccagcauuccuugcacuugggaauuguucuauaaaauaaaauauuaaagaagaaggcugcuagguagggcuuuuuuuucuuuuuuuuuuuuugagacggagucuugcuuugucacccaggcuggaguggagauggagucugacucugucgcccaggcuggacugcaguggcacgaucuuggcucauugcaaccuccgccuccuggguucaagugauucuccugccucagucucccaaguagcugggauuacaggcacgcaccaccacaccuggcuaauuuuuuuuuuuuuauuuuuaguacagaugggguuucaccauguuggccaggcuggucucgaacuccugaccucaagugauccacccgccucggccuuccaaagugcugagauuacaggcgugagccaccaugcccggccuagguagggcuuuucuucuugucugauuaaaaggagcggauuuaucuaacaggucucuuuuuguauuuauccuuuaucuuuccaaucuaaacauaacgucuggaggaacagcagcuucauugugaccaugaagacaaaaaaauaacacgcuaagaacaguagaagagaaaugccaaaacaucagcucuagauuauccucuaaagacuuggagaaagucacuauugguuggauuuucuuuauuuugcagcugaacacauuccugauacacaggagauucuguuuuuguuuuuugcuuaucuguggcuuuuauauuuucuaccauaguauguacuguuuuaucauaagaaaaaaauacuggauacaagaaaaagggucuuuuguauucuucaagagaaaucuagaggcugugaguuggagucucaaaucauccaaggaacaaaagcacaggcaaagaagacaugccaauaauaaaauucuuagagcugcuuaacauuauuaauauuuucauucccuucaacagaaacuguuuacagcuauuaguauuacuguuuuucgagucauggaacacuuaagaucuacuauggugucaggugcuacuuaaggcaccaaguauccaaacaauaaggcagcccaugaccaaaaggaaccguaacaagcaaacgaagaggaaaaaccuagcaggguaaaacacacugccuaacauugcucagcugguuaauggugaagccaggacuggaaugcaggucucuugacaccuaacgaccuucaucacccuaucauaugcuuaacccacuuaccauuuagaagaaagaagugcagcuugcuaccagcacaacgcucucggagcaaacgggaaauggguuaagcauuaauaucuggcuaaaagauguaagaaaaacucuggugagaguauuuaaggagaaugaucuagaugggggucaaaaaacaucagagacagaccuuguucuucauuaacuaguauuuauaguuauagcaggauuguuuucccuaaauaaagggaaaggucucuuugaguggggcagaaaggauuccacuuuuuggcugggugcaguggcugaugccuggagucccagcacuuugggaggccaaggcgaguggaucaccugaggucaggaguucaagaccagccugguuaacauggugaaaccccaucucuacuaaaaauacaaaaauuagcugggcaugguggcgggcaccuguaaucccagcuacucgggaggcugaggcaggagaauugcuuaaaccugggaggcagagguuggugagcugagaucaugccauugcacuccagccugggagacaagagcaaaacuccguccuccccaccccccccccaaaaaaaaaaaagagauuccacuuuuuaucuaucuauaccacaccgaaucagucgaucaauccacugaccacagauuguaaucucggccaaccacuauaguggggaaagaaaacauagcagugcaaucagcuguuggauaccacaggcaacuugacaagucagugacaacuuggccuauuuauucaucuuuuaaccguuuguucuggugucuguguagucacaaucaaagaauagucccuaggaauccauggaguuucauugaaauggaguuagggcuuuggaucauaugcagaaucucaguacuauuccaggagaagggcagccacauugccucugaauggccaaaacauaggguagugaagagugggagaauaugccagcccgaaauaugccacuuuagccuaaggauuauguggagcuaaaggcacauuaaaauacaaaacaaaacccagcaggugcaagaaguguucucuaacccuccccuuuuucuuccugaaaacaugaaacaaaacccccauauagaagacguccagcuauaccagaaggaaagucucauucuuaucaucaaggaugggaaaaugagacuaggaaaagucuguacaaacagaucuuguuaaaauaauucuuaucuuccuuuagccuuuccacacaguugaguuacuuuuccacaacugccucucuuuguucaaccuaauauaaaaccaucuagguuuugccacuucuuugagucuucauuuccuuaugagguaucucaugucacauaaaacuuauauuaaauaaaugugugugcuuuucucccauuaaucuaucuuauauucauuuaagucuuaggcccagcugaaaagaaaacccuaaaagaguguacaauuuugccuccucuacaguauccaucuugaaagcugaaaguucacucucaauaugccuuaagaauaagaacaagugggggcauguuuuuuagccauaguuauucguaacccaaacaaacaaguaaaggauaauauaagugccaaaaauauaaauguugucuggauucacacauaucuuauuugagugacugucauuuuauacugucguaaucuguuugcaugucugucuuuccacuaaacuauaugcucccuaaacgcaaggacgauuuccuuucaucuuugcuaagaauguccaagccuuccuccuuccaaggcucgaacuggauuccaacuauaaaagucuauaaaauaugacagcuauuuggaccgaaauccuucauuccaaacuauccuacuuaaaaaaaaaagucaacuuuuuaacauuuccaaaauauccugaagggagggaaaaaucacacauuaaauucugucaaguaacauuuaccuccucaagcccugacuaaucggaaaugacuggacuuggcagcuccuuuuaucacguggucuaucagcuaaauuuagcuccuguugugccaauugaaaaaugccaacaucccuucccaucucauacaacaucccaacccgccaaugacucuagggucucucuggcaaucuggugugaccacuccucaucagaucaaaauauaaauuacaaaccaaacuuaaaguguccaaguagccccauccagaagagcaaugaugaaguuagaagagacgaagacgagaagggugccagauucauuacuauugauucccugcuggucuuucaaugucacggaaagauguccauuauaguucuaugaagagcauuuggcucaguuuaaacucuuuuguuuucaguuccuuuaaaaacaaaaaucaaccacgaaggauaaacaacuagaaauuaauggagcccaaaggguuucugcagaaugagaagccuucaucacugcacccuaauuauguaaaucugcuccugcagaguccaguacauuuauuuauuaagucucaccacugccauccugguaacccagagaagaagccaaucuauaaugacucaagccacauuucaaaauagacuccaaaggacacaugaugucauuugcuaaaaugacucaauccagauggaaagcauucugaccuauacauaauugauugaccuuugcuaugcuuuccccaguuauuuauauacuaucauaugcaugaauguauaucagugguauuuacacuuggcagcuacuuuuaagaacacauuauucaauugggauuugaagcuuuuuacgaccauuuccugaccaaacauucauaaaugacgaacaaggaaagauguuaucuuaaaaauaauguuuaauaggcucuggagaguuuagagaagcuuugcuacucuaguuauuuuaaauuacaggggacaagaucuauguacauaaagcugaguucaaacccugaaacugaggauaccaaaggacauuuuauuuacuuuccaguuuggagcucaauaaugauaguaaaauaugcuguacagaaggcauggaauguuuuagauacaugugagaagagcaucaacuguggugaagguaguuagagacaauaacaaauuaucagaaucuaaccauggauuucauuuuccaaaagagguuagcugcaaauuggauaauacccagauaaucaagauaguuucaagaugaucauagaaggggaggcagauagauuagggaaggcaaauaugaagcaagcaugucuuuacucccauuaggaauacccaaggcagacauccauaacugauuacugaauucuuaaccacagagcccucacuuggcucaaaauacuuuuccaauaguacuccaggcaaacaccaucaaccaaacagacuuguccuaauaacauaaacagagaaaguuguaucuuauuuacugaucaaauuaauucuauuuauuguuaccauauacuccaagauucaaucuaaaacuaaacagguuuuuaaauucaaaauuuaaagucacaucucugaauccuaagaaaacguuaagucaaaucuaguaguuuuccauacuucaugguaggcuagaaugacccuuaauguaaaugaaaagcaagcaggaaagcuaaacaggagaagaugaaaaugcuuauauguucacauaggaauauuauauagcagugaaaaggaaggaacuacggccacaugcaaccacaggaauaaaucuuagaaacagaaauccaaguggaaauagcacauggagaagacuacauacagcagugcuuuccaaguagugugccucaguaaguggguuacaaguguucccaauccccuuaguucuggggugaauaguaccuggaguagccaaagucuugugucaagccagagcauuuauaucaggagguucuagaauauuuucaaguucuauguaugccaugauggaagaaguuaggaagcacugacauacaauaauucuuuccagagauuaaaccauuauaaaaccauuuuauaauacuuaaaaacuaaaauguaucugcuuaggcauauauauacauauauauauauauauauauauauauauauauauauacacacacacacauauauacaugugacaaauuuauuucaaaaugauaaaagaaaagcaaggaaaacaugaauggauacuucauccaguacauccauucauucaguauaaugguuacuguuggaaacaauaggcaggagaugaguuagguacaaaaacacuucaguagaugguaauguuacaguucuuaagguagauggugguucauggguguuuaguuuauuauacuccaagcauauuauuuuauaaauacaacauguuauauacuacuuuucucaaaacaucaagguuaagaaggaaggaaacuuuuuagcugauucugagucaauuuuucacaguugaaucucaauauggcaauucaagaauagauacaacuacuuuuggaagacugaaacucagaggucaagauuuuguccucaugcaacuagaauaguccaaagguuucuaacagucaacucauguacccuauuuaaugauuacaagauuuuguucuaauccaaauagaguauuaaugaaaaauuguuguaaaccuaaaguuacauuucccuacugaaacaaaaacaucacaaaacccauauguaagccucuuaguuaagauccauuuaguuauaaaaaacaaaacccaaccugaaguguucaaguaaaaggauucuggaugaggaauuagagguauccuacagcacauaggauagcaaguacagccaggccuuaugaagaaccagagccaggguguaggcagccuuucagauccgagguugaaacauucucucucucuugggcugcagguucuugugucucuacuucuuucuggaaccuuuacuuuauugucccuaccuuuagcugugcuuuuucugcuuuggcaucgacaugaccaaauauuuguaucucuugugauuuaaguuuaaaccaaguagugcccugaagacaauuucaaaaugcccagaggggaaaaagaaucuaauuaacccaaccaaggucaaaaucugucuacaccggguuuaaucagacacagcuguacauaaggaguuaccaauuccaacaacuacaggggccaggcagguaauuaaaaguaugaugcugaccagguguaaaaccagaagcuggaagaaaagggucuuacaacaaagagaacucaugcugccucuccacuuuggauauguaauaauagaaauccagauuuucauugaaauuucuugauuuuuaaaauacaucuguauacguuaggccacaggcuucuacugucagcguccuacaaaaaaugaauugugaauauuucaguuucggggggucacacugggcaaaccugacuuagauaccagcccuuuggguagaagagcaggucucacagaagggcucauggucaggcaguacugcaacaaagccuggauuaugcacuacuuuacacacccuccccaugaaauacacacaucagcuaaacuucuaaaaauaucuuguucaaaaucagauacuaagccgggcagagauaaucaucauguagcuuuguauggguucauaguaaaaagcauuaaaaaacaaagaaaucacacaaaagcaaacuagagccagaaaaacacagcaccaucuucuucuuuucuuucuuucuuuuuuuuuuuuuuuuuuuuuugagacagaaucucacuuuguugcucaggcuggagugcaguggcgcgaucucagcucacugcaaccuccgccucccggguucaagcgauucuccugccucagccuccugaguagcugggauuacaggcacgugccaccacaccuggcuaauuuauuguaguuuuaguagagaugggguuucaccguguuagccacgauggucuugaucuccugaccuugugauccacccgccuuggccucccaaagugcugggauuacaggcgugagccauggcgccgggcccaucuucuuuucuguccacagccaaaacauccugccacaaaaggaccauuuguuacaaaacaacugcauauucuuuuuucaguuaacugaagguaacacaggcccuccugugucaauuucuucaccauacaaaacugggagacacagaagucauagcuuaaguaagugucacuuccucucggaagcccagccugagucccugaucuuguauaaggcaaaugucccuuuacaaagcaccuguuucccuugcuguggugccuaaccacagcacaacugauauuguauaugcacaacugucuauuuaucucuuccacauaggugagcuucuggaaagcacagauacugucuaauccuccuucucuguucuuaacaccuguuuguuaaauaaauacauucuguagucagacaugucaaaaauuuuauuuuuuaauuuuuagcagcuaauuuuaaaaaugcugaauuuagacuagauuccuccuuauucuuuuguacgcacuuaaaaauuuucaacaaaacacuuaaaaucuuuuacucagaaaagaacuacacauaucacucugaauuacuacagacucaauaucacauuguuguggggcuuucaagaaucugugcuuauauuuaagcuaaaaauccuucacagcaccuccugucaguuuguagauacgcauagauuuucucaauauaccuguauugauauagauauaaauauaccugguauagaauaaggcacgguaaaauucucuaccuagacauaaaacccauauauuuaaacuuaugagaaaucuggagaaguacaguauauacauguccagcaagacuuauguuccauuuuaaagaaaugagccuuggcaaauuucccuagcacugagaacuguuuagcaagaauuaauuuuuaaaugaaauaagcuaaaaauaaaauagauguaguauuauuuauacuuaagucuuguucuuuagcaauuauuaaagguuacacugguauguuuuaucauugguaacuggacucaaguuugaccaaauguuucucuuuacccaugaaaaauaguugcaauguuccaauuuugacugccauuccaggucuuugguggcccuucaucaagugcaauuugguagccuaaaugauaugggagggacagagcauaauuucauggcaguaaguauagcugagacagaaagguuaaacaagguccaugucuuuggacacuugacccuaaguuaugacagauuaacuuuaaaagacaauguuuuaucuugaacagaggggaguuuugucuucuccuuccagcuagguggaaguauuuggcaaaugucuucuuuggaaagaauuauuuagcaauggaauuauaaucggaauuauuuagcaauggaauuauaaucaauguaguaaggacagaaaaagcaaacuaaggacaaaggaauaaaugaagaaaugacagccacacuugccaaggugaauuccauucagggaauuugccaaaugaaaaggauauuaacauuaacuuaagcagguuuccuuacuucaggaauugucugucuuuaauauucauaaugguccucaugaauuuuccaaaggauagaguaugcagcauuuaugauuauuuaaaggcuuuauaaauguaacugcucuugggcauaguggugcuaucaggcagaccuagguugaaauucuggcucugucagcggcugugauuucaugugcuaauuucuuaacucuuaugagccucaauuaccuugucugaaaaaucagcccuuucauuuauauuucaacagaacuucugcccuugaugucccuuugaaguuauuucccauaauuagucacagaucauagcaucaucagcugcaaucaucuuaucuccauucuauuaacaaauuuacauacauucuuuuguauguucaacaaacagcauaugccaagcugagcuggcaacuggacaaaaacauauuauaugugguuucugaacacccagagcucacuaucuuguuggggagaaaggcagugaggaaauaguaaugcagagcagugacaggugcccauaagggguucgccuaguuuggagaggagaaaacauuugaguugaaaucugaagagagaaaaugaagccacuggagaugaagaaaacaaacuuccauggggcugagggaacaagaaugugcaaaugcucugugggaggcagaaagaaagagauuuugaggaggaaaaagggcaguguaguuugcgugcaaaaaccaggugagcaagaugggagaaucaggagaggcuuuuucuuuuuuuuuuuuuuuuuaaugucaacacuguuugguguuuauuuggugagccugagggcaauuuucauucucauuucuuuuucuuauugauuauuuccaacccuuucaacagugaacaugcguugcuuuugcaauuacaacaacaacaagaaucccuauagacaaagcaaaaaauauauacuuuguaauguuuuuaaaaaacaaagauuaaacuacacuaaaauauaaggugauuaucucugaaugauaaguuuuggggcaguuuuuuuuuuacccucaucacugcuuuccgaauuccaaagguaaaaagauacuacuugaauaagaagaaaaauaaagagaguuguguuucaagcuuucccucuucccuucuucccacccuaucuaacacuuggaauaucccaugagggucuccaacgucagcaggaacuaagagccaagagucgacugagagaugacuuucuuucucuuucuuuuuuguuguguggugaagaaagaaaucauaaucugacgucuaaagagcacuucacuguugcucuugguuggacucuaaaucacauugggaaaauuaaaacuacaaugagaaacaucuuacaccagucaugaugacuauuauuuuuucaauuuuauuuuuauuacacuuuaaguucuaggguacaugugcacaacgugcagguuuguuacauauguauacaugugccauguuagugugcugcacccauuaacucaucauuuacauuagguauauuuccuaaugcuauccgucccuccuccccccaccccacaacaggccccgguguguggccccggugugugauguucuccauccugugucuauguguucucauuguucaauucccaccuaugagugagaacaugcaguguuugguuuucuguccuugcaauaguuugcucagaaugguuuccagcuucauccaugucccuacaaaggacaugaacucauccauuuuuauggcugcauaguauuccauguuguauaugugccacauuuucuuaauccagucuaucauuguuggacauuuggguugguuccaagucuuugcuauuguaaauagugccacaauaaacacacgugugcaugugucuuuauagcagcaugauuuauaauccuuuugguaaacacccaguaaugggauggcugggucaaaagguauuucuaguucuagauccuugaagaaucgccacacugucuuccacaaugguugaacuaguuuacagucccaccaacaguguaaaaguuuuccuauuacuccacauccucuccagcaccuguuguuuccugauuuuuuaaugauugccauucuaaauggugugagaugguaucucauugugguuuugauuugcauuucucugacggccagugaugaugagcauguuuuccugugucuauuggcuccauaaaugucuucuuuugagaagugucuguucauauccuucguucacuuuuugaugggguuguuuguuuuuuucuuguaaauuuaaguucuuuguagauucuggauauuagcccuuugucagaugcguacauuguaaaaacuuuaucccauucuguagguugccuguucacucugaugguaguuucuuuugcugugcagaaacucuuuaguuuaauuagaucccauuugucaauuuuggcuuuuguugccauugcuuuugguguuuuagucauaaagcccuuacccaugccuauauccugaaugguauugccuagguuuucuucuaggguuuuaugguuuuaggucuaacauuuaagucuuuaauccaccuugaauuaauuuuuguauagcguguaaggaagggauccaguuucagcuuucuacauauggcuagccaguuuucccagcaccacuuauuaaauaggaaauccuuuccccauuucuuguguuugucagguuugucaaagaucagauuguugucgaugugugguauuauuucugagggcucuguucuguuccauuggccuaucucucuguuuuuguaccaguaccaugcuguuuugguuacuguagccuuguaguauaguuugaagucaaguagcgugaugccucuagcuuuguucuuuuggcuuaggauugacuuggcaaugugggcucuuuuuugcuuccaugugaacuuuaagguaguuuuuuccaauucugugaaggaagucauugguagcuugauggggauggcguugaaucuauaaauugccuugggcaguauggccauuuucacgauauugauucuuccuacccaugagcguggaauguucuuccauuuguuuguauccucuuuuauuucauugagcagugguuuguaguucuccuugaagagguccuucccaucucuuguaaauuggauuccuagguauuuuauucucuuugaagcaauugugaaugggaguucacucaugauuuggcucucuguuugucuguuauugguguauaagaaugcuugugauuuuuugcacacugauuuuguauccugagacuuugcugaaguugcuuaucagcuuaaggagauuuugggcugagaugauggggauuucuaaauguacagucaugucaucugcaaacagggacaauuugacuuccucuuuuccuaauucaauacacuuuauuucuuucucuugccugauugcccuggccagaauuuccaacacuauguugaauaggaguggugaaagagggcaucucugucuugugccaguuuucaaagugaaugcuuccaguuuugccaauucaguaugauauuggcuguggguuugucauagauagcuugcauuauuuucagacacgucccaucacuaccuaguuuauugggaguuuuuagcaugaagcauuguugaauuuugucaaaggccuuuucugcaucuacugagauaaucaugugguuuuugucuuugguucuguuuauaugauggauuauguuuauugauuugcguaugugaaccagccuugcaucccagggaugaagccaacuugaucgugguggauaagcuuuuugauguccugcuggauuuguuuugccaguauuuuauugaggauuuuugcaucgauguucaucagggauauuggucuaaaauucucuuauuugguugucucacugccaggcuuugauaucaggacaaugcuggccgcauaaaaugaguuagggaggauuuccucuuuuucucuugauuggaaugguuucagaaggaaugguacccgcuccucuuuguaccuccgguagaauucggcugugaauccaucugguccuggacuuuuuuugguugcuaggcuauuaauuauugccucaauuucagagccuguuauuggucuauuaagggauucaacuucguccugguuuagucuugggagaguguauguguccgggaauuuauccauuucuucuagauuuucuaguuuauuugcauagagguguuuauaguauucucuggugguaguuuauauuucugugggaucaguggugauauccccuuuaucauuuuuuauugcaucuauuugauucuucucucuuuucuucuuuauuagucuugcuaguggucuaucaauuuuguugaucuuuucaaaaaaccagcuccuggauucacugauuuuuugaaggguuuuuugugucucuaucuccuucaguucugcucugaucuuaguuacuucuugccuucugcuagccuuugaauguguuugcucuugcuugucuaguucuuuuaauugugauguuagggugucaauuuuagaucuuuccugcuuucuccugugggcauuuagugcuauaaauuucccucuacacacugcuuuaaauaugucccagagauucugguauguugugucuuuguucuuauugguuucaaagaacaucuuuuuuucugccuucauuugguuaugugcccaguagucauucaggagcagguuguucaguuuccaugcauuugagcgguuuuugaaugaguuucuuaauccucaguucuuguuugauugcacuguggucugagagacaguuuauuauaauuucuauucuuuuacauuugcaaaggagugcuuuacuuccgacuauguggucaguuuuggaauaagugcgauguggugcugagaagaauguaucuucuguugauuugggguggagaguucuguagaugucuauuagguccaccugcugcagagcugaguucaauuccuggauaucauuguuaacuuucugucucauugaucugucuaauguugccaguggaguguuaaagucucccauuauuaucgugugggagucuaagucucuuuguaggucucuaagggcuugcuuuaugaaucugggugcuccuguauugggugcauauauauuuaggauaguuagcucuucuuguugaauugaucccuuuaccauuauguaauggccuucuuugucucuuuucaucuuuguugguuuaaagucuguuuuguuagagacuaggauugcaaccccugcuuguuuuuuuuuuuccauuugcuugguagaucuuccuccaucccuuuaguuugagccuaugugugucucugcaggugagaugggucuccugaauacagcacacugaugggucuugacucuuuauccaauuugccagucugugucuuuuaauuggagcauuuaguccauuuacauuuaagguuaauauuauuaugugugaauuugauccugucauuuugauguuagcugguuauuucgcccauuaguuggugcaguuucuuccuagcaucaaugguguuuacaauuuggcauguuuuugcaguggcuguuacugguuguuccuuuccauguuuaaugcuuccuucaggagcucuuguaaggcaggccugguggugacaaagucucucagcauuugcuugucuguaaaggauuuuauuucuccuucacuucugaagcuuaguuuggcuggauaugaaauucuggguugaaaauucuugucuuuaagaauguugaauuggcccccauucucuucuggcuuguagaguuucugccaagagaucuguuguuagucugaugggcuucccuuuguggguaaccugaccuuucucucuggcugcucuuaacauuuuuuccuucauuucaacuuuggugaaucugacaauuaugugucuuggaguugcucuucuugaggaguaucuuugugguugucucuguauuuccugaauuugaauguuggccugccuugcuagguuugggaaguucuccuggauaauauccugcagaguguuuuccaacuugguuccauucuccucaucacuuucagguacaccaagcagacguagauuuggucuuuucacauagucccauauuuccuggaggcuuuguucauuucuuuuuacucuuuuuucucuaaacgucucuuccggcuucauuucauucauuuguucuucaaucacugauauucuuucuuccacuugaucgaauuggcuacugaagcuugugcaugcaucacguaguucucaugccaugguuuucagcuccaucaggucauuuaaguucuucucuacacugauuauucuaguuagcgauucgucuaaucuuuuuucaagguuuuuagcuucuuugcgauggguucgaacauccuccuuuagcuuggagaaguuuguuauucugaucuucugaagccuucuucacucaacuugucaaagucauucuccauccagcuuuguucccuugcuggcgaggagcuagguuccuuuguaggagaagaggcacucugauuuuuagaauuuucagcuuuucugcucugguuucuccccaucuuugugguuuuaucuaucuuuggucuuugaugauggugacguacacaugggguuuugguguggauguccuuucuguuuguuaguuuuccuucuaacagucaggacccugagcugcaggucuguuggaguuugcuggagguccacuccagacccuguuugccuguguaucaccagcggaggcugcagaacagcaaauauugcagaauggcaaauguugcugccugauccuuccucugaaagcuuugucucagagggguaccuggcugugugaggugucagucggccccuacugggagguaucucccaguuaggcuacuugggucucagggacccacuugaggaggcauucuguccguucucagaucucaaacuccgugcugggagaaccacuacucucuucaaagcugucagauagggacguuuaagucugcagaaguuucugcugccuuuuuuucagcuaugcccugacccuagagguggagucuacagaggcaggcaggccuccuugagcugcggugggcuccacccauuucgagcuucuaggccgcuuuguuuacccacucaagccucagcaauugcggacaccccucccccagccucacugccaccuugugguucgaacucagacugcugugcuagcagagagugaagccccgugggcauggaacccuccgagccaggcaccagauauuaucuccuggugugcccuuugcuaagacaguuggaaaagcacaguauuagugugggagugucccgauuuuccagguaccgucucucacggcuucucuugacuaggaaagggaauuccccaaccccuugcacuucccaggugaggcgaugucccgcccugcuuuggcucaugcuccgugggcugcacccacuguccgacaagccccagugagaugaaccggguaccucaauuggaaaugcagaaaucacccaucuucugcacuccucacgcugggagcuguagaauggcgcuguuccuauucagccaucuuggaaccuccucccaugaugacuauaagggaggcuuuuaaaugguggaaaugaaugguuuccaccaggacaguggcaagauucaauuaucauuuuaaaaaucucugucaagcuacaguguggaaaauggauuggaaggagacaauaauggcugcaaggguaucaauuaagaggcuauuguagcaaggaugauaauuuaaacugcaauuggaacagaagauaugguaaaaugugacaaaucugagagauauuuagguugguaauuaauuggguaagagaacugugguacauuuuacacauaaaguccuaaggugcaguauuugauuuggucuauaaauuguacuccaaaucagcugaugcuuuuauaguuagagagaauuaucucaguagacguaauacuucucuuucaaaaacugucaugguucuuaaucauauuccacaauggucaguauggggauguuuaugccucauggaauagagaaaucaaaaauuuaaaucuauauuugauguuaaauauaaauaguaucuucuuauaaaaauacauuaccauuacucuuagcuugauauauuguaaauugcuuuauucaccuccucagccauuuuucaucagcaguaguauaugugcucccuguuccuggcagugauucacuggaugagaacauaaauguauuugugggaauauguaugaacguugcucugggaacaaaagaaacaguucuguuauaccacauuggugguaaucauucuuucccaaaaucauugcuugaucccuuaaacaaacaaaacaaugugaaauaacaagcauugcaaauaccuaagacuuugguguauugacugccuaucugucaaauuugacaggaaggauuaaccaugguuucaauauuuacacuuggauuuugaaagacuagauaccaaguugaugacucuuugaaaauaauauagaaaaguauauauaaauacauagguaaaaaggaugggacaaaagugucaaugguuacugcugaaauaugguuuuggagugcaaguauaggggauuucugcuauucauuuuaugcuuaugcaauguuuaaguuuuaggagcagguaucaguuucuaagaaaaaucgaaaaaagagcagauaugaaaaacaagaucaauaaaauaguuucacuguuuaauaaugccagguuagugagaggcaacauucaucauggaaacuaaaugcauuacacuagacuuucacuauuuauaauuauuuuucuaggaccaugaucagacuggcccacgguauauaaucuacaaauugacuacugauauuguaagagggcucagccauauucaaauaccaucuauuaaaaaaauuaaauaugcuaauucgccacuacaauuuaaaauucaacuguagguaaauaaaaguaaauugugccaauaugcauguggaauuacuugcuucugaucaacuaaaaaaaaauuaguaagaaaucuggugaacaucguauugguaaacaaaaacaauuuuuaaaggaaaguggcaagauccauguccagucugauccaagguguugccagaauggcagcccgaguugagagcagaaauguguuucuccucacaccuuuccaacuuuuaggcuguggucacuucaaacuaagaagcaaaucacaucuuagcccauguaguaaugagguuauccacacuagaaugcauaaacgucaccuuguggcuuguuaaaaacacagauucuugcccaucacaagauuauauuaaacugacuagggucucuaauauaaugaugaauaaaaauggaaauaauaaacacauuuaugaucucaacaagaaaauuguuaauauuucaaauuaaguaugaagucugcuguaggacuuuuuuuuuuuuuuucgagauggagucucacucugucacucaggcuggagugcaguggcaugaucuuggcucacugcaagcuccugggguucaaacaauucuccugcuucagccucccguguagcugggacuacaggcaccugccaccacacccagcuaguuuuuguauuuuuauuagagacaggauuucaccauaguggccaggcuggucucgaacuccugaccucaugauccacccgccuuggccucccaaagugcugggaauacaggccgcccugcccggccccugcuguaguuuuuuaaaauaaauauuuaucugauuaaggaagcucagcucuauucccauuuugcugagauuuuaccaugaaugaauguguuugucaauuuuuuccccuuaucuauugagaugaugauaugguuucucaguuuuacucuauuaauaugguaaguugcauugacugauuuucaaauaaucagcuuguauuccuggaacaaacccaacuugauaaugauauauuauucuuuuuauauaucacuggauuugauuuaccaauguuuuggcuaggauuuuuuuuucauuuaucuucaugaaaaaaauugaacuguggauuuauuuucauuuaauaccccucaucuuuggggucaagguuaugcuggucuaaugaugugaguuuacauauaacugauauugcuucuuccuuaaauguuuggaagaauuugcugguaaauuuaaaugggcucuuuuuugugggaagauuucuaauuaugaagcuaauuucuguaauagauauaggauaauucagauucccuaaaaauauaucaaauuuaguuguauuuuuaaggaauuuaaccauuucauuuaaauguucaaauuuacuggcauaaaaucuuacuaauaucuuuuuuagugcuuuuuuauuucugauuauuauuucaauaauuucugcucuuaucuuuauuuucuucuacuuucuuugcauuuauucuguuucuuuuuuagauucuugauacugauuacuagauuacuaauuuucaggcuuucuucuuuucuaagaauuuaaggcuauaaauuuccauauaaaaacugcuuuagcugcaacaucaaagcuugauauguuauaucuucauuaucagaaauauuuuuaauuuuuguugugauuacuuucuuugaaacauagggaagaaaauauuaccuaauuuccaaauauuggaauucuaucauuaucauuuuauuacugauuuccaccuuaauacuacugugaacagaagauaaacucuaugguuuaaagccuuugacauuuguucagaagugcuuaugucuagguauauauuauauuuacuaaaucuuuaaaaauguauaugcuuauuugguuguugcaguguucuauacauaagauuaaguuuguuacaagugguguuugaaucuucuauauguuuacugacuuuuuuguuuguuuuguuuucagacagggucucccucuauugcccaggcuggagugcaguggcaugaucacagcucacugcaaccucugccucccaggcucaagugauccucccaccucagccuucugaauuuuuugguuuuguagagaugggguuucgccauguuuuccaggcuggucuuaaacuccuacacugaagcgaucugccugccucggccucccaaaguguugggauuacaggugugagcuaccaggcccagccguuuacugacauuuugucuucauauucuauuaacuaccugaagagguaugguaaaaucccaacuaaggcugaagauuuguauauuucucuuuuucagugcuguuauuugcuuucaaauauuuugagaccaugcuauauguaccuauacauauagcuaugucugcuucuuuuggaauacuguguguuugcacaauguuucucuuuuuacaacuuugaaucuuuauauggauuuauauuuagacuguaccucacauaguuagcuuauaguugucuuguuuuaauaauccagucuaauaaucuguuuuuaaauagaaguauuuaguguuuuguauuaauauaauuaagguuauauuuauauucuuaucacuaucuuaauauauucuuuauuugucucacaguuuucuguuccuaaauucucuuuuugucuucaauuaaucaaauauauuuuauauuauccauuuucccccucuaucagcuugguaacuguacauucuuuaagugguuacccuggaaaugaaaauaugauuucuugacuuauuagaaucuaccauaauugauacuuuuauccugucuggauaaggauuucacauuauuuuaacuucauuuaauccacucucauucuaccuguuauuguuuguugccuuuauuuuaauuccacaaauauuuuauuuuucaagcuuuuuauuauggauaauucccaacauauacaaaaauagacuuaauaaucuaaugaaacguucauauuuaucauccugcuuuagcaaucauuagcucaugaccaaucuuguuccaucucuauccccauccauuuucucuccaaauauauuauuuuaaaacaaauuccaaacaucauauuacauuucuuaugacuauuucuguauguauauccaaaagaugaguaugcuuuuuauaauauauaacuaugaugucauuaucacacauacgaaaaaauaaugauaaugggccaggcgcaguggcuuacaccuguaaucccagcacuuugggaggucaaggcagguggaucacuugaggucaggaguucaagaccagucuguccaacaugguaaaacccuaucucuacuaaaaaaguacaaaaguuagccgagcaugguggugugugccuguagucccagcuacucaggagucugaggcaggagaaucacuugaacccgggagguuucagugagcagccugggugacaagagugagacucugucucaauaaauaaauaaugcauaauaccaucaaauacucuggaaauacucaaauuuccaaaugucucaaaugugauaaccauuuuuauagguauuuugaaaucaagagccaaauaaauucugcauacugugauugguuuauuuguccuuuaagcuuaauuuaaccuauugauucucccucaaucuuuuuuuuuuugcccccuugcuaucuaugcauuggagaaaggggcuuguuggaacugaaguuuuccacgcucugauguuuuuucccccauggguauuguauuaaauaaaaugcuuccuagcuguaauuucuguuuguuugcaguuagaucuagaggcaugcagauucaaguucauuuguuuuguuuuugguaagauuaccucauggcuagugguuuauguucuuuucucuuuucccauaaauauucagggccuggauccguuaauucauuaaaauaaaaaaauaagaauauuacacuuuuaaaacauuuauuagcaggaauccuauuaucaagagaaaauucccccaucuauguuuacuuagucauacaagagauguggaacaaaugcuugauuuuuuacauuuguauaccauuuuucaaaacaacaaauugguucacuaacaucuuuccaugguaaccaaucgguuauaauuauucuuaauguuaugaacucauggauauaaaauauuugaugaauuugcaucugcugcaguuacugucaaugagugcuuaaauuguucuaucuuuaguuauaggacuuacacuccacuaaacauuacuuugauuguuuuaaacaauccauauucauagacacuuacuuauauauuuauacuuuuugguguucuucaugcccuccuucauuuacaugauuucaacugggacuauuuccucugacugaggagcuccuuuuaauaguuuugauauagauaugcugauaauuaauuaucuuaguuuuaauuuucuaaaaauguccuuuuugaaggauguguucgguagguauaaaauucugaauuggcaauuacuuucuuuuggcacuuuaaccauggcaucccauuguuuucuugguuccauuguuuugguuuaaaaauuagcuuuaugucucauuggugugccuuugaaaauauaucuuuuuuccuuuggaugcuuuuaagaugcauuuauuugucuucaauuuuuaagcaguuuuacuacaauaugccuccauauuuuauuuggcuuuuuuuuuuucuuacacaguuucuugaauccauggcuugauguuauucauuaauuuuggaaaauucuuuacugcuauucuucaaauaauacuuaugccccaucuucccugaaaucuccucuugggccuccaauugccugacacagaccuuuacacuaaccaauaugucucuuauaaaauuuucuuuauuuuugcauucucuuuuccacucugcuuuaaucuggauauuuucccuugaucuauuuuccagaucaugaauccucucuucuguugugucaacucuauuauuaaaccuaucuacuuaguuuuaaauuacacuuacuguaauuuuaacuuucauguuguacauuugauuccuuucauaggaucuagaucucuggugaaauucucugucucuucuugaacauauuaaucucuuaucugaaacagauuauagcuauagaucuuauagcuccaauuucucagucacuuuuggaucuguuacuuuugguugguuuucugucuugauuauuggccauuuguucuuguuuccuggcaugccuacuacuuucuagugaaugacagauacacuuuuuauggaaauuguacaaguuuugaaugauguuaucuuucuccaaagaugauuugauuuucuucuggcaggcagauagaguacaggaaaaucaucuuaauccaguugaggcugguauauuuccaguuugcucuuacccuagguuguaguucuucaggggccucaaggaccuugaguauuuccaugguccuacuucuuugaaagcccugaacucugugagacacugagacugcuacaauaucugcuuugccauuuacuccuguaucagauauuuucagcuuuauauuuuguugucucucccugggaguguacaaaaaggccucaagggaaaauuccaugcaguauguugaacuuacaucucuguggcuccuuuccucugggaucuuguuuccuccaguccuuuguugguagcccugaacuccacuggucaggaaagaauuuaagcuauuuccacuuuagaaacuaaaaucuuaaguuacgcuccuuguugauguauucaugcuuuuauuuucccugauuuuuaauauuuuaaaagcuggucacauucucaucauuuugguaugaucacaaagaaacauguaguaauggaaaacaaagaaguauugaccuucacuaggcaaucaacccucagauaaugucaggaaaucugaagcuuucucaaguaggaguauggaagaguggagaagggagauguguuauuuaucacagacaauacucagcacaauuuuauugcuccuuggggaauccaaagcuuuuaaagaugauauuauuauuuggaaggccuccagagagcacuaaguauuaaaaauagcaccugcauucugcuaagucaaaucaccuguuuauuauccagggugaugaaaaucauuuaauaaaauauuacagacgcuuguucaaaaucaugcacacaauucauaggcucagagacauuaaugucuaugccuggcucacuacauauuuguuaaauugauaacucagguggacauuaguuaauauuaccacuuuuuaaaaauuaaugauaucaaguuauuugaaauagccaguagaaaaccucugcaguaacauuucccauuuuuccucauacaaaauuuacauaaaaccuuugcuuuguaauagccacuaucuuuuuucuuuagagaaccuucuccuccuccugccuuuagaauauaaauauaagaaugugacucaggucuggucagucccuguucaucccauuggccagaguuauugguucagaaaugagcaugugaucuacauuauuccauugagacucaguacuuggauuuuaugaacacuacuggaaagagaauugcugcugguugguaaagggauagaaugaaagauucaaugugguuaucaccacguaaugaagaccugccuaagacugaagccaaaacuacuuaaaacuucucaguuacaugaaucaauaaaugcccuuuguugccuaagccaguuuauuaggacuggguuucagaccuggaaccaagaguucuuacuaauauagcuauaccaaaaaaguguguagcagcaaccaagucugucaacaagagugauuaacccucagguuuaagaacaaaacugaaaagacgcaguagcauuaggaacauguuuuuguggugauaagauuuauuccaguccacugauaauguuuuacuuucccaccuacauuuacaggaugcccaagacaugaggccugaaauuuaucaauaauaucaaauaacauagccccauucuugaaguuccaaaguuagaguauuauuggcauuuuucaccuauuccucacagagcuuaguuauuuggggaugaaguaaguuacagaaguuuccaaaaaagaaggaaaucucuauguguuucauguuuuuaaaauucugucuucggcuuuggcuuaaguuaugguuacugaugguagcuguaaguaauauucccaggagaaaggcugcaaauaaaaugagaauuccucagcaucuuuauuguccuucaaguggacacgaauucaagcaggugcacauacugaggaucauacauuucuacucauggcauuuaauuaggaggaaaguaaaaugugcagggccagaacuuuaaauauuaguuuaauaaccuuuaugcaccuaauuucugaaugauuuucuuacucucuggagaggcaucuaaugucagacaguggcauuaaggugaaauuaaggugagucaugguaacugaaaagccaugaggcaggcacaugucagaauuauuaauuuuaaaggauauaugaaauauuuucuccucugaaaauaugcccaguuaauguaugcugaacuugaaguauggcuuuauuucccucauucacaacuaaucacugucuccaggaggaacagacuaaagagagaaagauuacaaaagaaguauagccauuucaaaauccccaaacaaaugagaaaucaaaagaacaaugacaagcuuguugguuauguagaguaaaauuuuuagugugccaaucauggcugauaccauguuuugaccaugucaaaauucaucaaggcaggaguuuucaaaccuuuuuugaauaugacccacagugaaaaguauuucuauaucuaucuguaauaugacuguguaugcauauacauuuacaaaacucuuaccaaauuaaaugaacucucauauuuucuauucuauauaauuucacuaaaagcaaucccuaaauugucucacaacucaccaguagcuuacaaguugauauaaaacauauaauuugacauauauuccacaucuuaggcuaagagaauuacacauauucaaaucauuaccaaugccaauuucagauuaagacuguucugaaaugaaaucaaaucaacucuuucuacacaguggaaauucuuagaccguuuauuaacuucacuaaauauuuucauaaagcauuugaagcaagaugcuuucuucaggauaacaccuccaaacauacuuuguaucuuucguuuuucuuuuucuuuuuuuuuuuuuuuuuuuuuuuuuuuugagacggaguuucacucuguugcccaagcuggagugcaguggugggaucuuggcucacugcaaccucuaccuccuggguucaagugauucuuuugccucagccucccaaguagcuggaauuacaggcacaugcuaucaugccuggcuaauuuuuguauuuuuaguagagacaggguuuuaccacguuggccaggcuaaucuugcacuccugaccucaggugaucugcccaccucggccucccaaagugcucagauuccaggcgugagccaccacacccggccucagaacauacuuugaaacaacccaaugcaagcucaccaccucaaauccagauccaaagacgacacuaucuuuaaaacaaacaaacgaaaaaccaugucucuauaaaaaggaaugaaacauaaugucacagggugauauucuaaugagacaaagagguagucccauuaucuguuuuguuuuaccuggugguaucaacuguuguuucaucacuguuucugugaagaacauguuuucuuaaugaacccuugagaaggacagugauuugaugaaugaaagaugugacacaugaaacaaaauauuccucauuccacaccuguguauauaauaucauuuggcucuccaaauuaucuuaaaguuugaaucucauuucuuccuuccucaauauuuucuuuuaccauggaggcagggacagcaaagaaauguuuccucuccagauccacuauuaacugaaaauuccagugcucugaauacuuguuuuuuuuuuuuuauuuuuaaaaagggaccugaauuucuauuaaaggauuuccuuuauuaacuccugcugaagaauuuacauauuggcagguuggaaaguaagcccuguaggaaagaaaucggacuuguuuuucaucaucaacaugacggucugaugauggguguaugaguuuccuguugacacccaugucacauuuacugaauuacuguugagaccacaggguagacccagcuuauacaauucuuuugucuucuuucugcuucacagaucauucauaaucacacacgggguaaaaaaugagggagcgaaaauuguguaagcuaauuuucacuguugcuggaagcggaagcaaauaguucucagagcugagagugaaccuggguggugaagagcagucagcauuaccgguggcaaguucagcauucugaccaaaaugagccacucugaacccugguguucagucaauggcgguuuccucaaauuuguccuuaaaaguugaaauguaucauacuucugcucagccacccuuaagaaacuugaguguaugagugugugugaaauacaaauaaaaccuacacagcuauugucuggauugaacaaacaagcaaaugugcucaguuuuccaaacaauugcagaugcuguaauaauucagaaaagugugugcugagcagugggggaugcuggcaugcucuguuagaaucauuguggcugggugcggugguucacgccuguaaucccagcacuuugggaggcugagaugggcaaaucaccugaggucgggaguucgagaccaggcugaccaacauagagaaaccccaucucuacuaaaaauacaaaauuagccaggugugguggcgcaugccuguaaucccagcuacucaggaggcuggggcaggagaaucacuugaacccaggagguagagguugcagugagccgagaucucgccauugcacuccagccuggacaacgagagcgaaacuccaucucaaaaacaaaaacaaaaagacagagucauugcuaaccauguugcuuagcacaauuuuggaaggaggcaugaugcuggcacagaaaacccuugucagaaauuccuauuccuuaauuuuaugcucuuucuuucauucuuuucucacuucauugucauacaggcaagugaaaaagaguggaaagagaagaggcggugucaaaggaaaagagaaaaaauacaccugacuccuguuguuuaugauugucuugucaguuaacaccugggcaaucaucaaccauguacuuuccuugagccagguccuuaaagaacccaagaugaaggaaguagacagaagcagcuuuggggugguuaggguagugcuucuagaacuuuaacguggcuacagauuucuugggagucuuguuaaaauguggauucugauucuagaguggggccucaaauucugcuucaguuggugaucuuguuaaaaugccguuuccgauuaugggguggagccucagauucugcacuucuacucuuagggaaacccaagccucaggguuagucuuugagccuggggcaguggccuauccugggccuuuuucuuuacagguauuucacuugacuacuucuccuuuuuucaggggccugcaguaaagagaaauaaagcaugacauagucugaaaagcacugguucuagaaucaaacaaacuuggguuggaauuccaacucugcaacugauuugcaaucuguguggucacaggugaguuuuuugaaucccucuuaaauucauuuucuccaucuauaaacuggguaugccauuuuuuaacucucagggcagcuacaaggaacaaaugagaucaugugcaucaucagguagguucacauucauuaugaaaugaaugacuaaagagccuaaagcacaaccguucuaucuacagguaauaaaaaggaagguagggugcaacaauguuuaaauacaucuuuauuuuucuuaauaccaugacuuuggcucuuccuuagaucuacagcuauggguuguguagaguuguaaccacauuaagccaagcaugucuucccauuucgaauacuuuucugacuccagaaauucauucucugaucaugcuuucaguaaugacaaaauccagaacagauuggguuuuugaaaauauuucuugcuauaucaaaugaggaaaauuugaaaauauuucuugcuguaucaaaugaugaaaauacaucugaugauuuacuugcccucaauuaauucaguucuuaggcuugcucuucuggacuucucuggcuccuguuuccaacaacagauuucccuucuucucaagcuccccucuucccagucucucuccuccaaucugaaauugggcucccuuugcucccauaguaaauaaggcaaaagugucccuucauucccaugugauccagcuggggaaucucaguuucucuaaaggaaucaagaagauacuucagaguuaaccagaggaauuaaagaaaaaacaguuaaugccagccuucuccaaccuucccacaucagcagacugaacaaagcgcucaaaacucaggguuuaauaaagagggaaaaaggaggaggagcuacuuuauuggguguaguagagacaaagagggaaauagaagaaaauugugaaguagugacauuagcugccauguccuaccuccucuggcaguucuccagggcagacagggcuggcagcggauggguguuauaacuccuauggaucaugccugacccuucugggcccgucaugacuucuguuuagaugacacuaaagggucucagggcagcaucagagcaggaaggaugugccaaccacagaagugccaacucaugacaagaaucauugcucauucagggauugcugccccugccaucacccccucugucccaggaucugcauuccgcuguucucucuccugcaagcugugacagcagaagaggggccuccuucccauuagcucauuuccaucucggacuuagucaaaggaauaaauuauugucagcucaucugucuuauuagauugagccacaugauauugccauguuguugcuccaauacuggcaauuucaugugauucaaccucaucugcuguuuagagaaaggaaguuucacugcuaugaaaaacuaaaccauuucuguggcugagcuaugcugaccagaacagaguuaucucaaauucaucuacucaaaagcugcauauuuuaaacugaaaugcacugagcgucuuccuuaucccuacuuuccacauuucuaagacaagauaaauucagcaacauucuuuagaaaacauuccaucuccaacagcaacuaucagucaaacaacagggaaucauugugcauuuacucuguauaaagcauaagaaggauaaaaaaaauaaacacaacaucuuuucugucccuaaggaguaacugacguagcugaagaaagaagaggggaaaaacaccacaaaaaauguaaagaaugaagcaacaauauaaggaaugucacaagacagaccaugaucauuugcuaaaugaguggaauggaaaauaaguacagugaguugagaggcaggagcaaucaccuagaaucugaugugagccacuuucuaucuaauuuagcucaucaaucaccucacccucccaccuacuuacugugggaaguuaucacagaaaaugaaaaucuccucucugccuacucauaacucccagaugucgguuccagaaauguaugcccagcaggucucagaccacucccacucauuuauuggguccaucucaggaaaagaugggggaauggggacauuuacacuggaugcuuuucuuucucuaggugaagucagcaugacacaggaaaaugggagaaaucuaaaugugugugccucaauauaaacuguagccaccugguagccuagcacuuuuccugacuucaugacuccuuuuaauucugaauuucaaccuuucugagcaguugccaauaguaaaaaaaaugacauaaauuuaagcauacuacaaauaccuguuuagauacaaaugaggucacauuaacaccucacagccccccuauuuuagcaauucccugcgugcucucacucacacaaucucccaugguacccugcucuuccucucugcugagggccucccucuugaggacaaugccuagccauggacccugucucuaguguccuccuggagaaggguguuuccuuucccagggggucauagccaagggcucugcaaggcagcagcagcccuggcugccccaguacuucuggcaugaaagccaugcugggauguuccaugcagaaaugcagauaauacccuucugcccaacacugucacccucuacugccuggguugaauaaaagugaaaguuugcuaaggucccaaggcaacaucucugaccaggccuuuucuccuucuccccuuucuuccuuccuuuuuuuuuuuuuuuucuuuuuuuuuuuugacagagucucacucugucacccaggcuggagugcaguagcgugaucuuagcucacugcaaucuccaccucccagguucaagcaauucuccugccucagccucccgaguagcugggacuacaggugcacgccaccacuaccagcuaauuuuuuuaaaauauauuuucguagagaugggguuucacuguguugcccaggcuggucucgaacuccugagcucaggcaauccacccgccucggccucccaaagugcuaggauuacaggcguaagccacggugcccagccacuucuuuccuuuuuugagacagggucuugcucuguugccaguacuggaguacagugauaugaucauagcacacuguagcuucaaacuccugggcucuggugagccucccuucucagucuccugaguagcugggacuacagguguacaccaccaugucuggcuauuuuuuuuuuaagagauggggucuugccauguuacccaggcuggucucaaacuccuggacucaagugauucucccaccuuggccucccaaaaugcugggaugaaagccauugugcucagcccucacccuccacuucuaauccauaagaaagacgugucaauuuuaccuacaaaacaucccucgaguccuccccuucacuccaucucggcagauacccuguugguugcuuauuaauuaccaucaccucuuaccugggccucuaccacagccuccuaauguccugcuuccacucuugcccuuccaguucauucugcacaaagcagcaagagggaucuuguaaaaagacuaaauggaucaugucuuccuagacuuaaaacccuucagugcuuucccugcuacacucagaauaaagucaaagcccuuggcccuggccuacggggccuuccaggacuuggccccagccuugcucuacaggagacuguccagugaagguuauaaacucaaaguccacugcuucccaugagaagccugggucagaauucugggucuucuguuuaccaugugaacuguggagcuuugggccagcuucuuagcuucccugcacuucaguuccuacacauggaaaguuacauaucucacuggauuauuagaaauaaagugagauacaacguauacagugcuaggaauauugccagucaauaguaaaugcuucauaaauauaaucagccuggucugcuuucauuucuucgaacacaucuuuuccacuucagggccuuccauuuguuguccuuucugcucagaaugcucucccuccuccccguuuguacagaaaggccuucccugacuaacagaucucaauggggacucucccugucucacucuguuauucucuguugcaacucuucauuuccuucguaucacuuguauccugugauaaacugccauuauuuucuuucuuuggcuauucacugcuuauugucuuucccuuccaugagacuuuaaucuuuauaaguauuaccauugaauuccaguacuagaacaucauuuugacucagggauccuucaagagcuuccaucacuauuuaaauuuuuacagugaggaaguggaugaaucuuacuaaucucucaucucauggucuauuuccauuuggcuuuuacuuaaaggguccucuuucuguggaggucagaccaacucucuggggcaggguuggacaaaaaacaccaugauugacucagucuccccaacuccccugaaaguacauauaagcuucuuuucaaggacuccuugccuucuuggacagauauuuaacuaaguaaccucugauggcuccuuuuaucucaauccgauuuaccuucucucuuguguguguguguguguguguguguguguaaugcacacacuuacuaagauguuggcuuagcccagaguccucagaaagcacagccugaggcaaaaucuuacauaauccuaauuuauuggaaugugccauccagggaaggaagagggagagaagaaggaaaugaggaagggacggagaacaagcagauagauacaaggguauauuucugagcuggcugccacuguuacucagcacaacugaugucagaucuccaggacccaucuucugaggcaggcugugugaaugacagcuccuuuggacaauaagucaggguaagaaggagaugaauuccagguugcacauacgugggagcugagccaucuagugcaucacaggccucaguggcaacaugggagcccugggggagaugacaggcugacuugagagaaugggagcagucacuguaacagccuuuggcccuuggcagcaacaaugucagcagcauuagugaccuggcucuguaaccaugagagcagcacaaaccaggcaagcauacagaucuggaggauggccuaaacuaagucucguacugauggguaggaaggugaugacuguccaaauguaguguuugaggauggcaagcaugggacauauaggcucaccacuccugaagcuugcacucauggcagacaucuuuguacuuuguacuuugucuggcugagcccaaguacagccucaaaacacuucuucauacagagcuguaaucagccacuacaucacaacaguaaugcaaaugaugacagcauaagauaaaaaaaauuguaauucacaccugaaaugauaaagacaaaaacaguauaaagcuaaugaaaaugaugaauuucagaaagugaaaaauccaccaaagggaagcccuuccagagcaucuuccaucuaacccagcuccauagcccagaaaucagcgucuguggaucuucuugauauugcaggaaaagagaaugccauucaaaugacagcuuuuccagaacuggaauucuauguacaaccuagcaucacagcucucaucauucuguauuugaugacaguuuuguggguuucauaucccaaaaugauaccugccuaauucacagagcaaaguuuauuucauuuaaagcaguucugaucaggggaaaauguuucauugugguguuauaaggaauugaucugcuaauguucuucuuaagcuuugacauuaauuacagagaagaugcaucaucauuucuacugacccuucauuccacccccaccuaccaauacacccacccaaauguucagagcuuuguauaugugucuuaauaaucugucauccaauacuuggcaagugaaaugugcuaucauaugguaccaagaauguucgcagcucuggcuaaaacuucacuggaucugauauuuaagccuuaguggugaucuaacauaggcagagaacugugcuaagaacugauagaugcagaagugaauaaaacacugccccuuucccuuagaguaguaaguuccaaacuaaaggauagaacccaauagugggucuugacaucaacuuaggaaauuguaacgagaaauuuuaaaagcuacaauagaauugaauauaguagaacauaucucaaauaauaauaaaggguauaguuucaugaaggggugugugugugugugugugugugugugugugcauauacauguauuucuuucuguaggugaucuaacaguuugaaagccuaaguuuuccaaaggugaaaaccaucauucaaacacauaaugauaaaaauuuacguauagagaaucccuggagucaugcagaaucaacauucaguaugcauacaggauggcagagauuaguacuaagggggccugauauucaggcaauggugagaaucuagaguuugccuucuaaagcccacauuccucauauuacucucugcucagaaaccacuguaugugcccccaucacuacagaacguaauccaagcucaugaguauggcauugaaggaccuccaagcuuauuucccacuacucuucaccuccucccacaccuucuugaugccauacuguugcuauaaucauuuuugccauuuugaauguguucuguguuugaauacguucuguguuuuuuuacuucuggacccuugcacaaacucuuccuucaugcuggaaugucuuuccuucccuaucugaccacuaaaguaauauacuuacaguggucagccuuuguuuugucucuccagcaagcuauccgauccuccuucugguaauaauauuuucuuuccuuugagaaacucccugaaauuucauggguucuguggucaaucauaaugccccacugccuauggccacaggagaagcucugugacaaacauacagugauugguugaaaaaaacaagcaugugaccuauggcagaacauuauacucuaucucauguacagacggguacaauuccuucucugaauucuaacagcagcccucaaaauacagugagcauaauaauuaccuggaagacuugcuaaaccacagauugguuccacccccagaguuucugauuggauaaauguaaauuauggccugagauuuugcauuucaaauaaauucccaggugcguuagcuuccuccuguugcuguaacaaauuaccacaaacuuaguggcuuaaaacaacauaaauuuaucuucuuacaguucugguggucagaagcccaaaacaggucaagguguugacagggcuguuccuucuggaggcuccaggguagaauccauuuuuuugguucucucagcuucuagagguugccugcauuccuuggcucauggcccuucucuugcaucacuccaaccucuuacugcuguccucagaacuccuacuacuaacgcuuaccuccugucucccccuuauaacgacccuugugguuauauuaggccuacugagauaauguagaauaaucucucauucucaacccccuuaacuugaucauaucugugaagucccuuuugccauaagagguaacuuaggccugaguccuuucaccugaggauuaggauguggacaacuuugaggggucauuauucagucuaccacaccaagugaugcugauccugauaguccaggguccacacuuugaaaaccaaugaauuacuaucacuaucaaagccagccuaguauuuuauucuuuagucugucugccucccacuagauuaagagguugcagaggcuggaauagaucuuggccuuuuuaaaaauugcuuuaauucuauguacauucuccuuucugaauacugguaaauacaucuuucaguuaaacuggaggaauagguaaacagucugaaaugcugauagaaaagaaaacugugaagauaaaaccccaaaguggagagguauugguuaauaggauuaucuggauuccuuacugccaacaguaaaucuuucuaccuaauuaugcucccaaauuucaaauuucucuauugcugacaacuaucgccauuuugaugccccccaguuauuucucauuuuucucaaaccaaauuuguguagcuggccagccuauccugaguucuaccucaugggcucuggaugucagagauagcuucaccacacacucaagaacucaagccagaaauuucaccagcaucauaggaauagccgcugacaguuauucccccacugauaugugcuuggcaacguucugaguucucugugggcacuuacucauuaauucuuaccauucuugucuuguccauuuaaaaaauaucucccauagugcuuuacauguagcauacauacacuuuauaagucuacauugcuugguucauucaguagaccauaagcuccuugagggaagggaugggucuuauucaucaucuuguugccaggaugaaacuaugucacuuguaccucauauuacauuugcaguaaaauguuagagagaugagaccauaugugagcaguuggaauuaagucagucaaguugaaguggggucuaacaucaaauugccuugaaaagcaggcagaacuuaaaacaugauauaauaggcaucucagagcuagugcaaaauccuaagcaagagcauaaagcuaauguugggagcaggccccccaaaaucuggccauaaacuggccccaaaacuggccauaaacaaaaucucugcagcacuguaacauguucauaauggcccuaacacccaagcuggaagguuguggguuuagggaaugagggcaaggaacaccuggccugcccaggguggaaaaucacuuaaaggcauucuuaagccaugaacaauagcaugagcaaucugugccuuaaggacauacuccugcugcaguuaacuagcccaaccuauuccuuuaauucggcccauaagagauacuuuuaguuaauuuaguaucuauagaaacaaugcuaaugacugguuugcuguuaauaaauauguggauaaaucucuguuuggggcucucagcucugaaggcugugagaccccugauuucccacuucacaccucuauauuucugugugugugucuuuaauuccucuagcacugcuggguuagggucucccugaccaagcuggucuuggcaagcuaaaaucauuuuauagagccaaaucaguaaguccccaguuuagcuuagaaacaaucagacaaggaccaaaggcuuucuaggagguaugauucuuugaagagacaagggagauugaaauugaguccauaaaauucucuuccaucuuccugauucuagguguugagguaucuguccuuuguucuuggugauuuacuauaucugauugcaacuuagaauucaaacauuaggcucugccuucuuuuccauccggauucuaaaaucaauaucuuuacuaugacgcuuauucccaggauuaauuuaugaaauuguaugaugugcuuugaagacugaaggcuucuuagagagagagggaaugucaccuuguacuaucaaaccaguauauuaaacaguuacugcuuuaaaaaucagauguuuguugguugagaugcuauuaaaucuuaaccuacaaaaccagcacaugaucauuucaaugguacaaaggcaaacuaaauauagcagaugacaauugcuacaacauaagagaaaaaauguaauguaauauuuuaaccauuuaguuauaugccacaugaaaauaaauucuuauaaagaauaaguuuuagcacuugccccauuugugugauaggguaccuaccaugugccaagggcugugcaauacugugaugaacaaaagaaucccuacgugauggagccaucaaucuaguggacaggauggauauuuaauaauuaugaauaauuacuacauaaucacaggacagaauaaaaugaaggauuuccaagagcaaugugaacauagaaccaaauauggagcauaucugaggaaacaagaggcuguccagaggagaccauauuccagcugagauuuuaagggcaaaugagagcugacgagcagcacagaaggggaaagaaucuuccagcauuugaucggcaugauacauaaaaggagaguagcagggcaugggcugggaaccuggaggccuguucaagacuguucagccuugacaagguaaagggcaagaggugauauauuuguuugagcugaaucucucagcauuuugcaucucaagucuccuaguuuuaaacaacuuucuagagaggaggcugcucuuuauagaacugaguauauggaagacagccuugagaaccuuaaauucaaugcacuguguagaauauaaccaugauucuaaacgauacuuguuaaaaggcuuuuuuuuuuuuuucaaauggccauggcuuuguuaaaaaaaaaaaaaaaaaaaaaaaaaaaaacaagauaauuugguaacugaguagagacaggacagguuuuucuacugaagucuuugguuuauggauacaccuauaguguuggaaggaagcauuuguauuuuaagguaucuuuccuagguuuguugcuaaguucauggacagcauacccccaugaagaugacaacacaguucuucuaagacauuauuuauuuauguauuuauuuuuuaggcagagucuugcugaagugccauaggagugaucacgguucacugcagccucagccuccuuggaucaagugauucuccugucgcagccucucaaguaucugagaccacagguguguaccaccacacuuggcuaaauuuuuuuucuuuuuuuuuuggagagacaggggucuugcuuuguugcucagucugguccugaacuccuggccucaagugauccucccaccucagccucugaaagucuuuuaagauaucauauuacggaaacuuuaauuaagcucuugcuacauauaagacacuuugcuuaggauucaauguauaucuuucauuuaaccuucacaacaacucuaggagguaggcacaauuauuauucugcuuaucaacguugucaacugaaguuagaaagguuaguaaaucuuugaaguucacacagcaagucagcagugaggcuguuaaucccuccccacuguuaaccaggaaaacucuacuucuguuaaauucugaucauuuuuugcuaaagggguuagcagugcuuuugacucuuuuauguuucccuuugauuuaccaucuaaugguuauugcuacaguguuuaauaagcaaugcauuaucccugggcaguggaaguaauaucauuacucagagacgguaaacagaaguuugcaucugugcacugccuggagguggaagcaucaauaaaagccugagguggaaggaagagaugaaugugcaggcuugaaucagaggcaagggacgcaauuugaugugggguaauaagaaauucugccuaggcuagcaaagaaacacaauccuuuaccacuccuagccucaacugcacuguuagauuucuccuaacacugcuuuucuuugcuccacaggguacaacagucccagccccgcccaucacacccacaacccuuauguacgcccaagggugccuggcaugcaagauucuaagagcaauggguugcaagucccuuugacaaaguuugccuggggaccaggaaauuuaagucuacauccgaggaccaaagauauuuaaauuaaaaacuuccuaccaaauccaacagcagcuaagagaguggcgaaugcgauauuacagaaauuggucugcagccuccaaaugccaaaguggcagcuuguuauuuaugauaagauaaggagcagcucguuacuaaagauauccaugucaaccccacgcauugagcagaacaaaggaucguuaaugauuccugggcuugucauguuagaaugggguggcgaugauaaaagagcaucuauauaugcuuuccuugugacauuucuuauuuuuaaacuccaauauaaaaauauguguuaauuguuaugauuugugucacaugcuaugcuccagggcuggacaggaaacaguguccccauucuaguauuuuuauaauaagcaauaaacaaacaauaaacaaugacaacaagaagagaaccacuuuccaggaucauaugauuaguucugacauuugggaaauugcuucauugccagaagucaauucccgcgauugcgagcaucuuccacacauaaaauuaauaaugugcccagcuccccuccugccuucauuuuauuauaugaaauuuggaccucccacagcauguaaagucacauuuuuaaaauaaaacuuucuuccuuuauaaaauauauaaggaaaugucuuauagaguuacacagaccuuugaaaacauacauuuuuccauuccuuuguuuauucaggcaauacccguuugaguaccuacuaagcgccagguacuuuucuagagugaauaugacaaugagggaaaacagacaauuauuaauauuccaaaugaacaaaauaaguuugguaguaguaaguguugggaaaaaaauaaaguaagucaacgugauagagagacagguccuuccuaauggggacggggguggaggggcggucagagagggacucucuaggaaggugacauuuaagcaacaaguugaauuacaagaaggaaucagccauaaaaagaucuggagaggagcauuccuggcagaaggaauggcaaaugcaaaggcccagugccggggacaagccgggcuuguucaagaacagaugaaguucaaugacccgagggcauugaggagggcccaguggaugcgggaugaggucagggagugggggcaggagcagaucagguggggccuugcaggccuaaugaagacuuaguauuuuauauuaaugacaaggacagccaccgaagguucaaaucucggaaaugauagauucuauuugauauuuuaaaaauuacagcugucugggcgucaugggggaagaaaauggacaaaauuguguuccacucaaagauagcauuucccuuacagaucccaaggcccugucuuugucaguacggguagugauuaagaacauagugcuagucagaaaaccuagguuugaauccuugcucugccaucaauaugccaugugaucuuagggacuccaucaaacuuacuaaagucuucacgugaaaacuauaauaauaacucuucccagagucuuggugaaaauuaaaugagauauaacacauaauacagaguaguguuagugccuaguacuugauacauauaauaauagcuguuguuguuauuauuauuauuauuauuaaaauuaggaagaagaaagagaagcauaagguaaagcacucagcaacuacucugaucauucaggugagaauacagacuuaugggagacaggauggagguuuccaucagcauagagcaucucugugcuccaggcccuuggacaaaugucaccucuuuaauguccugaagacauuagguagaaucuagaccaaaacagaauucuggaaaaacuggaaauaauucagaugcucaccaacaggaacaugaaucuugauaucauggaugcaacucacaaauauguugauugaggaaagcuagacaggagagacuacaugcuguguaauuccauuuagaugaaguucaagaacaggugaaacuaacugcuguugguagauaucaaagcagugguaacauuauaagggaccguauuuggaaaacauuuggaaagagcacaagggagccugccagggugcugaaaagugcucuauaacuugaucuagauggcaguuacaugauggauauacauauguaaaaauaucaucaaaccauauacuuaaauuagcauacuuuauaaacuuuuacugauguauguguuauaccuuaauuuaaaaaaauauguauuucaggggaucagaaagucagcuacauaaauaaacaaauggugacugcucucuucaggaaaacgaugaccucaggacuacuuaggagccaguuaauuuccaaagcuacuucccguuucuaaguuaaacagcucugcacauaaugucagccacagcaauggcaaagaaccgcagggcaggugaugaaaaagcucggcuuagcagcaggacaauggggaaguguguuaaacugggaccaugaccaacuucccaaaacccucucuggugauugccagugccugcuuaaugccuuaccuuucaauugugcugaauuugucugcauuaaaugaaaguucgagggggcaggaucacuucuuuuuuguuuuagaaauauagcucaaguaccugugugcucuauaaagaauaaaaauaauaacaggaggccguggaacaacugaaguauggaacauguauuuagaaaguacuuucuggcauuucaauaaaggaaauucagagggcuuccagcauaagaacaggauccgaauggauucauuuuccugauagagugacccaacccacaaugcaaagucauuaagucccaucgcguggcauuaaaaaaugcuuuuaagcuaagaucagccgaaaaugugcccagggcagauuuuuauggccauaucaucacaaccugaaauucaaauuggugaacuagcuagaaauacaugcucacuagaaugguucagaguuuuucugcaucuaucucagugaaaaauguuagcaaaggaaaccuuauuuuccuggaaaaacacuaucaaauaauaaaacaauucaggaccaguuuucacaaaguaauaacaggccauacauaauugauugccuuuagucuucgucucuggguauuacaaaucacaguuacuagcgcaucgaacaagcuuucauuccggauucagacuguccgucuuggcacugccugaaacggcuugagcaccuuuauugcacacuuuacugcauuguucuucaguugcuucuucagugaaguucugcuauacccaacaauguuauacccuccuucuuucuguguguuuacugacugucccugaugguaggcaaaaaguaacuucuagaagggaacugauuuagacuuaugaucucaccucaggcuugcaaggcaauacacaccacccagggagauaaaacauauuccuaugaaaucauauccuaacucucuccauuaaaacucuagaacugcacuaaaagcaggaaagauauacuaaaauuauaccaauucuuuggcuuaccaaacaucaggcagcugcauccauaaaaaaaaggaauaaauaauucauuccaaaacucuuuuuugcacaucucaaggcucauaacauugguuuguaggaggaggucugaacgagggccuagaaauucugaguuaugccuuggcuauaacaggaaccugaucccucuaucuuacucucccuuuguauguacggcuaaugauauacaccugggcugccagugacaguagccaugagccacgugccuauugagcaccugaaaugugaguagucugaaaugagaugugcugugaguauaaaauacacacaggauuucagagauuuacuaccaaaagaagaauauaaaauaugauucuuuaauaauguucaaauauuaauuacaugcuguacaugccgaaaugauaauauuuuaaagauauuggguuaaauaaaauauacuauuuaaauuuauguuacuucuuccauugaacuuuuuuaaugugguuauuaaacauuuuuuuaaguuauguauguggcucacauguauuucauuuggaugacaaugaucuagauauucugaauugcuaugaaagcuaagauucucuccuuguggaaauggguaauuacaagccuaacaguuacgcaugucuuaaaggauggagaacgugggggaagaggaagcaaucaagucaccaaguguauuacauauuuaguuauacuucaauuuuccuaagcacauuacaaaaagaauggaaagaaggaagaaaaacaugcacaguccuucacccuccugagacagaaaugagacugaaaauggacuuugaaaucaaaccauuucagauuagaauucugccucuaaccucaguuucuccauuuguaaaauggaagauaagcauacucaccuuuuagagaauuaaauaagaucaugccgaucaaguacuuaaagcaacauugggcacgguugggaauaaagaucuuggcaccggagauguugaaccuggagcggaagggacauugagaccaaaauguccauugggcaaugggaaucugagccuggagaccaauaaaaagauggauagaugcaaguguccuagcaagcaagccgcacaggugagaaaacacuaaaaccaggaagggagcuggugucacauaagcagcucacacuucauggaaacaucacagcugcagcugagcuccagccagucguucccaugaaggaauaauaaugguacaguguugccagguuuuccaauuuucuaagagaaucuagaaauccagcuuuuuaaauguuuagaaauuuuaaaaaauuuaguuuaauuuaaaaagcacucauuauuccagagagaacccacgggaaaauaguuuaauaccagccaggcgcgguggcucacgccuguaaucccagcacuuugggaggccgaggcgggcggaucacgaggucaggagaucgagaccauccuggcuaacacggugaaacccugucucuacuaagaaauagaaaaaauuagccgggcgugguggcaggcgccugagucccagcuacucgggaggcugaggcaugagaauggcgugaacccgggaggcggagcuugcagugagccgagaucgugccacugcacuccagccugggggacagagcgagacucugucucaaaauaauaauaauaauaauaauaguuuaauaacucugcugcugccucaaaggucaacaagguaacuuguuagauuucuaccauaugaaaguuaacggggaucucagaugaaauucccacaagcccccaaacaguugagcugccaaagaugaagagggagauuuaccucuuccuccucccagcucuucaugcuguaggaacacaguugcugcgacuacaggugucccagcggucuuucccucuccccagaccgugaccuggauguuaugcagaauguuucaaagagagcugcaaaagcacaaggacuuuuuacaggagacacgugacauaaaccaaggugcuacuccggcuauuauccauugcccgcuuuaggucucucuggaauauugucuguuuccauuucaggcacucucagcuacuacccauuuugguuaauaaauuaucauauuguguaaauguauacaaucuguaagccuggaagaacugucuggaaaaaggauuuuuaaaauaucacacuaaaaaaauaaauacuaguggccucucuguaucuauuguaaggaguaaaaggauuuacaccugaaaaauuaaaauuacaguagcuacucuuuccucaagugguucuuagcaaaugcauuuuaaagaggaugacuuuccagugaacacuuuaauuuuaauuuaaccuucccagaaaaugaagugcuuuguguagauucuuuugguuuuauuuaaggcauaaaaauuaguucugaacugugauaauugugggcuuaggaauguaaucauuccaagcaccacuucucacuugcuuauaagcccuacaggucuugaguugcuguuuauugcuaauucgaaguuggcaaguuauuuaacugugaagcugaacuugaagucagagugugacgagauggugggagguagauuguuuuguuuugcuuucaacagguuauccaaagcccggaugcaaaaugcggugcaagacacgguucuagauaugugcuccucuaacucuuaaucuuaauuaaaaugggaugaugaaauguucuaaagguggaauaaaauauuacauuaaucuauaacucuaucuugucaaaccaaccacagauaggauacagguuccuaucauccacccuuaugauuuuguucuuaauuguggcauuuuguuguugcugugaggacucaaccuaaauacuauugcuucuauuugauuguuuaaaggaaaauaauguaacaagcuuuggucaugaaaaaucguaauguccauaauacaguagaugcagcauuucuaaacauuuuagaauuacguguuugaauccacgaccacauacucacauacauauaaucaacauuaaccaaagggucauauggcgauuuuuuuccuuuauaauaaagagauccucugaaacauuuuaagauaaaugaauuccugcuuaaguaugggugcauuugaagugagaaugcuuugaauaaaguuaucauuuucacacaccacuaugccugaaaguuaugagcauucagacagaaaucauugaagaaaacuuaauaaaaauauguuuggcauaugccguauuuagugugaucaauaguguuuaguaauucaagaaaugaauuaaaauuucacccucauuuugccacuccuaaauuuccauuugaaaaacaauaagagaaauuauuaacucccugaauauuucuaaugggcuucucagcauuauugaguaaaacuaacuccacauugcaggccugugugcugacucagguuuccaagguuucucugggaacucuuuggucuguuguugcuguucuuuauucuuuauugaaaggcauuuccuagugcauuuccuaauuuuaggcaccuggcuagacuuuggggaugaaacaauacauguggcagaaucccugcccuugggugccuuacccucuccuucauacagcaucuaauggauccaaaaccagggagaaggugcaccucacagccacaggcugcaacagagaaagguaaagugcugguacuaccugguuuguguuugucugucugucucuuucuuuucuucuuuuuaguaggugucaauauuuuacauaaagaucuaaauuucugacuucucuuaaaaaaaaaaucagaagaucuuagcauacuggaccagaaagacuacuuggcaacaucuggcugaagcuguggggugggaguguugagggggguguggauggugcacuuuuccuagucaucucuggaucaaaacuggcucuaguuugccaguguucccaccacucccuauaguuuuauacucacucauauccauuaccugcuuuguccucguauuacaguauuuacauuacugaccugcaagaaguaacuagcagucagaaagccugauacuagcccuuggucugcugcuuauuaaauauaugaccuagcaugaauucgugaauugcauaaugccuuggagccucaguuuucucuuaaaaaagauuaaagacaaaacaaaacaaaacacgccuucucuggcacugcaauugcaaaucuccaaaaagaaaucuauggagggguuuccaaaccuggaaagcauuaggccaaggaauaauauuauuguaauuuuguuuucagaagaaauaucuagaaaaucagaaauaacagccuauaucugauuauaccuauaaagaucacaaagcacucucaacugaauuaaaucucaugugaccucugagauaaauaucacuuuagccauuuugaugaugaagaaacucaggcugaaaaggaccaagggauuugccccaacaccaaaugcugacauuuuuaaaaagucaacuuucaagauaguucccauaauuuuaacaccuaugaagacacuauuaacaacugacaucacaugaugaaacaauaaccaguaagaugagccaucacuuuccaaggauauacucuggauagagaguagcagcuucuuugagcuuucguuuguuugcuuguuauucaagagcaacauuuuuuaaaggguauuacauguuguaauauaaaggaaauauuuuaaguaaauauuuguaauagguacucauuuggacuucuaauaaacuaguaggguuaaagcuuuugaggacgcacuuucucauuaaauguuugucaacauuacauuauuuucuuagagauugucaucagcaaguaacuucuaugagaaacaaauguccuuaauuuuauuaaagucuacuuuuauuaauccccucccuaccccuaauugagcuaauuugaaccauagugccauucagaaagaaauaugagaauucaucuggcucauugucacauacauuuuuuccacaaagaaccuaauagaguuaaaagcuugauuuaaacaugaauuaaagguuuaucauuuaccuuuaggaacaaacucuccauaggaauaguaagcucuuuuaaugcauuuacauuuuauuaggcuuacagacauucaauuuauuggugucuuuagguacacauuuacugcauacagucaaauauauaacaccuucauaguaacuuuuuuuaaaaagagaagguagacuuauuuaaguuuuuucaugguucaccauaauucagguagcgaagucuaaaugaacaagcagagggcagaugagugacuuuaagugcacaggagaucuccacauaguaauuuagagacaccgugggaaauaaauaaggagauacgugaaagaguaaccagcucuuggcaggacauguauaugacugaguaacaugcaaacuacuguuuauacauugcaaucagcuggcagccaagcaaaaagcuuauagaugaguaaggacacugccacagccauguuuuuguucugaaccuccugauuaaacaaauaaacucagacuagagagccacauggagaauacaaugcuagggauacaauacaauagaauacaauacacuuagcaugcagggucuaaauauuaacagcaacugcagaagauaucacugcagauuugaguaaacuuucugaaacaauaaucuacaaaaccagcuguguuuggugauggcucuucauaaaaacaaacaguugcaagaaaucuaacaggauuccaagcuacaguucuuagcuuauagauuucaaacacuggagagaaaugcauaacaucccagcuuuuuauucuccaaagugaagauuuugaaagcaaauaggauuacuaucuaguauggucaucauaacauuuuuuaaaaagacauuauuauucuggaauaggaaguauaugaucuccuuacaaugaacaauuccauguagaaaaagauagaauaucugcaaagcacuuuugagguagguuaagguccugggaaacagauuccucaugcauuuagcuugaagaaagguuuaaaaggaauucuuuagggaucaacaccugcagaaggaaagggaaauagaggaggaagcaggugagcugaaggagaagucccaaugguagcuuguggggaauaaugaagauggggugccuuagcgcauucuggcaguuguaaaaaauaucauaaacaacagaaauuuauuuaugauaguucuggagacugggaagcccaucaagguaccaucagauuugaugucuggugagggcccacuucugguucacagaugauggcuucugucuguccucacacaguggagggacuagcaagcucccuggggccucuuuuguauaggcacuaaucccauccaugaggguggaaccaucacaacuuaaucaccucccaaaggccccacuuugaggguuaggauuucaacauagaaauguuggggguacacaaacauugagaccauagcauggaauguccugagugagggugagaagggaggggccuuuuuacccuccagugaucagucacuggaagcaggccaccucaugaaggagguaugccuuugggagaggguugucuaugggcagcaccacagcaaguagggugauaagcccuuagcuccuaaaggaggaccugagcagugcauuacagaguccaugcgacacuucuguuccaggcuagauaaaauauuuuuaagcucuggcuguaaggacagucaccuuuaagcuuuuaaucuuagacaaccaucauaauacaagggcuauuugagacacaaugguaagacauuaaaaggucaaagcauauaaugcucuuacuguccaucagauaacaucuccaggaaaaucaguccugcugcucuuugauaccaaauggcuucuuagguaucagaucugcuggcuuguucugaaaaaagguagagugaacucauuuuucucuacuccuucccucuaaauacccuggaaguuauucaacgggaagugauaaagaacucuaaaaccuggaaaaaaaaggagauagaaacugacuaggggccuuagcacuugagggacaacaaccuggugaguuccgugggguuuccuuuuuauuuccaauauacccuaugccggguuccagagacggcugcaaccccaaaacagcaacagggagagccugcucccucuggucaaaugaccaguaaagaaguccaguagagaccuaguggggaagccccagccccagccccuacucuaccacuagggcagcgaugggcagugaggcccuaggccaucccaaccauauaucugacaaagaauuacuaucuacaguauauaaauaauucucaaagcucaacagaaaaaaaaaacaauaaacaguuagaaaaugggcagaaaauaugaagagacagcucaccaaagagcauauacagguaguaagcacacaaaaaaauauucgacaucauuagccauaagagaaaugcaauuuaaaaccacaaaaauauuguuacauaucuaucagaauggcuaaaauaaaaaagcagugauaacaucaaaugcuggugaggaugcagagacacuagaucacucagacauugcugaugggaauguaaaaugguacagcuauucuagaaaauaguucagcuguucauuuuaaaacaaaaaauaaauuugcuauauuacccagaaguggcacucucgggcacuugucacagagaaacgaaaacucauauucacacagaaauuuaaacaugaauguucguagcagcuuuauuuguaauacccaagaaaugaaaauuauccaaauauccuucaauggauaauggucaaacaaacugugauauaacauaacacggaauauuucuuagcaauacaaaggaaugaacuauugauacacaccuggaugaauaucaaggaaauuaugcuaaguaaaaauuaaagccaaucucaagaagauacauacuauaugauuacuuuaauauagcauucaugaaauaugauaaucauagagaucaagaauagaguagugguggcuaguuguucagaaugggguagggaauagguguugacucuacagggguagcaugagggagucucugaugaugggacagugaaguaucuugauagugguugugguuucaugaagcuacacuuaugauaaaauugcguagagcuacacaugcacacauauacacacacaaaugaguaccugcauaacuggucaaucuaaauaagcucuauggauaugcauuguacuaaugccaauuucuugguuuuuauauuguccucuaguuaggcaagauauuaacauuggggaaaacuggaaaaaggguacacaggcccucccucuacauuucuuuguuuguuucuguguaucuacuguuauuucaaauuuuaaaauuuacuuuaauugacaaauaauacuuguauauauuuagggggugcaaugugauguuuugauauaugcauacaauguagaaugauuaaaucaagguaauuaacauaucuaucaucucauaauuuauuuguggugagacauuugaaauuuauacucagcaauuuuaaaauaugugauacauuuuuauuuacuauagucacaaugcugugcaauagaucucaaaaacuuauuccuccugacuaacugcaaauuuguacccugguuuuugcuuuuauuuuugagacaaggucuugcucugucacacaagcuggagugcaguggcccaagcacaguuuacugcagcccaaucuccuggguucaagcaguucucccaccucagccucccgaguagcugggacuacacgcaugugccaacaugccaggccagucuuuuacuuuuuguagagacagguucucacuauguugcccuagcugguuucaaacuccugggcucaagugauccucccaccucggccucccaaagugcugugagccacaggcaugagccacaggcauuagccacugcaccuggccacuuuauacccuuugaucaacaucuccccauucccucucccuaucccccagccucuagugaccaccauuccacucacuacuucuaugacaaaaauuaaaguuuguuucuuuuuuuuuuaauuaggcccguugauugcucaggguaagaaaucguaauaaaauucuagguauuucuuccuuugcaaugugccagcaucugcaucuaucacuggaaaguggauugcaaacccaucucagaugcccacaccuccauuaaccucuccuacucccggcccaauuuccugcuccauaccccuucugauaguugcuugccuggaaucccuucaauggcuuagcaaacucuauggcaguuccuggguugcacuucaacacuuucuugacccuggcccaccucuguuguaaucccuuucucaaggucuggugcaauuaagaaugcugcugaaaggguuuuuguuguaguucgugccuaucaaacacagacuauucugauuacuuguggcauuuugcagugauauaaaauuaaaacuaaagcacaggagaagaaucuuagguuuuuauauaaauaauuuauugucuauaaauucucccaagaggaaucuaugucagucuacagaaagugucucuccauugagacccauaccauuugccuguaaauucagcacacugauagccauuugcaaucugcaaaagaaaagccaucuaucuaaaggggcacgccacacuguuauuccuuuguaauauuaagaaauuuauccuaauuuaaaagauaacugaauucuuauucuuuuacaaauuagacuuuaaaacacagccacugaauugaccaagcacuaccaagcuuuuauccuacuuuuauuuaaauguacugaaacauuagugaugaaagcuuucauuuaaagaauucugaugauucuaauauucacuuauaauguccauuuagcuaccacauuguguuuaugccccuuaaaagcugaagcuaugacugcucuaguacugaguucuccagugcuuaucauuaauuaaaagguaaaacacgauuaccaggguaucugcaaucaagcuuucaauguaagaaauaucaauauccaguacuugagaacauuuuggaaccaauuuuaauagguaaaaaaguccaaagagaagaaaaaauguucuuuauuauuucaaauuaaaaccagaucaguauaucuuacugaaaaguugcaauugcccaugccuuccaggcaucugccuaguuuuucucuuauagcagaugcuaaagaagagaaaucuggcauguccauuucuguaauauuuacagauauaacacaucagcaauacaucaguuugguuuuuuauggaagcuaaccucaagaagcaaaacaugcucugugaguguacuuguguacuuacuucagaucauccuuaugcuugggggugggcagacagauuauuaaauaaugacuguacugagugucuacuaagcacagugguguacuuguguugagggcaccgagacgaauagaagaaucccuacccuaaaggagugcaaaaucuaguaucggagccacaugaauauugugcaagugaaagaaggugagcacagauuauguccauggugaaacaaaaguucugaauaucuguugagacugauaaaaauagauccugcuaauguuaauggcaaaaauggccugagugucuuuagcuccccaaucaacucuaccaguauccacccaagccaccccaaauaaaguguuugcccaguguacauaugcaguuucaaaaaaguugcccgguuucuccucuucuguauugguaggaauugagcaggacacagauggcccacugaaauuagaauaauuugaggaagguuuaauaaagggacuauuuauaaaacuuuggguaguauguaggaaaaccauaagggacauucaacacucuggaacuguuaucaucacacgacauaaagggagaaggggaaggagcacugaccagaacuuggaaagagaaagucugguggagaggucaaccucgagaagagcuaucugcuuugauagaggaacauagccagcucaaagggaccccacagggagugauccaaggcaacuaauaccuugaccucacucuccuuccauuuuccagucuccugcuuggguccccccauuggccagaaggcaaaaaaacccacugaugaagcauacaggucagcagguggaaaaggauagcaucccugauuccugguauuaagaaaaucaaucagccgccaaccgcagagaacugcugugaaaauuaaaugauguaaagcacauuaugcacucaaacauaccucaaacauaguaaguaaaugagaaauguaaguuguuaaauauauaauaugggauauuuuucauuauacaauucaauauagcaauuaucuaugccucccaccauuuucuccccacaugagagguacagcagagagggagaagaaccaauguuuccuggguggcuaguaugauugcagcagagugcuaagcauuugcuauauaucccaucuuauuucauucucccuagaaagaaugugauaggaauuauuaagcucuuaggaaaggugaguaaaugaagcucagauauguugccuauaauuauugcuuauaauuaggaucucagaucugucaaauuccuaagcuaaugacuucuccauuauuuuauguagaugggcuaccuguccauauuagauaauuuuauuuuuaucacguugaggggaauuagagaaaaacuugcuaaaagcuaagcaucuaacuuagggcuugccacagaagagauagucaguaacugcuauauaugaugaugaggaggagcaggaugauaaugauugugauggugauggugaugguacuggugauggugauggugauggugacaaugauaauuauggcagcggugacaaaugauggugguaauagugaugauaagaaccacccuacuuuaaccuaggagcaaagaacuucugcaacagacacgaagaauuccuuaaauaagguuucaguauauaguugaaguaguggaacugauaaauauuuguuaauccuggucccucaauccaagaagaagcuuuuucagagcaggcuguguggugcauggcugggccacuaugaauuucgguuucccugugugugaaacgcaauaauuauauauguggugccuagagcugaugugaagaaugaaaggaaugcauuuagaacacuuggaacagccuggagcacagcgaacacuaggucaagauagccacuuacugucggggagguuaguuccaacauggcugggcucucagcaagucuucuuuugaggaaaggacccagaaguggaaauggccccucuccuuacuagcuguguccucacccacuccacucaucuacacaguuuagaaucugagggugaaagaaggaagagcaggcaagggaaggcagcaguggaaaacagcucuugggugguaaguagggagcaggaagagcaguuaccaccaugcuuaaaacaagguuuuuaaaaaaaaaaaauugccugaagucacauuugaaaauaaagagcuugguaaacaugcugauggcaaagagaacuuguaaaacaguuucacuugaaaaaggccaagguuaaugguauaauuucaauuuugaaccuucuuuuaauauggauuagugcucucaaauaugggauuugacauuaagaugccaaaagaagacucagaagguaaccucaagcaguauuuuuuaaggaaauuucuuccuuuuaucauuugaacgcagcugaacaaaaacguuauuaaaaauuauucugucauaaaaacagcaacaucaaugaccauaacaaaugcuaaaaagcaaaauuauccaugaaauuaaaaauauuucacgaauccaaggugagaaauauuuuagggaugacacuuggcacuugagauuuauguaaugagacauuaccaacuuuuauguauaaaauuuccuuucugaaaaaaaaguaugaaaaaucaaaagaaggcaccaaaaaagucccccacugauuuggaaaacauauucuuuuuuuuuuuuuuuuacaauuaacugcauuuggagaacugcaucacacuuuuaaauaaaauauacauaacacauuuucucuuuauagaaaaaccuuuacaaacccuuaaguuugcugaauuacugcugaaaaaguauuuuugaaauaaaauauacagaaugaauaaagcaucuuuacuccauucuucggaaauuaucuagauacaaauauauacauggcuaaguucaaaaacuuacauaguagaaaguuuaauaauuugaucuauaauauuaagcuguugauacuuucgauuggaaagaaggaggggaaauagugaaagaaaaauuaaccacagaauauauucuuugcaguuugagauauaaaauguuuuaucauuuacauuaaugugcauaacauuuuaauauuaauuguugccucuuucaucuugcugucuuauuuuuuaaaagcuuaucauagaaaagucucuauaugaaauuguucauccaaacagauaaaaaguuggaauuauaacugggccaaugaaauguuguuguuuuguauuuuauugcuuugcuucuucuuuaguaaucaucuuugcagucugucuaaacaauucucugugcacugacauuugcaauaauguguuuacaucacaaaguuagacccugucauucgauggaacaagaggcuguauuuuguagcccccagacacucugcauaacuuacucccucuuuggccugagaguguaaucguuuuuucaucugccauguuuaauuaccuuuacaggcauuaacaacaguuuacuagaaaucgauggaggagcaauaaauucauuagguucaguggagguaagaaguuucauauucuuuuucucaggugaauaccuauuugagaacuacuaacuucaucuuccauaaaccuaaaaaauauaauauaugauuuucaucugucuaccaguucuuaaucuccuaccaaagauggagucacaacacaaaaucaggagucaauaguuacaaugcuuucucacucugacacaaaauuguguaacuugaaggaaacguggguucccuuaugcaugcaaaugcccuaugcgacuacagaauguguucccuacacuucagaagcuguugauguuccacucagaucucuguaggaucccuuuuaccaguuuggugucccauuccucccuacagguguugcugcccaucuucuccaaagaauugcccuugagugaccagagcaacacccagagguucuggggagauauaucacuaaauucggcccccacccaggguccauagcuaaagacugaauggugggaagggaagguacaaaagucuacacuccugucucaaggcagaacugacccuguaguauguuucaugcucccaagacuccccaugugaucagguuaauuucaccugaaaccacaaccuugguagcuucuuccacuuccuuauacuaauucccucacucccuuccugguuucucccaagagcccucucuuacuaaucaccugcacacccaucuccaguucuagggaauucaaccaaagacccuguagaagcaaacauuacagaacagacaggcauacaaaugguuuuccaguuuuugcagguaaucaauaucucagccauuuuaaaagguacuguccacaguguuuuauaagcacaaguuggggauggaggggaaucacaugccuguuauguaauugugugaaaagaaguuccuaagaucuacaaagucacaucauuugcagaagucacuaacugauuccugcuccagggaaggcugcaguuggcaagggcugcccuucuuggcaggugucaggcagggcucugcacuacaauucucccugcauugggagaacaaaaggagucuggggcuaggaagaaaaaaaaaaaugacaagcgaagcauuaaacuacaaacagcucuuugaagccucccugauagaggugguuguguuugugcaacaguuauuggguugagucuaauaaugaaaggacagaucaccacuuacucugugaugucaguaaugaaagcuaucaaaacuaagccugagugggccugacugucacccuguaaaucuaacguggacagcuuaaugagggagggacauuaucuuuucucacacuccaauuuuacucacauaagaaauguggcccacauuggcaauuaacuugagagauuaauuaaauccaauaacaaguucaguucccuccauagugcauucugauaucaugugaaggcaccaacaugcuaugggcacuuagcacauguuaaaaaauaauggaacuaauuugggcuuuuugugugugugugugugcggaaaacuggcagcuaaccgccucaguaaauuaauuccacaaacugauacagcuacucgauaguucacacagucuuauuuccaaacucugcuuuauuauccugaaacucccaagaaacauugcccaauaauuguguuucuucccucagcaauuuuacucaccaguaguauuuaacauauuuuauugggcccucugaagaauaaggaggcagccauucagacaaaacauaaacucugccccagcuuaagaagcaauagacugggucccauugugucucuuucaaaacaacggcugacacugacaaggaacaggaagagcagcaggggugcaggcaugagcuucacuuagcgucagaaggccacgugauauauguucugguucucuuucuuuuggguucccuaauucguccuuaguuccuguuuuuguguuuucuucucugaaacgguaaagugcuuuccuccacuaccauauaugaaauuugaucuuaagaaauaggagucuucaaauuugaccaauuggccaaaugguuauuaaacugaugccuuagugaaagucaaugaaauuguuuuuuaacugguugcuguaaaaucauauuccuauaauacagaucaaauucauauacuagaguuauuauauagauacuacauaauaauaaugccuacuccugccccacugcucccaaaucaaccuacucaaagaagugcuuccuaacaaucucacuaccaaggacuccuuuuauuaugauuugagaauggaguacauguuugaaaauauuucaucuauccaagauuaacgauuaauucauuuccuuuuugguauuauuaagaaaaauacauauccugucugauggaacuucuaauaaauaaauaaugaaauuacaacaugaagguaaccuaaucuuugacaaaaaugggaaauauaauauuuggguagccuuucauaguuacugugguuacaaauacccuuuaggaaauaacgaaaagagcuugaagguuucuuuucuauuuuggagagaauucuaugacaaggugauauuuuagaccuacccuaauagucacuagugcagaagauuuacauuaacaaucuuucauacagccagaaguuucaucuaccuaaguggcaccuugaaacuagaaagagaugguaaauaacaacaagccucaauguucuaagaauaaucacaucaccugaagcaugguaucucugcgcauaucuucaauuauuaccaaaaaugucuaugcuauaaauauacuugaugacaaagcauuccuacacuugauuaccaaaaaaaaaaaaaguaaaugguaaacaacugauugaauuuauuggaucuggggugaucuuauauuuguaucaaacuguaaauacauuuaacucaacugauccaauauuagcccauuaguccauauuuuccacuuaggguauuauugcagaccuacugauaaucauaauggcuaacaauauuaagcucuuacaaaaugcuuuacaugcauucauucauuuaugugacucaacaaucccauguaauaaguacuauuaccauugucauuuuacagaugacaaaacuaauguuuagaaagguuaaguaacaugcacagccacacagcaucuggguuuaucugcugcuugguaaaucuggacuaaacaaccaacagggaucaggcuugauauucuguuccaccugauggccaaggaagauacugugcaaaugccugcacauuuguccuuagacuacaagcuuucuuucaguccugucagcauugacacugccaauauuuuaagaaauguauuuaaagucccuucugauauuucuuauaucaccagcuaaacugcacacaaaauaaguuaauugguucuaagguuuaccuaaauauuucucauuguagcagaauuguggaaggagaaguagauaauaucaagaguugacuguuccauguuuuauagaaaguaagagucagaaaaaauauaaccuaaauaauuccauugaacucucaguauauguaggaguaauggcauaaugauauauuguuguuauaauuauagguaaaagauaaauucuuggaaaauaauuuuaauucacauucucuaacaugagaaauuucucuucacuuaagguaaacuucgaauguuuccuuucuuuccacaagguggaaaucuugaaguaaugggcuacugaaaaaccagagaaauuauaugcacugacuuacuuauucauucuuaauuuuagauuauaaaaguuuucuuguguagcuuagagaauuuuccaaauccuuuauaacugugguuguggaauuccacaauguugaaccugaauagauuccuauuuaugacaaguuacaaauuucauuguagaaacguaggugcaaaagacauagauuccaaagauuuaccacuuucaguaucaaauaauuuaccuuucauuuuuagcuugcucucacauaaaaauugauccaaaaugcuguuuuaggaagaaaccagcccucauaaauucuugaugaauccagaucaccaauaugaauaucaguuauugaaauccucagaacauauaugaaggggauuaacacuaaucaucaacacacuaaauggcccuaacuuaggcuguuacguaccuucauucuucugcuuuauacagucuauaacuguauaaagucuuccaacuggaguucauggaaucagauauucuuaaaagaauacauuucaagauccucaacuuuuuuccuaaaauugauaugucugaaaauguaucugcaguaaggguaucauggggaugacaauuucuguuuaaagaucucgccuuuucaucugcaaacaauugucaaagaauacauugcuccugagaaaaaagucccaugagagcaaagcaaaaugggaaucuguaaaaaauacaauggcgauggugucuuauuucucucaggagcagacucacugcaaaccuccucaccauaucagccaaucuauuucagacugagaacucagaagugaaaugacaggcaugggaaggaccacaaggaaguuuaauugaaugugaaaacccaaguugaaagaaaguaggccugaccuagcugauugauucagcaaauaaguuuuucaaaauaaacuauaaaguggacauuuuucauaaagcuaaugaguuaaaucugcaguuccaaggcuuggaggaaauacacuacucaaagaauguacuaagcaagagaaucuuguccaaaaauuaaaaaucauauuugcagagguauacugaaauuuggaauauuucaguuuucccaccucugagucuaucagauucaauauggcaccucuaagagaaagaggaauagguauaauuaaugggcauuugagaagcuuugguaagccuuugguguacuucccaggaaaaagagaaauugaauaucuugagugacugagcaacaaauucuuuuucaagacaguuuuucucucaauaaaauugaaguagaacuaauugaguugucagaggaugaaucauaaaaaaaaauuugaugagaaauuacuauaugauuuuuggcauaaaacuggcaagaaguuuuaaaaaauucaaugacauaaaaauaccuccaaucucaucugcuuauguaugugagaaagauuucucaaugcuuauaucuagaaaacugaaaaauugggauugugcuaaauccuguuuuguuuugaaacaaauaauauuugacuugauauaggaaugaauuaaaaaaucaaaaaaagcccugacaaucucauuauuaggugagguuucaauaauuuuaacuuuuauauuuaauaauuguuaauauauaaaaaauauaagaaauacauauuuuuuguuuugaucaaucuugugcuaauaauagugauaaaagcucaauccagauguaauuuuugaaauguagaggauuauaaauucaaaauuuuuuuaaaaaauuuaauguucugagacuauaugaugaugcauaaaauauuucaagcauauuacauugauaaaauucugugagacaaaugaaugaaauaugacuuauagagaaaggaauggugcacaauuuucaaugaauaaagaauuuguuuuuauauuguuaaauugacaauagugagacucaacucauuauaguauuuagauuccaaacggauauacuuaaaaaauauuuaacaauuuuuaaaugucaauaauaagccagaaauuauauucuuugcaacucuuuaaacuuauaacaaauuggaagccuauaguuuuuccagaagucuuucaagguucagggagcaaaaaaagaaagaagaaaaaaaggagcuuucugcuuuguuucuccugccuuguuauuauuucuggaauuagaagauaugcuuuccuggccccacuuucagauuugcucuuugauccacucuccccuuagaaauuggauuucugaauagcuaaggucuccagaucacugaauuguggauaugauaaacuuuccaaacaaauaugauucuaauuauuugcuuuacccuaagacucauuacagcguucuuucaaauaacaaucuucuccagugcuuuugaaauaugguucuauaauuauaaaaauucaccuugcauucuauuuacaggcuuuucauuuuauuuagguccaaaauacaaaugcauugcuuugauucuguagcagauuuuugagaguaaucccuuuuuaagugucuuuacaaauauguuaucuaguccaacaaggcaaaaaaggaaaauagaaaagaagggagagagaaaaaagaggaggugaugaaaugccaucaugauaucagagaaggagguggauaauuuaaagcagcaaggcccuuucaaauagaagauggcuaaauuuuaucacuaauucacaauaggauuagaacaugaauuaaauuucauuugaaaacaaagauaccuauugcuuuauauagucccugccucaacagcaauaccagccugauuucuuucacaguuuucuuucugagacaagaaauacccuaauaaaacaaagggaaaaauauauuucccagugucuaaugaucuuuauaaguccuuugaccuuuccauggaccucaguuuucuuaucuguaaaauaagaaaguugauuuaaaccaguuauuugaggaggggcaagagacggggcaaggagggcagaugagaagaaucacaggaagggaugaauuuuucgacagaauacccacacucugcaugacuuuccagauuccuacucaagcugcaccacuaucccuauggaugcugagaacuccagcugugggaauuuguguucucuccuuggaagaggacaaauggccggaaacaccaugcauaacuuuaaagaucccuuccagcaaugagauaccaugauucuucggcuaugacuagaaaacauauuguuacucauguauuucuucucuccuuuccuuugucucuggcaagcaucacuauuugcuccuugcugccuagaacaguaugagguauauaugccuggggugugaaaggagagauggagggagggacauauuuacagcagcuaugaugcucaagagcuauauuaaucuguagcucuguauuuucaugacuucacaacucccuaagcuuaaaaauauauauacguacauccggcugggcgcaguggcucaugccugcaaucccagcacuuugggaggccgagacgggcagaucaugaggucaggagauugagaccauccuggcuaacauggagaaaccccgucucuacuaaaaauacaaaaaaauuagccaggcgugguggugggcaccuguagucccagcuacuugggaggcugaggcaugagaauggcgugaacccaggaggcggagcuugcagugagccaagaucgcaccacugcacuccagccugggugacagagcgagacucugccucaaaaaaaaaaaaaaaaaaaaaaaaaaaaauauauauauauauauauguauacacauccuuauauauguauauauauguauauauaugcauguauauauguguauaucuauacauacauccauauacauauauauauguguacacacacauccauauauaugacauuuuaaaagauccucuuuucucucaucuugaaguguguuaaaagguaugcguaaaaaggagcuacaaaacaaugagguuacuagauaagguacuuuuccugaaucaaagaagcuccuagacaaaauggggccugacuugguggucagcugucagagugaaacuuaauuuaacaguaacaauagacaaaguaugucagacuaagugcuucaucgacaaucugaacaauuuucaauaaaauggccuugaugucaguuagggcagacaaccccagguagagaaagacuacucgggaaaaaaaauuaagaaaaccuucugcagauucgaagggggauuuuuuuuuaucccucugaccagccucucuguauguaacuuucagugguucuugccuucaagagguuuucccaccacagugaggggcugagggagauguuugugucccuggaucuagugacuuguuuucauggcucugaagcccacagucacucccauuuagaaaauauucuauauccuuuuggauuacgcuugaucucuuuuuaucuaauuaauuacaucucaggaaccaagaaguaauuacauuaagaacuuggaggcaugccuucaggaaugucacuauggcuuucuguuuguuuguuuuaaagcaaaucagcacucuggaacuugguucagauuagcaauuuuaugcauucagcuggauacaaugcaacuccugguuauuagaauaagaaauaaggugaagaacaugaaggaaugugguucaaucucucucucucuuucccuuccuuucuauuccacuuuaguauagcaauuacaggccucugaguuuggguuuagcaucgugaugguaggcagguauuuacuuuuuuacuugagggucaagugggaugaaaagcaaggaaaaaaagccaggacaguccaaggacuggcacaugucaaagcacagaggaacaauacagaucuucagaggaacuuuuuuucuuuuacuuccuuuuuaaaaaacuuugucaguguaguaaguggugaagacuauuugcuaaaguguucaacaacauaacugcucugagauuucuccuucacuaggcuacucucuuaggccucugugaacaucugugccauguguacaggccacuuccuaacaggcccaaagaggauguguuuucauaaaaguuguaaacacauuuaagaaauuaucugaagcucauaagccaccugauuuccuaggcaaggccucucaucacauuaaccauauuuuacguaaugagcagaugggcagaauaaaaccagagggaggagaaguggaggaaaaggacaguaaugagugaugaaauggaaaucacgugauuaauggaacauagauuuuaaaaaguaaugaagaguuuaucccuaggguagaaaacagggaacaacaaaaauaaguaccacguugucaaaacaguaaaauaagagaguagaacaaagaaacagagcaagacaaagaaaugcugguuuuaggauaggccuuauuuuaaagacacaggggauuuuggaacuuaccauuuugcagcuauuuguuuaaacaaaaauaaauuuauguugccugguguccuaaaaguuacuuaugacaacggucauuaauagauaagagccugcagcuauccggguacaccaacaccagccuuuguguuuguucaacauuucuuucugugggaaauguaauuuguagcauaagaguucacaagaacccucagcuccauggcuccaucacuaaugaaacaaguccuggauuuucauagcaaccaucaagcauaaauuuggcuccccagagcaugugaacuuuaugugugaauuacuuaugugugugcacaaacuaaaggcaaauucaugugaagcauacaggcaauuuacaaacucuaucuguucugaaagucugcacaguaacaggaacacagacagaaauaacaaaauggguguauauguccagguuucuccacaaaagaugaccuguauacuugcaagggcaaaauaucacaaaaacaacccuaaugcaagaguaguaaugagagcaacuaaaaauaaaauacagaggcugggccugguggcucacaccuguaaucccagcacuuugggaggccgaggugagcagaucgccugaggucaggaguucaagaccagccuggccaaaauggugaaacaccgucucuaacaaaaacacacaaaaaauuagcaagguaugcuggcaggugccuguaaucccagcuacuugggaagcuaaagcaggagaaucacuugaaccuaagaaguggaggugcagcaagcugagauugcgccacugcacuccagccugggcgacaagaguggaacuucgucucaaaauaaacaaauaauagaaauaaaauagaagauaaugacugugugugugcacuuucauuauuuugaauguuagugcucaaaggaaagcaaauuuaguuagaaaacaagcugauagaaaaacaguuucagagauucuuaagagaacuucaggacacauuuaagaaccaugaaggcugguaacacaaguuuugaaaaaauuaggccuuguuucaggacaauuuuguuuuucccauuucuaggaauccgauguaucauucacacaauuuguauucccauuagccuugauuagggacauaucugugcucacauuagacucccugaauacagggaccaaaauucauucaauguugccacuugggugucuaauaugcugcaaaaaucucuaggaaagauauaaaugaacaaauaaaugauaugcugagauaacauugugaagaauuuggcaaugaggaggggcauuaucuucuuccauaaagacauugauuuauucuuuaauaucacucagaaucacaagaaauaaucagcugauacagaaauggaacagcugucucacacagaaguggcuaaagagaaaaaauuuccacaaaauacuggaaaagaugguaacaaaucaaauuucaaaguugggcagcccuaccaaaaagagaaaaagaagauacgagaggagucaauagugacagcacuacugaaauucaaaaauaggacuugaggucuaagacaaacugauaaaaauuaaaauaauggcaauuacucauugaacauuuacuaugugccagguacuauauaugcaugaucuaauuuaaucuuuauaauaauccauuuagguaaguacuucuaucauccuuauuauacagauagucaaacacgaugauaaaaaguaaguaacuuucucaaagucacccaccuaguaagugauggaaccaguacuuuaaaacaugucugucugacuccuuaaucaaugcaacacuaagauacaugugacuaaucaaggaaaaagaaagaguuuugauuuuuguuucuuuuuccaauuuagaaaagaugaaggagaauucuagaaccuucacuucugagcaaauagcaaaccaacuugcuguugggaauuuaagugucaugcacauuaccauuuacauuaguuugaaaaagaaguaaauguccaacuuuuaguuucucuaaacaguuauucuaguuuuccuaaguuugaccccaaaagggauuugacugugaaacaaaacucucuguaguucucagauaugguuagacagucagaugcccacaaguaacagccugugcagaacaucaacacaguauaucaccccagcaaggaaaguucaaaggaaagauuucuaaggcuacugagauaaaauggaauagaaucuuuccaguauauuucucuuugcuaucaaaccaaauuagaaaagacuaauuuauacuaaauuauaaaucacagcauuucuaauuuaaucacugucuguuuuuuuaauuuuuguucuuguuuuaguuuugcauuucuuucacccaugggauagauacacauucucacuuaagccccuguugaaacuauuuccauuguccccuagauccucauucuacuuuaaugugucuaucuucaguaaaacacaacugauaaaccugaaagauaauaaacuggacagacuagcacugagauucuaaaugagauaaaccggcagucauccugacaguaauggaauaaauaaagcaugaauaauuacauuaaaagacaauuucugauuuaaacuuugcuuuuccuguuuuuacacaguagaaaaaauuaggcugucuggccuuccuuaggagaaaucuuucuuagaaggaaugugugcuuauuuuuaaaucuaucauaacaacugauauaucagcaacaauguacccauauuuaccucauauuuauauguaugucuucucuauuauaagcaauauguuaugaaauauauuagagauuaguucaaagaguugagauugguuauaaagaauuauauuagucggguuuaaaacguauuuggaaaguucccaguauaaaauaguuuaguuguguuauuuuccucuugaugucuugaauguugcaagguacuauucuauggcugguaggggcaugcaacaggugggaguaaggaaggaaacagcaagccaauaauaaguuuugaaaauaagcccaaucauuaaguauauguugagucucuucauuaccgugaauaggaagucuaauagauugccauaugcagaaacagagaaaaugcuguuuuaguggcaccuaaugagguuccaaaaaugcaguaacuuguagauucuuucacauucauacucuguguaauauaacgcuauauagcacacuuagcucucuuuauaccuugauauuuuaaugcaaacacagauucuuuucucuauggcuuuaaacauuacacaggaacaagcucccaugaaccucuuucacauuccuacucagagcucucugugaaaagcugucauuucuuguucuauucaagucagacuaccuagucuccaggcacaaugguaaaaggaaugucaagguaacaucuucauuuauucauaugauuuucucuuuuuuuuuaauuauacuuuaaguucugggauacauguguagaacgugcggguuuguuacauagguauacacaugccauagugguuugcugcacccaccaaccugucaucuacauuagguauuucuccuaaugcuaucccuccccuagccccacaaacccugacaggcccuuuggguauaaccuaguaaugggacggcugggucaagugguauuucuuguucuagaucuuugaggaauugccacacagucuuccacaaugguugaacuauuuuacacucccaccaacaguguaagagcuuuccuacuucuccacauccucuccagcaccuguuguuucaugacuuuuuaaugaucgccauucuaacuggugugagaugguaucucauuguaguucugauuugcauuucucuaaugaccagugaugaugaguuuuucuucauauuuuuguuggccacauaaaugucuucuuuugagaaguguuuguucauauccuucacccacuuuuuaugggguuguuuguuuuuuucuuguaaauuuuuuuaaggucuuuguagauucuggaucuuagcacuuugucugauggauagauugcaaagauuuucucccauucuguagguugccuguucacuuugauuucuuuucaaggaagcacuaaauaugaaaaggaaaaacugguauaccauccacugcaaaaacauaacaaauuauaaagaccaucaacacuaugaaaaaacugcaucaccuaaugggaaaaauaaguagcuagcaucauaaugacaggaucaaauucacacauaacaauauuaaccuuaaauguaaacaggcuaaaugccccaauugaaagaugcagacuggcaaauuggauaaacagucaugacccgugggugugcuguaucggugcgcuauauucaggagacccaucuuaugugcaaagacacacaaaggcucaaaauaaagggaugguagaauauuuaccaaguaaauguaaagcaaaaaaagcaggaguugcaauacuagucucugauaaaacagacuuuuaaccaacaaagaucaaaaaagacaaaguagggcauuacauaaugguaaagggaucaaugcaacaagaagagcuaacuauccuaaauauauaugcacccaauacaggagaauccagauucauauagcaaguucuuagagaccuacaaagagacuuagacuaccacagaauaauacugggagacuuuaacaccccacugucaauauuagaucaacgagagagaaaacuaacaagaauauucaggacuugaacucagcucuggaccaagcagaccuaacagacaucuacagaacucuccaccccaaaucaacagaauauacauucuucucagcaccacaucgcacuuauucuaaaauugaccacauaaguggaaguaaaacacuccucagcaaaugaaaaagaacagaaaucaggccgggcgcgguggcucacgccuguaaucccagcacuuugggaggccgaggcgggcggaucacgaggucaggagaucgagaccaucccagcuaaaacggugaaaccccgucucuacuaaaaauacaaaaaauuagccgggcguagcggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaagaacagaaaucauaacaaacugucucucagaccaaagugcaaucaaauuagaacucaggauuaagaaacucccuaaaaaccgcacaacuacauggaaacugaacaaugggcuccugaaugacugcugguuaaauaaugaaauuaaggcagaaauaaguaaguuuuuugaaaccaauaagaacaaagacacaauguaccagaaucucugggacacagcuaaagcaguauuuagagggaaauguauagcacuaaaugcucacaagagaaagcaggaaagaucuaaaaucgacacccuaaccucacaauuaagagaacuagaaaagcaagagcaaacaaauucaaaagcuagcagaagacaagaaauaacuaagaucagggcaaauuugaaggagauagagacacgaaaaacccuuaaaaaaaucaacgaauccaguagcuggguuuuugaaaagauuaacaaaauagauagacugcuagccagacuaauaaagaagaaaagagagaagaaucaaauagacacaacaaaaaaugauaaaggggauaucacaacugaucccacagaaauaaaagcaccaucagagaauacauaaacaccucuacacaaauaaacuagaaaauauagaagaaauggauaaauuccuggacacauacacccucccaagacuaaaccaggaagaagucgaaucccugaagagaccaauaacaaguucuguaauugaggcaguaauuaauagccuaccaaccaaacaaagcccaggaccagauggauccacagcugaauucuaccagagguaaaagaggagcugguaccauuccuucugaaacuauuccaaacaauaaauagaaaaagagggacuccucccugacucauuuuaugaggccagcaucauccugauaccaaaaccugacagagaaacaaaaaaagaaaauuucaggccaauaucccugaugaacaucaaugagaaaaucuucaauaaaauacuggcaaacugaauacagcagcacaucaaaaagcuuauccaccacgaucaaguuggcuuaaucccugggaugcaaggaugguucaauauacacaaaucaauaaacauaaucccucacauaaacagaaccaaugacaaaaaccacaugauuaacucaauagaugcagaaaaggccuucaauaaaauucaacacuccuucaugcuaaaaacgcucaauaaacuagguauugauggaacagaucucaaaauaauaagagcuauuuaugacaaaccuacagccaauaucccaccaaaugagcaaaagcuggaagcauucccuuugaaaaccagcacaagacaaggaugcccucucaccacugcuauucaacauaguguuggaaguucuggccagggcgaucaggcaagagaaagaaauaaagcauauucaaauaggaagagaggaagucaaauugucucuguuugcagaugaaaugagugcauaucuagaaaaccccaucgucucagcccaaaaucuccuuaagcugauaagcaacuucagcaaagucucaggauacaaaaucaaugugcaaaaaucacaagcauuccuacacaccaauaauagacaaacagagagccaaauuaugagugaacucccauucacaauugcuacaaacagaauaaaauacccaggaauacaacuuacaagggaugugaaggaccucuucaaggagaacuacaaaccacugcucaaggaaauaagagaggacacaaaaaaauggaaaagcauuccaugcucauggauaggaaaaaucaauauugugaaaauggccauacugcccaaaguaauuuauagauucaaugccauccccaucaagcuaccauugacuuuauucagaauuagaaaaaacuacuucaaacuucaaaugaaaccaaaaaagagcucauauagucaagauaauccuaagcaaaaagaaggcaucacacuaccugaggcaucccgcuaccugaucucaaacgauacuacaagauuacaguaaccaaaacagcaugauacugguaccaaaacagauauauagaccaaugaaacagaacagaggccugagaaauaacaccagacaucuacaaccaucugaucuuugacaaaccugacaaaagcaagcaauggggaaaggagucccuauuuaauaaaugguguugggaaaacuggcuagccaaaugcagaaaacugaaacuggaucccuuccuuacuccuuauacaaaaauuaacucaagauagauuaaagacuuaaacauaagaccuaaaaccauaaaaacccuagaagaaaaccuaggcaauaccauucaggacauaggcaugggcaaagacuucaugacuaaaacaccaaaagcaauggcaacaaaagccaaaauugacaaaugggaucuaauuaaauuauucauacuauuuucauguuggacaguauuauaaaagccaaucaaauuggagaaauaacauaguauauuuuacaaaauguaaauuugugaugcaagcagaagagcuucugcuacucaugagaguuauauucuuguuacccaagaauauaacuucgcaucuuuucaaaacaaccuacacagaguaacucuuaaaaaucugcuagugagggggaaaaggagggagaaagcaaagcuucaaaggacuuucuaaagaaauuauaauacuaagacuuuuauaugacauucaacccuguuuuccccccuucucccccaacaaaauaaccuagccaaacaauagagaggcaacguuuaaauacaaacuuucuuccacucaacacuagaaaacugguaagauuaggucuucaaagaggcugagcuaagaauucuccuaagcuuuaaauuuccugcaaaggcugaguuuuauuucuuaagggaagagcuucuguuuggcuuuucuuuuucuuuuuaagaaaaaaauucuauauaauuauagguuuauuguuacauuuguauguaugagcaaaguacaggcaaagaaagaaaaacauugucaagaagcugguuaugacuaaauauauaaagauggaauagucuaacaaugccaguugaauaaauacuguaacaaaacuguaauuuaaaugaagcuaccaaaauauuucaaaagacaacgcauuuuaugauuuuaaaguuuaucuucaaaaugaaauaugaucauagcuauuaacaauaugcuguaaaauaaaauaugcuaaacauugcuucuguuaguaaccacuaguuucucaggaaacauucuuuauagagcaacucugauuaauguacaagugacagcuuuuuuuuuucugagcacuaaccuuacaguauaccauuguuuucaagacaguguuuauaaaagcuguaaagauacguuuuagacauuaccuugucuauaucuaugaacugucagcaaaaaauaucccuuuuucaccuucucuccacucuccauuuccaguuagacauuguguuuucaucccuauauagcuugccuaccuuaaacagaaaaaugaccaacauauucuuaugugcaaaaucugaaaacauuucuuucagaauaauaugaccuguuagacauccgaagaucaagacagggauaaagauuuauuaggccaaaccacacaggacuuauauguuaugggcuguaggacagagcguauuaaauuauuucccugaucacacaacugaauguaaaaggcuaaacguuucacugauuguggucaaauaugauuguugcugcaguagaguaaaggccccaaaaguacccuuaguuaggucagugaccaaaugucacucuauaugauuuuguucuucacgggcaaugucuccaaagugcuaaaugugugaaacuccagcuugaaccaaggaaugaauuuuaguuugcucuuacccuuugaauggauaagcacauugaacaugaaaaucuucucucuuccuuaucaacaaggcacuaacagaauucagauuuacagaucagacacagaaauauggaaaauauucuuaauguuagaucaaauacggaauuauccaauaaauaaauauugaguuuacaaaccaucuaaacuuugacucuccuacuucccaucuaccaaggaagggagaaaaguaagaaauggaaguuaagcucaaauuacucagguacuguuuguuaauauaucuggugacuaucuuaugugagggaaaaacuggaauaauaggaaaagguuuggugauucuacguagcuuuugugacuguaguucuagcuccuaaguuuuacuuuccaaauagcuaagggcugcuguucucaaaagagcuacccuuucuaaauucaggaaauaacaauggaaagaaauaauuguuaaauaaaaguauauguugauguuuacccuauuauauauuauuuucauuuuauauguuauaugcacaaaaauuuauugguacauauuucuaaauguuaaaaucuugguucucugggugauaggaucauacaucauuuuuaucuuuacaucuauacuuuugugcauuuucugcuguucugcaacaagcaugaaaugauuuuaugcucagggagaagaaaaaagccaucucccaccacuacgcccacuucaagaagaagaaugaagaguaaaagaggagaaauaugguaaaggagucagcuuuguacucucugucugcuguuuuuugcuuccucucauuucugcuuuccuuagcagaagccaagaguguuuggggggccuaggucugaggccagcuccaccucugaccaguguaccuccaauucucuccgagccuugguuuccucuucuauagaacgacaauaauaaugguacucacaagaagucaagaagaaacaggauaaugcauguaaagcuguuaccauggcgccuggcucaaagagaauacccaccaacauugcugcacuuuuuuucgccagccuuaccugaucauagaaaucuuaagauuuauaaaauacuuuaaagcaaacuuguccaaccugcagcccacaggcugcacacagcucaggacagcuuagaaugcagcccaacacaaaauccuaaacucucuuaaaacauuaugagaccuuuuuuuugcaauuuuuuuuuaagcucaucaguugccguuaguguauuuuauguguggcccaagacaauucuuccaauguggcccagggaagccaaaagauuggacgccgcugcuaaagcuuacaaugagcuuuaacaaacaguaauuuaauuuuuaaacugauaguaaaaagcagagcuagaauucaaaccucaccuucccacauccuagcucugauaaccaaacaccacuuuugaguuggauugaaacaguugccuacuggagcugccucccugaggcuuaccugcaauugguaaauuucaguaacuuugcauaccagcuguuaaacacagacauuauuuuaaauuauuauagaauuauacaaauuaaaauauaaaaguuacaauuaaauaaaaauauuuuaaauaaauaaauauaugaagcucgucauguccuuauacuuuuuucuuuuuuuugagauggagucuggcucuguugcccaggcuacagugcaguggcgcaaucuuggcucacggcaaccucugccuccuguguucaagugauucuccuaccucagccuuccaaguagcugggauuacaggcgccugccaccauaccuggcaaauuuuuguaguuuuaguagagacaggguuuugccauguuggccaggcuggucucgaacuccugaccucaggugauccacccaccucagccucccaaagugcugggauuacaggcuugugccagcgcacccggcccuuauacuuuuauuaucuauacucuuuaagcuuauuugcaccuauuguauuuguagaguggaaacacuacauaauagagugcuacauguaucucuuccuaauucacuugcaguaaauucacauugguagcuugaaaucagccaaacuggcaaaugccacaaaucaagacucaauaucauuucguugacuugagagugauggagaauaugcagauuaacuuaaagugugccauaucuguggcuguuauauucugaauaacacacacacacaaauggagaacccauucuuccaguauuauaaacuaucauacaauauguaugacagaaagaugauuauucaucaguugcaaacauagacuggcuauggauauaagaauuuggcaaaaaucaaccaaagcagugugugagaaucuacuggcuauccaggauuuacaaucaagaguagugauuauuuuauucauauuuauaaauuacauguuacauguccuuuauaucaguaaaauuaauaauaaacacacaugcaagcaugcacauuagggcaugcaugcacacacauacacauauuuuuccuugagagccagcuguuaaacauuuaccagcauaccacuaaauugaccauuauuuuaaacuaagaggaaccuagaagcucuuaagcagagcccuaggcucaucuucaaaucacuaagguuggguuauaaaugguuuuagcuucagguaaggcuaccaaauuagaucauuguauuuaaauauacuauguuggcaauuccuauccugcacaaugaugaaguaggcucauagcuucaaguuccaccauuauuacagaaaaauuuauucuauggaaacgcaacuuagggaaagucaagauagcuuucuacaauucacaaaaacuauggagacauacaaagaaguaagauauggcuccuuccugccuccaagacaguugagcagggaggacaaacacauaaaccuauaauauaaaaggcacagcacugauagauacaacgugcuaugggaugacaagggagagaucccaugaguuuacacuucagguccugguuaauggcaccagucucaccugccucaaaagaagcaagggcaaggaggcagguuccagggagaaggagaaaccuauaaaguauggcauaauaggaagaaggauucuagaaucaggcagccugugcucaaacccagacucuuucacuaacugugugaacacguccaaguuacuuggccucucuaagccucugcuucuuaaucuaaaaaaggagaauaguaacuccugacccagagcacuguagugaggaucaaauaagacaacaucugugaaacacuuaccccagugccccauaauucaaaagugcucacucaaugaacauuaccuacuacugugaugguuguugauagccuugagaguugaaauggcugacuuuggggacuaggagggugcaggaacuagacagagggauuccaggcagaaggaagaaaauaagcaccccccaccaacaaaaaaaaaaagaaaaaaaaaaacagagauuacauacaggggcccacuuaguaguccugagguaguagaauauuccuggaggucuaggucaggcacagcuacagcaaauaaagacugaggcuagaccaaggcucuuccagaaugguucaaauauacacucauuccucaugcucuucugagaaaaacgaaacaaaaucaggcuuuuaagaugauacccuuuuucuucugacagguacuguaaauugugucucugauauauuuugaagagccuauaagggaaugauaaaucaggcaauauuacauauauucaucaguaccuuaauuguuguuaaauacuaacaacaccuaaaauugaucuguaccaagauuuacugcucugacaaaaaaccaccuggaaaagagcacaugauaauuaagaacgaccaaggguuugaagcaaucuaacgcguaugaacaagauuuaaacuccuccccgagggaauaacuaggugauguuuauucuguagaugaacaaugugauuauaacaauggaagauugaugagauuuuuuuacugugggaaucugauuuagccggcuagcucagauaauaggaggaugcaaaacuaagccauccaguaccacuuaaaaauucuuugugagggacacaucuucagugaccugaaaaaaauggacugcaagucaggcaggcauauuaggcagcuacaaacugucauacaaaaaaacagcauuuaccaaaaaguuucuaaaugcaccacaacugaguucaaccaaauuagagagaaaagguaggaagagaauuacauucuuaucagaagcaaaggaauuuuuuuuucuuuugguggucuuuugggccuaccaacuguuauuugagucuaacagguuauucuuaguaaucccucuuguccaggaaaagaggaacugcuuggucuauuuuaauaaacacacaaacuaaaagcaaggcaauauuagucuuccagagccuugcuaugaaaaguguaaagagcuaucaccuaggagcuuguuagaaccucaggcucuugggcuccacccuagaccugaaucaaaaucuacauuuuuguuuguuuguuuguuuguuugagacagggacucacucuguggcccaggcuggggugcagugguacuaucucagcuaacugcaaccuuugcgucccagacucaggugauccuccuaccucagccucccgauuagcugggacuacaggcauguaccaccacgccuggcuaauuuuucuauuuuuaguagagacaggguuucuucauguugccuaggcuggucuugaacuccuggccucaagccauccacccaccucagccucccaaauugcugggauuacaggcgugagccaccaugccuggccagaaucugcauuuuuaacaagaaccccagguaauuccuuuaaaguauuagaagcaaugcucuaaagagacauucauucguucauucaauacguuugcgagaucugcagugucauuuaugguauguagccacuagccaaaugugacuauuaacauuucaguuaguuaaaauuaaauaaaauuaaaauucaaggauuuauuugcacuaaccacauuuaaguucucaauuagcacauguggcuaaugucugccauauacauuuuaaucaucacagaaacuucuauuggacacaucacugaacaaagaagacaaagaucuuuguacucacaaaguuuagauucuaguggugggaaagcagauacaauaaacauaagugacucaguuaaaugguauguuggacggacaguucaaggcuaaggacaaaaauuaaaaaacaaagcagccuuagagggaucaggaggauggaaagacaggaauuuuaaauauggcaggucugguaguuucaaugaaaaaguuacauuaaaggagaggcaggccgugagcugcccgggaugggggcagggggguaguuucaaaggguaaagccugugcaaaagcccuagggcaggucuguuuccauaacagcaagggucccauguggcugcaggagaguaaggggagaaggcaaguaaaaugguaggagaacagaggaguauggauccuggguauggaaagggcuuccuuauccauugucaaagauuugagcacuuacaugaaacgaaauaagggguccuugcaguguuuugagcagacagguaacaugcuucaacccgaucucaaaaguuauucucguucagcaaaaaaugacuauaaguaaaaguuauuauuauuuuuuaauucaaggucauguucagauguagaaagauacuaucugcaguggcaaaaugacuuuguuuacaaguuuugguaaccaugagaagcuuguuaaugauacacaaacaaguuauuaaaauuuaucacuguaaaauucagauacuuuuucaaaauccucuaugaauaugcagagucacaaggucuuacagguuaccacccagaaccaguagccaucuuugcuauaaaacuuuucagcaaauccugaggaaugcaaaaucagaguugcccaauugcccaaaagguggaacucugcuugagugucucaaccugaaaauuuguugauuacuuuauagagagaaagagaugaaaaucuguuaaauaguuucaauuuuuucuuuuuuaccccaacucauguaaauugaauucaucuacucuaacaucccaguuaaaugucaaagcuuugggaaucaagguagggauuuuuauuuauuuuucaaaguucaguucccagaaacaaugacacauuuuacccacaagugagaauguuguuaucuuguagguaauccagcuacuguucuaugaacuguaggucacuguagccugucuacaaaaugccaucaucagcuucaaggccuguguucacuaagacagccacauggaaguuauacugaacaggcaacccuaaaaugacugagcgccaucgccugagauuuauucccugaggaccaccaccaacugugauccagccagaauucuggcaggaaaauaaaguaaguucaccuucuguaaguuaaaucaaaugaacaauaaaucaaggcauguugggucauugggaacuaacugcucagaugcucauggccggugagugaaucaacuggcaucauuuuaaagcaucugggcauagcauuuuugagcuauagaacauaagaggagauuuuagcaaccaaauuauuaccaacgucagugauuggaguccagaacuggagcugcuuugauaguucauucguguauuccuucauucauucaacaaauauguguugaggaacuccuacagguaaauaauauucugucugcuaaaaauacagaacuuuacauacaguaaacuuguccacaugaaacuuaaaguuucaguuuuaaccuccucauggcucccucuuggagccaggaaccuuccagagcuaggagaccucaagaggucuuucauggaugggaaggauucagagacuguuuuagagugauaaggaacauaagguguacuaccagaaggugaaucuucacaggguaagagguguauguaagcaguaaguuuuauauucucuauccugaagccagagcaccuaagagcuucuuucauuucccucauccacccacagaagucaccccuaagaacugaagcauucuucaucccaccucauuucuggcacagcaaaaccagaaggagcagggaaaacacauucccagaggccagacauauuaagauacuggaaguaagcaaaggggcuaauagaccuaaacaaucagcuuuggggaaaagaagauccucucuguugcaaacagagcuaaaaggaacagccuagaacagagccuacaagccaaagacaguauauuagccaggcuucuccagagaagcagaaccaaugggauaaauguagauauacagaaagagauuuauugugagggauuggcccaugccauuauggaggcugagaagacccacuaucugccaucugcaagcuggaggcccaggaaagcaggagguauaguuccagcccaagcccaggggccugugaaccaggagagucaauaguguaagucccuuuggaucaaaggcccaagauacaggagcucugauaucugaggacagaagaagauggauauaccugcucaaacagagacagugaauuugccauuucugcacguuuuguucuauucacguccucaagagauugggugaugcucagucgccuugaugagggugacuuuuacuuagucugcugauucacaugcuaaucucuuccagaaacacccucgcagacacacccaggaauaaugagcauaucucuuagcccagucaaguugacacaaaauuaaccaucacuuguguccugccacguauuuuuguuaacaaagcuuuacuggaacacagccaguuauuuguuuacauauugucuauggcugcuuuugauauaaauucuacuguccaauauaguagccacuggccacauaaaaugugccuuauccaaauucagacaugguguaaggguaaaauacacaccagaccucaaagacugaguaggaaaaaaacuguaaaauaccucaucaauaauuuuuuauauugauuacagggaaaaaacuaauauuuuuaauauuuuuggcuaagugaaauauauuauuagaauuaaucucaucuguuucuuuuuacuccuuguaauguggcuacuacaaaauguaaaauuacauauggggcuuacaucugugguucacaguauauuucuauuggacagccuggcacagaaggaaagacuccaguauguauacagacccuggagacaaguugaauagaaaaacucuguucuuacucuaccuuccacuuuaugucuguuuuuaauacuccaaccccaggucuuucuuuuaauaauuauccuaaauuaacaaacacacaaaucugaaauucuugcaggucacuauugcugaaaauucaacagaagaaaaucuguguauaucagaauuucacacaaagaugggucaguggcugggcugcauaguggauauuugcugccuaccaacauucuuucuacuauagcaagacucuaagcaaacuccacaaaggagacacucugaaguuucaugaucuacauagaugcucaacuaagguaccaagucauuuaaugaagaaauaauaaucucuucagcaaauugugcuggaacaacugaauaaccacacaugccaagaauaaagcuggaccccuuccucacaccauauauaaaaauuaacccaaaauggagcaaugaucuaaauauaagugcuaaacuguaaaacucuuugaagaaagcauagggguaaaaucauuacccucacauuuggcaaugaauucuuauauaugacaccaaaagcacaagcaacaaaagaaaaaauagauaagugguaccuccucaaaauuagaaaccuugguacaucaaagacauuaucaaaaaaaugaaaagacaaucuacagagugagagaacauauuuguaaaucauauauuugacaagggucuaguauccagaauauacaguauaagaaauucuuacaacucaacaacaauaaaaacaaacaaacaaaaacaacaaaaaaaccagguaauggguagaggacuuuaacagacauuucuccagaaaaaacaugcaaauagccaacaagcaccugaaaagaugcucaucauuagucauuagggaaaugcaaaugaaaaccacaaugacaugcuacuucacaccuaauaggauggcuauuauuuucuuuaauggaaaauaacaaauguugguaaagauauagagaaacuggaacucuccaacaaugcuggugggaauauacagugacuuagccacuguggaaaauaguuuuguaguuucucaaaaauuuagauauggaauuaccauguaccccagaaaucucacugguagguauauauccaaaaggauugaaaacagguucuaaaacagguaccugugcauacauguucauagcagcacuauacacaauagccaaaagguggaaacagcccacuuguccaucaacacccaucaaugaaucaaaggauaagcaaauuguaauauauccauacaaugcaauauuauucagcccuaagaaaggaauaaacuucugauacaucuuauaaccugggugaaccuugaaaacaugccaagugaaagaaacaagacacaaaagaucauauauuguaucauuccauuuacauaaaauauccagaauagguaaauccacauagauagaauacagauugguggcugacaaggguuuggggaaaugaggagaagcugcauugaaaugaggaguuuuauuuuagaaggauggaaauguuuuggaacuggauagagaugaugauugcacggcacugucagugaguuaaacgccacuggauugcucacuuuaaaauggauuuuuuguuauaugacucuuaucuuaauaaauuuuuaaaucauauauuuuuugcauuucacaugucacaauucugaucuuuuaaauguaaaauacauuuuacauuacuuaacuauuucuaguccucacuucuccuccaaaaaaauuacauuacaguugacacuagauuuuguuaaacuacccaaaauuuacuuugcauauaucccucuugugcacaaguuagucagaauuaguuucuguuguuugcaaucacauaacuuuaauugauaugguaccuuaguaugucagucagggagccugaggucuaauucuaggucugcaucuaauuagcugguaaucucgggagaaauuauuuaaauuagcuuggcuuuagcuuucucauauguaaacugaaaggauuagacuaaauuauuccugaggguuuaaaauuccauaaaugacauaacaucuccuuuuaaaauauuauccaagaagaaguaauugucagauagugaugaugugacauuuuuuccaguaaaaaguaaauuuggaagguaggcccugcuuuuacucuaguuagucccuccaccucacucuucuggcuccucaguaauguuuagcaugcauauuccaauagauaaaaucccucaaagguguucaguuucauuucucugaugugaaagggcaaaucaaaugaaaugguuagagacaaugcucaaaauuuaaagcuguaucuaaguuucccaacucgauuaggccauucuuacauugcuaugaagaacuaccugagacuggguaauuuauaaagagguuuaauuggcucacaguucuggaggcuguacgagcauggcacuggcaucugcucggcuucuggggaggccucagggagcuuugacucauggcagaaggcgaaauaguagcaggcacuucacauggggaaagcaggggcagaacagagugugguagguuccacacaccuuugaacagccagaucuccaaaacucacucacuauuguggggauagcaccaagggacugaugcuaagcuauucaugagggaucagcccccccugaucuaaucacccccuaccaggccccaccuccaacacuggggauuaccauucaacaugagauuugaggagacaaaacauccaaacuauaucacuaaccgaguguucagauuguaguauagaaacuauccaagggcacuucaaauguuccucuuaucauugaaggggcugaacaauaauuugacccaaaagcuuggcauucugcuuuuacuagacuaggcugguauuauaaugaccuuuccuuuugaaaaacaauagugguuucuaucuguugucuuguaaagaugaguuuuauauuauuaagaauaauaaaagauuaaaaaauguuuuaagcauuucauccagaagcuacaaagcauuauguuggggaaguuugaggaguuuauuaggucaaucuaggcucuaauauacucagauuauugauuuaaaccggugagcacaauaaaucacacuggucauggagguggcaccagcugaaagugagaacacagaucaauuacccgagaguucugggcuuucucacugacuugccauuaaaaaauuaccuucgugguuucaccucaaagaucagucugcuuuguuuuuuuuuuuuguuuguuuguuuuuuugagauggagucucgcucuuucgccuaggccggagugcaguggcacuaucuccgcucacugcaagcuccgccucccgaguucacgccacucuacugccucagccucucgaguacuugggacuacaggcacccgccacugcacccggcuaauuuuuuguauuuuuaguagagacaggguuucaccguguuagccaggauggucucgaucuccugaccucgugauccauccgucucggucucccaaagugcucggauuacaggcgugagccaccgugcccggcccagucugcuuuuuuuaugcaaacuuugaccgcuuagaaaagcgcuacaagacuggagugguuaugcuuggcucuggugucagagugcuuggauucuagcuaaaauccacccagggagugucgcuuaaccuuauuuucucuccguuuccucaacuguaaagcaagaaaaauaauaguguuucccaaagccuggcacauauaccacugggaguauaccagaugauauuagaugguacaugagugguuuucuucuucuguuaacaauuauguguuuaauucccagcauauuaaaauauauauaauuagcacaucaaaugcuaugguuugaaugugucacccaaaguccauguguuggaaacuuaauucccagugcaacagagguggguccuucaaggggcaauuaggucacgagggcucuggccucaugaaugaauuaauuauguuaucagagaaguggguuaguuaucaccagaauggauuccugauaaaacgaaugaguuaggccuuuuucccucacucaugugugcaugucuuuuauccuucugccauuggaugacucaucaaguaggccuuugccaaaugcagacccuugaucuuagaugucccagccucuaggaccaugagacaaauacauuucuauucauuauaaguuacccagucucacauauucuauuauagcagcacaaaagggacuaaaacaccacacuaaaauuauugcguaggacaaaucuaagucaaggaaaagaagugcgcuccaaacaguccuagucagucagggaaaguucuuuacagaaaaagucuaguugacaaauggaaaauaauuaacagaauuagaaaucaugauuuuugcaauuacuuaaugacauaauugauuuaaguaacaaucaucaauugaagaaacaaucacaugaaaaauuaauauggaacuuuaaaauggaauagucagucuguuaccugccaaaaccaaugaugaaucucagcuucaauaaaacagguucugaauaguggaugcuuccuaauaaacguaguaaagacacccucugcaaagcauucuugccaaaaacauuuacguuaaaucaaauuuagagacagcaucccuuaagaaaaaauaagaguggugaaggaacacauuaaagaagagcauaugaaaccagaaugugugacuuccuacagaacaaaagauccugcuucuauaacaagucuacagugggaauggaggcaggauuucucuagguuaagagacuuaaggaacauauguaauauaauguuugaauuuguuugaauaugaaaauaaggaaaaacaguaaaugacauuuucaagucaguuggggaaguuucaauguggagcuggauuagacaauaccaaauaauuacuguuuauauugcuugauauaauaauggcauugugcuuaaguacaaaaaugcccauauuuguuacagcugcauucugaaauacaucagaguaaagugaagugaugucugcaauuugcuuuaaaauacuucagaagagaaaaagaaaggaggggagggaaaaagacaauaugaagaaaauguaguaaaaaucuugaugauuauugaaucuagguauacaaccugcuugauaauuugcaggacccagagcaaaauaaaaaugcagggucucuuauaacugcuuaagaauuucaaaacagugacagaagaaccaaauaaccacauuaaaccaaaugugggccuucauaagccaugggcucugaacaacucucaggcugcaugcacaugaagccugcucuauguguuagauaauauggaaauuaauugcacuauucacucuacuuggugcauauuuggaaaacuuccauaauaauuuaaaggggaucacuuaaaaauauauauauauaaaguaaagauuauaugaggaaauagcaaaaaucaggaaggcuacaauuggccgcaauuuccaagauacugauguaaucaugaaagacacucaauguggugccugacacacagcaaaugcucagguuagcuccuacuacuguugcuaccaccagcacuaccauuuugacaaagacuacccuuguaucuaguaagaaacaugaacguuuuauagagauuacuacaacaacauuuuacagaaagguuacuuuagacaucgugaaauccuuacugggagaucuacuuauauacagaaagucuuacaauucuuaccaauauuucugauuguauuuugcucccuugugcccuauauucuuuaaaacuugcgagggauuuccaucaaugacagacuggauaaagaaaauguggcacauauacaccauagaauacuacacagccauaaaaaaggaugacuucauguccuuugcagggacauggaugaagcuggaaaccaucauucucagcaaacuaacacaagaacagaaaaccaaacaccacauguucucucucauaagugggaguugaacaaugagaacacauggacacagggaggggaacaucacauaccggggccuauuugagggguaggagucugcggggguuagcauuaggagaaauaccuaaugcagaugacggguugauggguguagcacccaccauggcacauguauaccuauguaacaaaccugcacauucugcacacauauccuggaacuuaaaguauaaaaaaacaaacaaacaaaaaaacuuguaagggauaucaacugugggccacaacagcacuuagaacagaauauuauuacuaacuugaagauucuucugaaagccagacuccucuuuguaauucaagugacaucacuuacaguagcaaagaaagagcaucagaaugaaauaaguccuugugggucucaaucauggugaauaauacugugguuuuucuugaaugagaaagggcauuugcaaaccucaaagggguuuaacgaaaccuuacucuccccuuuaaauguccaaauuaagcuucuuuggaauaaaaccuucucaaaagaaagcaaauguaaaaguuagauuauuguauaugaccuaaaacauuugcugaaucacaauaaacacauaccagcaucuacuauagccuguuaccuaaaucaaguuucacagacccagagaauuccuccgccuuauuuuguuuuuuaaacauuggauugaaaguacuauugaggaucagcaugaucagugcaaaccuuauuuugcacaaagagcaauuuaggaaaaauggauaaggugauaggccaccaauuuauuugucuauccagaaugauaaugguuuuauuaaaucccuuaaagaaagaugaauuuuuauaagcuagacuaucuaauuuguuaaauagcacaucaaucugaauauugucacuguuuuuuaaaauacucuaauguuaauauuuuggcauguuugaauugaggcaacacagaguuuucuaaucguuaaucuuuaacuugaugaagggaucuacacagaaugaagcagacuacacacggcccaaggguaguggagaugugugugguaucuguugcuucuauuaaacauuugcacaugaagcauggguauaugcuagcagaagaacacuuucagacaucccaucccuauucaguuauccuucaaaucauauggcaacaacacaauaagagccacuuauaccuuauucccccgauggaaacucuuugccucuucagagagcccauaaccagcugagggcccaggccugacugguaaccccucagggagggagcauguccauaaaucagcaauauagcagagauggggcuucuuauccuuggcagccauuuucccugccuccccuuccuccccuaggacauccccucucugcccugguaugcaucuuggacacuggaugucucaacucaguuuagaacuuacuaaaacaagguuuaauaaccucauauuaaaauuuucaagacuggcugggcacgguggcucacaccuguaaucccagcacuuuaggaggcugaggcaggcagaucacgaggucaagagaucgaccccauccuggccaacaugcggaaacccugccucuacuaaaaauacaaaaauuagcuaggugugguggcacgccucuagucccagcuacucaggaggcugaggcaggacaaucacuugaaccugggaggcagaaguugcggugagcugagaucacgccacugcacugcagccuggugacagagccuggcuccaucuaaaaaaaaaaaaaaauuuacaagacuaccgagaauccgcaccuccuaagaaauggagaucaagucugugcgagucaucauuccucuugggucucuugauuuaucuaucaauuagcaacacuauuugaccuucuaccuaugugugaucauggauauuaaucagcccuucuuuuuacugauauaauuccuacuuuuucagaaaucugacaaacucacaauugcugauaucuacccuuuccuccuuacgaagauagaaaugcccaucuauaauuuauagacagguaugauuccacaauuuaaaaaauaaagcaaaaaaaaaaaaaauccgcucaacucaaggcuuauacaucacugauucccucaaugcccuuacuuggaaagcaguaauucuuuugagcuaauaaaaugcauguuaugaaccagaacaauaccuuaaagauauaacaaaaguaauuaugauaauaaugaaaaaagugagaauuucaaaaucuuuguguaguucuugaaaguauagugcaguauaaugugagaacugaaggcuguuuaccaaaaauucauauaucucuccuucuaaauauuuauuauuuuugaacagacccgcuuguguggccaggugacuuuagccaguggcauaugugccaauucuguuaaguauuuuaagaaaugguuuuaccuucuuucucuuucucucccuuccaccgucuggauguagauagcacuacggaccuagggaaaggcagaaacacaagaugggagacauaugaaauaucccaggaagaaaacucuuuugcagaagcacugauaccagacucuuacguaaaugaaaaaaaacuuccauuuaguuuaagccauuauuacauuuuggagucuauaaugcuaaagcagcuaguaucacccugguuaauuaaugaaguaaauuaaaugguuaaaagcauauaaccuaccugggacaucuuguagggcaguaagauggaaguuaaaggacaacaggauugaaacuuaaaguguucaaagaugaaaucauaagcaguauggaaccucggagguaaguugggguauaaaagaaacaaaacuggccaugagcugauuauuuuuaaaacagaauauggguauaugagaauugaucacauauucucucuaguucuguauauauuugacauuuuacacaauaaaaauuuaaacaggcagggugcaguggcucacaccugugaucccagcauuuugggaagcugaggugggcggaucacucgaggucagccguucgagaccagccuggccaacauggugaaacccugucucuacuaaaaauacaaaaaauuagcuagguguggucguggguaccuguaaugccagcuacuugggaggcugaggcaggagaauugcuugaacucaggaggcagagguugcagugagccaagauggugccacugcacuccagccugggugacaaagugagcaucugacucaaaaaaaaaaaaaauuaaacacuuuuuuuuaaaaaguaaggauaccuggaguucccacuggccuaggaagggaauaucugagcaucaaaaagguuaagaacagaaacaaauuaaaacauacaaaauuuuuuuuagaacaacagggagagguuccaagauggccgaauaggaacaacuccugucuacagcucccagcuugagugacgcagaagacaggugauuucugcauuuccaacugagguaccggguucaucucacuggggcuuguuggacagugggugcaccccauggagugugagccaaagcagggcaggcauugccucacccaggcagugcaaggggucagggaauuccguuuccuagccaagggaagcugugacaaaugguaccuggaaaaucauaacaaccccacccuaauacagcacuuuuccaacugucuuagcaaauggcacaccaggagauuauaucccgcgccuagcucggagggucccacgccuagcucggagggucccacgcccacggagccuugcucucuguuagcacagcagucugagaucgaacugcaaagcagcagugaggcugggggaggggcauccaucauugcugaggcuugaguaggaaaacaaagaggcccagaaacucaaacuggguggagcccaccgcagcucaaggaggccugccugccugccucuguagucuccaccucugggggcagggcacagcugaacaaaaggcagcagaaacuucugcagacuuaaacgucccugucugacagcuuugaagagagcagugguucucccaccauggaguuugacaucugagaauggacagacugccucuucaagugggucccugagacccaaguagccuaacugggagauaccucccaguaggggccgacugacaccucacacagccaaguaccccucugagacaaagcuuucagaggaaggaucaggcagcaacauuugccauucugcaauauuugcuguucugcagccuccacaggugauacccaggcaaacagggucuggaguggaccuccagcaaacuccaaaagaccugcagcugaggauccuaacuguuggaaggaaaacuaacaaacagaaaggacauccacaccaaaaccccaucuggacgucaccaucaucaaagaccaaagguacauaaaaccacaaagauggggagaaaccagaguagaaaagcugaaaauucuaaaaaucagagcgccucuucuccucgaaaggaacgcagcugcucgccagcaagggaacaaagcuggauggagaaugaauuugacgaguugagagaaggcuucagacgauuguuaguaacaaacuucuccaagcuaaaggaggauguucgaacccaucacaaagaagcuaaaaaccuugaaaaaagauuacaugaauggcuaacuagaauaaccaguguagagaaguccuuaaaugaccugguggagcugaaaaccauggcucaagaacuacaugacacaugcacaaguuucgguagccaauucgaucaaguggaagaaaggguaucacugauugaagaccaaaugaaugaaaugaagugagaagagaaguuuagagaaaaaagaguaaaaagagaugaacaaagccuccaaguaauacgggacuaugugaaaagaccaaaucuacaucugauugguguaccugaaagugaugaggagaauggaaccaaguuggaaaacacucugcaggauauuauccaggagaacuuccccaaucuagcaaugcaggccaaaauucaaauucaggaaauacagagacgccacaaagauacuccucgagaagagcaaauccaagacacauaauugucagauucaccaaaguugaaaugaaggaaaaaauauuaagggcagccagagagaaagguccgguuacccacaaagggaagcacaucagacuaacagcggaucucucagcagaaacucuagaagccagaagagaguggaggccaauauccagcauucuuaaagaaaagaauuuucaacccagaauuucauaacuagccaaacuaaucuucacaagugaaggagaaauaaaauccuuuacagacaagccaauacugagagauuuagccaccaccaggccugccuuacaagagcuccugaaggaagcacuaaacauggaaaggaacaaccaguaccagccacugcaaaaacaugccacacuauaaagaccaucaauacuaggaagaaacugcaucaacuaagaagccaaauaaccagcuaacaucaaaaugacaggauuaaauacacacauaacaauauuaaccuuaaauguaaaugggcuaaaugcuccaauuaaaagacacagacuggcaaauuggguaaagagucaagacucaucagugugcucuauucaggagacccaucuaacaugcagagacacacacaggcucaaaauaaagggauggaggaagaucuaccaagcaaaaggaaaacaaacaaacaaaaaaggcagggcuugcaauccuagucucugauaaaacagacuuuaaaccaacaaagaucaaagagacaaagaaggccguuacauaaugguaaagggaucaauucaacaagaagagcuaacuauccuaaauauauaugcacccaauauaggagcacccagauucauaaagcaagaccuuagagacuuaaaaagagacuuagacucccacacaauaauaaugggaggcuuuaauaccccacugucaacauuagacagaucaacaaggcagaaaguuaacaaggauauccaggaauagaacucagcucugaaccaaguggaccuaauagacaucuacagaacucuccaccccaaaucaacaaaauauacuuucuucucagcaccacaucguacuuauuccaaaacugaccacauaguuggaaguaaagcacuccucagcaaauguaaaagaacagaaauuauaacaaacugucucucagaccacagugcaagcaaacuagaaaucauaaucaagaaacucacucaaaaccacucaacuacauggaaacugaacaaccugcuccuaaaugacuacugggcacauaacgaaaugaaggcagaaauaaagauguucuuugaaaccaacgagaacaaagacgcaacauacuagaaucucugggacacauucaaaguaguguguagagggaaauuuauagcacuaaaugcccacaagagaaaacaggaaaaaccuaaaguugacacccuaacauuacaauuaaaagaacuagagaagcaagggcaaagaaauucaaaagccaacagaaggcaagaaaugacuaagaucagagcagaacugaaggagauagagacgcaaaaaacccuucaaaaaaucaaugaauccaggagaugguuuuuagaaaagaucaacaaaauugauagacugcuagcaagacugguaaagaagaaaagagagaagaaucaaauagacacaauaaaaaaugauaaaagggauaucaccaccgaucccacagaaauacaaacuaccaucagagaguacuauaaacaccucuaugcaaauaaacuagaaacucuagaagaaauggauaaauuccuagacacauacacccucccaagacuaaaccaaaaagaaguugaaucucugaauagaccaauaacaggcucugaaauugaggcaauaauucauagccuagcaaccaaaaaaaguccaggacccagauggauucacagccgaauucuaccagagguacaaagaggaccugguaccguugcuucugaaacuauuccaaucaauagagaaagagggaaucaucccuaacucauuuuaugaggccagcaucauccugauagcaaagccuggcagagacacaacacaaaaaagagacuuuuagaccaauaccccugaugaacuucgaugcaaaaauccuucauaaaauacuggcaaacugaauccagcagcacaucaaaaagcuuauccaccacgaucaaguuggcuucaucccugggaugcaaggaugguucaacauaugcaaaucaaaaaacguaauccaucauauaaacagaaccaaagacaaaaaccacaugauuaucugacuagacgcagaaaaagccuucgaaaaaauuugacaggccuucaugcuaaaaacucucaauaaacuagguauugaugggauguaucucaaaauaauaagagcuauuuaugacaaacccacagccaauaucauaccgaaugggcaaaagcuagaagcauucccuuugaaaccuggcacaagacagggaugcccucuuucaccaauccuguuggaaguucuggccagggcaaucagacaauagaaagaaauaaaggguauucaauuaggaaaagaguaaguccaauuguugcuguuggcagaugacaugauuguauauuuagaaaaccccaucgucucagcccaaaaucuccuuaagcugauaggcaacuucagcaaagucucaggauacaaaaucaaugugcaaaaaucacaagcauuccuauacagcaauaacagacaaacagagagccaaaucaugagugaacucccauucucaauugcuucaaagagaauaaaaugccuaggaaugcaacuuacaaaagaugugaagaaccucuucaaggagaacuacaaaccacugcucaacgaaauaaaagaggacacaaccaaauggaagaacauucuaugcucauggauaggaagaaucaauaucaugaaaaugguuauacugcccaagguaauuuauagauucaaugccauccccaucaagcuaccaaugacuuucuucauaggauuggaaaaaacuacuuuaaaguucauauggaaccaaaaaagagcccacauugcuaagucaauccuaagccaaaagaacaaagcuggagccaucacgcuaccugacuucaaacuauaccacaaggcuacccaaacagcaugauacugguaccaaaacagagauauagaccaauggaacagaacagagcccucagaaauaauaccacacaucuacaaccaucugaucuuugacaaacaugaaaaaacaagcaauggggaaaggauucccuauuuaauaaauggugcugggaaaacuggcuagccauauguagaaagcugaaacuggaucccuuccuuacaccuuauacaaaaguuaauucaagauggauuaaagacuuaaauguuagaccuaaaaccauaaaaacccuagaagaaaaccuaggcaauaccauucaggacauaggcaugggcaaggacuucaugucuaaaacaccaaaagcaauggcaacaaaagccaaaauugacaaaugggaucuaauuaaacucaagagcuucugcacagcaaaagaaaccaccaucagagugaacaggcaaccuacagaaugggagaaaauuuuugcaaucuacccaucugacaaagggcaaauauccagaaaucuuccaagaacuuaaacaaauuuacaagaaaaaaaucaaacaaccccaucaaaaagugggugaaggauaugaacagacaguucucaaaagaagacauuuaugcagccaacagacacaugaaaaaaugcucaucaucacuggccaucagagaaaugcaaaucaaaaccacaaugagauaccaucucacaucaguuagaaugacaaucauuaaaaagucaggaaacaacaggugcuggagaggauguggagaaauaggaacacuuuuacacugcuggugggacuguaaacuagugcaaccauuguggaagacaguguggcaauuccucaaggaucuagaacuagaaauaccauuugacccagccauccuauuacuggguauauacccaaaggauuauaaaucaugcugcuacaaagacacaugcauacguauguuuauugcggcacgauucacaauagcaaagaccuggaagcaacccaaauguccaacaauagacuggauuaagaaaauguggcacauauacaccauggaauacuaugcagccauaaaaaaugaugaguucauguccuuuguagggacauggaugaagcuggaaacaaucauuuucagcaaacuaucacaaggacagaaaaccaaaaaccgcauguucucacucauagguaggaauugaacaaugugaucacuuggacacaaggcaggggacaucacacaccagggccuguugugggguugggggaguggggagggauaccauuaggagauauaccuaaugcuaaaugaugaguuaaugggugcagcacaucaacaugguacauguauacauauguaacaaaccugcacauugggcacauguaccguagaacuuaaagcauaauuaaaauauauguauauauauuuuuaaaauccauaacuucauaaugacacaugcaugaaaacucauuagacguuaaugaaugaaugccuaauaacuucuaguugguaaccaauguuaccaaauagaaguuauuaggcauucauucauuaauuaaaaauuaaaauaugauaaacaauuaauuuccugccuaugugaacuguauaucagaguaaccaaaugguugauaagaaaaaguuuuuuuauagaucuccaugaauaaaugcaggagaaaugacacaacuagaaaacugcuauuuugcauccccuaaugauauaagaccuauauccagauauaggaaacuacuaugaguggacauaaaaccaucaguguaagcaugauagggaacuugguaacagaacagucugacaauaccugaaugaacuaacucauguuaucuucacuaaaaggacauauaucauuauuuccuucaugcugugaugaaauaggacauacauagcaccaucuaugaaguauucuugccuaaaaaaucucuauaaaaucuagccaagacuccagacuaaauaccagguuauaguggugauuggguucaggacaugcuuuccuaaaauaugacaccuugguauuuaagaaaacagcagaagcgggaaggucacucucaccuucugccguucucuccugaagcaggucaugaaccaauggaaggauuuuuuugagcguccccuggagcaggucauaagaccauuuuagaggugcccuccuuauacauggaggaaaggaacauccuuaccucugaagacacagggacacagagaagaagcugaacaaacaggccuugcuaaguucccucccccaguuuauuaccauuagaucacacucccaaucauauguccaaucauacuucaccucuucccacucuucaucaaaccuagcauaaaaaguacacgguuuaaccauuucuuugggccuucauuuccuuaugaaggcucccaugucacaugaaacuuauauuaaauaaaucgguuugcuuuucucuuguaaaucuaucuuuuguuauagcggcuuccaucauaaaacuaggaugggaauaaaagguauuucuuuucccauacagagaaauaaauuaaacacugccacaaaaaagcgaacagccaucuucaaaauauagagcaaaugauccaguuucucucacaaaucaaaguuauugagaggaaggggauaagaggacuaauuaaaaaaaaggagacaagcaacauaacaauucaaugcaaugugugaaucucuuuuagauucugacuugaacaaaaccaucaacaaaagaacaauuagggaaaugcaaauauggacuggauauuagaaaauauuaaggaauuauuauuaauuucauuaaaugugaugauggcauggaauuuaaauaaaggagguaaggcccuuaucaguuagagauaucuacugaagaauuuucaggugacaagauaugauauccagcauaugcuuuaaugcgcucaagcaaaagaaaagaaagaacgaaaaaauaaaauggggacagaggaaguaagauuggcaagauauugauaauuauuaaagcuggaugaugcacgcauggguguucauuaugcuauuaguucuacauuuguguauauuugaaauuuuccaagauacaguuuuuuaaggcacaagauaggagucagacauugguuggaccagcccuuucacuuccagcugggagaaacugggcagaucacuacagccugcacauugcccuccuuugugucaucaagugcacagauauuucuucuaagaaugcuccaauacuauuccuuggauuuucuuccgagccauagacaccuauuuugugaguuuugaugcuucccuuucaauacucauacacgugcagacaaacaacaguugucccaacugcuaccuaucugaagugauuauaagugacuaucaauuaugacauauaucccaauuucaaagauuaaaaugugaaaaaaaugugcguuaaaaaaaucuaugaagaaagagaccuggagaugaaguuauaauaaaaaugucuaugacaaugagauuuucugaauaccuacaaggcaucuccugcuuuggcuccauaaguaccacuaucucuguuuguuuguuuguuuguuuguuuguuuguuuguuuuugagacagggucucaaucccucguccagacuggagugcaguggcaggcacuccccaggcucagaugauccuuccaccucagccucccaaauagcugggacuacaggcaugcgccaccacaccuggcuaauuuuuguauuuuugguacagacgaggcuucaccauguugcccaggcugaucucgaacucuagccucaagccaucugcucaccucagccucccaaaguucugggauuacaggccugagacaccaccccuggcuucuuggguuauuuugacugacauaucucacuggcuaaaauacuuccauuuuucuagaagcuacggcaacuaccacuggguuggcaaaugacaggcccuggaaauguuucugauagauguuuguugcaugaauaauaaauaugcaaauuuuaagccaaaaaagaaauauaacacaugcaaagagauguggggagucucgugcccuucuguauaaaguucuggaagcuaauuuuggaaacucuaucaagaaguugugugugacuauuuuuccaaaguagagucaaaauucaugaggcagggcaaaaguuacacugcaucuaaugaugaguaagaaugcacaucuguucccuggagcugcucucuauacacauauucuaguaauuuccacacaccaucagaagauagaagauggagaaaaccaguaaagauauaaucuuugagaaaagacuuuuguuggagccuaaacauaaacuuuuccuucaaguccauguccugagagagguuuguaaaugugugaccuaaaugaggcuaccacugaauuuuguuucccaauaucccucagagaggcuauaaggcauauacaaauucuacuuaaaagcaaaucaugguaaacauuuauuaaauuuuauuacgcaccaaguaccacacucguguucuucccaggacugccaaaguuggcugaacccugaugcaguaacucugcagauguaccuauaacaucucaacuaauccuagcagcaacccugcaaagaacaguaccaccuuacuuauauuuucaggauagagaguaugaccuuuagaaagacuugcuaacuggcccaaguucgacagccgguaaauagcauauccaggacucacacccacggcuaugaaaaaucggugcuugcggcuuguguuuuucaccuaaauacacaaguguuacaugaaugaacugugauggaggaucagcauuguuccugccaaccacacccaccugcagucuagcgcagaucaauacuuuuacaaagugcaaugaaaaugaaucacuggggaauaaaggcauucaaaguaaaagucaaaaguuguuauuggagucaacagacaaauuuaugcuguuauugcccacgaguuucuaaauccuuacucucaauuuauaugcuuauuuuguugcauacuggcaccaggacaaggaccacccuuugaguagugcugcacuacacuuuauuguuagauccaugcuuagaaugaacacauuuauaauaagguuccaagaucccuccaccuauugagaggcugguaauucuuuuagauguuaauuaaucuauuuuuuuuuaaaugaagaugacuuuuagcauuuucuucuuuccuauaaagauucaucaagauaucagacauagguuccaaagucaacaaaaauaaagaacuugugaaauuuucugcugcuguaugauacaacugcugugguauuuugauaaauauuaacagaaaaugugaaacuuugaaauauguuuccuuaccaagggaacaaugaauaauaaugaaaccagggaaugaggacuagaagcaccaggugcccccgccucccauccacugcagggaaggacucucuuccaaauccacccugaaaagugaguggcuguugggaaacuaaaaaauguacuuaagagaucucaaauauauggugacacauggaauucuucaaccugccaugccucuugagaaguucucagguaaauaacaagaaugaugcccacaauacauucacauacauaaaaaaaauguccuggaaagaaaaagaggaugggagaagaaguuaaugauucuuggggcuuuuuaaaaaaauuguguucggcugggugugguggcucacaccuguaaucccaacacuuugggaggccgaggcagguggaucaccugaggucaggaauuugagaccagccugaccaccauggagaaaccccaucucuaccaaaaauacaaaauuagccgggugugguggcgcauggcuguaaucccagcuacucaagaggcugaggcaggagaaucacuugaacccaggaggcagagguugcagugagccuagaucgugccauugcauuccagcaaccugggcaacaagagcaaaacuccgucucaagaaaaaaaaaauuguguuuaaaguuucaaguuaauuuuuuuuaagucaccauagcucauauggccuugguaugaguugaugggucaaacccauagcuucucuggcuacucaggaaauuaguaaaggagggcaaggaaaggcacaauauggaagagagaaauuacuagacaagaaucagcaaucuggagcgaacccaaucuaaaggaaacaauuagaaacuggcacaggucccaaaucaauaagcagaggugacugugggcagugagcauaauggcuggguaaugaaaacuaaaaugcagguaagcaagcgcugggaaaggagcagcugaugacagggucaucuguccagaggcuugaagagaccugucugaacaggcucucacagcccagcuagucccugaugucacagccugugugaauaaacagcacuggugugguauccccaaacuucauaagaaaugaagucuucauggcucaccuugucaaggccagagaacaaucccaacaggaaaaacacuucuuacagauuaugcaguggauucaaagagcacuggaacuguauuucccauuagcucuaauggagguugugcuaauaaauuccccagcucugggcugaacagguguaauucaguaauguagcuauaauugagugaugucaacucaauauaauuuguaauguuuuuguaacaaauuaucucuuuuuuuuuccagaaaaaaaggcaucugugauuccauaugauaaauuacuuuaaaagggugacauacagugcuaaugauaaagaucuuuaauugauagaaauguuaauaguagcaucagcuaagaauuaucuuugcugauucuuuauacacaguaacauuuuaaacauaacaagcuuucguuuuugaccaaccaauguuuuugauuugugacucaugguuuucagauauuucuguauuucaucaauauaacuauucuacuagagagguucuguauaaacccugcaauuuagccauucccuucccugcacaguucccaagccagaucuagacauuucuaccucugugccuaagagaacacuggucuccuggucuggauggacagcugucuccuccucuuccauguaccuaagaaugaccuguuggcccagucaaaacccuccuucuaugaagcuuuccagaccuauagccaggauuacucuuucacacccuauaccccugggacacuuuggggucccucuauuacauucuuacuuuucagacccccuuguacaugcuauuccucugcugcucucccugguuagggcccacucauccuugggguuucaguucaacguuauaccucaaggagaaccuucccugcuuuggaacagggcacauuacacgugcauuugcauaccucugcauuccuuuccuuuguugcacuaaccacaguuguuguuaguaucuuuuguuuguuuguuuguuuguuuuucaggaaaaaaaggcaucugugaugcgucucuuuuccacuagggcuaggcuuuagacaaggucuguguugaguuuuccuaaaucuaguagcaaggacaugaugcuccauaucugaagaaagaaugcauggaugaaugaaugaacaaacacuaucucugucugucucucccuaccucuaucuguccucuccacuaaacuugaacucaaagguaauacagugcucauuguagccacaauaaugccuaauuagggucucguccauaauagagaugagaaaaacucaguugaaauaaauuuaauuucuccuacuguaguguuaacaucagguuagucauagagaauucaguucccaaagcuuauaguguuuuucaccauaugcuauccacugacccucaucaagcuccaaccacgugcuagccccucugcaagauacuguggaagagaagugaaugauauuuagaaccaaguacucuacaguuucugggugauucccauguauaaccacauuucugcauucaugccagauacugggggaauucaagguuaaucaaacacagaugguguccucaaggagcucaggaucugggagaagagauaaaagugaagaaaaaauaucaugagguggaauccaugagugacauaaaaggagucccaauacagauucuagguguucuaaugagggacagagagaauguaggcuuaaguggggguauuuuuuuuaaguuuuauuuuuaauuuuuguggauacauaguguauauauuuauggguugcaugagauauuuugauauaggcaugcaauguguaauaaucacaucaggguacggucuccaucaucucaagcauuuauccuuuguguuacaaauaauuaaacucuuuuaguuauuauccuaaaaugcacagauaaauuguuuuucacucuagucacccuguuguguuagaaaauacuaagucuuauuuauucuuucuuacuauuuuuuguauccauuaaucuuucaguggggacaguuuuuaaaaugagucuuuaccuguugggugggauggcucacgccuguaaucccagcucucagggaggcagaggcgggaggauagcuugagcccaggaguuucagaccugccugggcaauauagcaagacaccaugcuccacaaaaagggaaaaaaaugagucuuuacccaggugaagauugggauuagggacccagccaaaaggaagcgagguugaagagcaagaguguuuauuccuugguucaauagaucuuugucaccuacugugugaggcauaaauaaaccuaaguccauucucaaugcagcuuacauucuaauuguggagacaggugaaagcaaacaaacaacaaugccagguuauaaugagugcucugaaaaaacagggcagaguaagaagcgaagcugaugagagugcuaccccagacaagguggucaggggaggccuucccaugucaaugacacugaacaaugacuugaaugaagcgaaagagugagccauguaacacgccuugggaagugcauucccaacagagaacagcaauccucuccacagaggaaggacagaugacccacaccuuuuucaaacuggggucucugagcauguucuuagggaucugaauguucuugaugagacuuuuuauuuuugguuuuauuuagauaauacucacuuaaaauaguucaaguguauucugcaucagcuacauagcaccuaaaauacggguaccagcacaaaaguuuugugacuccuuuauguuugcauuuauaauuguggugguaucagguauugcuguuuuagcugucacaagcaaaagauaaaaaaaacaaacuuacuacuuaaauaauguguuugugccucaugaucucagaguagggguggaguacauaugaauugucccaguaauagcagcuggaaguguuagggaaauugagucaucacacagccuaggcuaacacaaacaugacaagcuguguagaaccuuugacauaacagacaucccguauugauguuuccagagaugauucuguuuaaacaaauaauaucauucaucuuguuaaugcaauauuccucauuugaauuuaguuuugucauuuugauugcauguaauuuguaaacguguuaugguuucauauuugucuaagaaccacacaaagaaauucauaccuacuuuuguauuuucaugugguucaauaauccaauaacaaaaacauuaaguuaacauuggggguucauaagacuuuuuuuucccuuggaauggcauccauauguuacucaagguuggucacagugaaagcuggugguggaaaaggccuuuguuuuccagaaccaugaccaggugauagcucuggaugguuuccaaugaaacacacaguaaguacaggaaagaagggagaugaauaucuuugguaggaaaaaaaaaaucacaaaucagauauaccuaaugacuguaacuuuuauuauucucugaacaccaaggaacguaaaggccauaaauuauguuacauguugguuaauucuccuucagaacacccaggccauuggaacauuaaauguggaaaguauguggcgggggagagagggugaagaagcuauaaugaaagguucacugcacucggguggcagauuaaacacagagccagaugaggagucaagcgucacuaaaaaugcaaaacaaauccagcuaaauuauuucaccugcaaggaaaaguuuuucucacaacacaacacuguucuaugccaacaaauguaaacaagagcuaagacgacuaucugaaaagcucaggcaguuggugaggaaggcuccuugggucacagaacccuccaaaacuucucacuguagcagcugagagcuggcaucugaaaucaaacuggguagaguucaagaaucaccucuaacagagauuagcucugagaccuagcaaguucuuuaauaucacagaaaaaaaaaagacaaaacaacaccuacauuacaaaguuguugaaaggauucacugagauaauccucauagaccacuuagaacacugccuggcacguaauaaguucuccauaaacgugagccaugaguuuuaugaugcuauaggucuaugauuauauaagcaugagucuccacauauggcacaacaaacugcucuacucaacucuacagcccuggaugaugucuccacauuuuacauauuccaugauaguuuccaauaauuuauauacauguaaaguauauuugagauggucgguaagauaacaucauucucauucauuccccuccccaauauaguuccuaaggaggaaagauaugaauagugcuaugguuuggauuuguguccacgccuaaaucucaugucaaauuguaaucuucaguguuggaggaggggccuggugggaugugacugaaucauggaggcagacuuccuccuugcuguucucgcaauaaugagugagaucugguuguuuaaaagugugcagcacuucccccuuuagucucuuucuccugcucccaccauguaagaggugccuccuuccucuucaccuucuaccugaggccucuccagccaugcuuccucuacagccuguggaaugugagucaauuaaaccucuuuucuuuauaaauuucucaguuucagguaguucuuuauagcaaugcaagaacggacuaaugcagaugggucuacagaaagagcauaacccaacaaccuuacaugguagguaccauuauugucccuauuuuacaaauaaacaauguccagagaagaggauggacuugcucaaggucauacagcucauaaaugaugcagccaggauuugaggucaaguagucccagucuagaaucuaccuucuuaaucaccacaagacucuacuccuccaaacaaguguccuuccucuguguccaguaaagaggaacucugggaacugcuggucacauaauuguuuauuccuccagguuccccaaugucuggcccuagaaaaugaggauguuucacucccaacuaagcauuucccuaagcuacuauuuguuaugcuguuagcuaagauagaaagucaauuuuaaaaucguccauuugaacaguuauaguaacuuucguaaaugguaaaugaaacaauuugaaaacacuguccaacauuuuacacaguaucccaucgaccacagcuaacuaaaguaauucacaugugaauuuuauucucaaaaaaaguguaugcuuugcuuuugacagauaaugaaagccauuuaauucaauguggcuuuuuuucuuugcuuuuuccuuuuuuuuuuuuuuuuuuuuuuugccagaaagcagugagauaaauugaauacccauaaacugaagaaaaucuguuaauuuggggugucugguuacaccuauucuugugcuuuuuuaaaagagagucugccaaaguuuauucucuucuuaaauuaccucaucugagcaguauuuucauuuguaaauaauggccacauauucucuuuaaaguaggaggaaauggagaccuuaaguguuucaaggaaacuucaggucccucaaaccuccuucaaagaaaacaacugaugauugucuuugaggcaaggagacacuagucaucaggccaucaagggcagggaacaaccugaacacuuugcagcucugcacuacagguccucaacgucguucuugcauuagcccauucuugcauugcuauaaaguucauucaaugccaucugguuauaacaccgacagaaaauaaauugauucccaguggggccccugucuauguagggucugaacauucuccccaugcuugcaugaguuuucucugggcagucaaguuuucucccacaucccaaagaugagcaugguaggugaaccggcaugucuacaugguccccaucuuagugaguaugaguguguguguguagguguguaggugaguggguccugcaaugggaugauguccuguccagggugaguucccaccuugcacccugagcugcugggacaugcugcagccauccgagacccucaacuggaauauaaauaauuaucuuaccuguuuuuauuacucuuucuuaaauguguauauaguucgcauagauuucaauguaaaauauucaaaguguuuuggucuauuuagaaguuugaugguauaguugugaccagaaauaugccauaggaacuuaacucuuauuuauaucaauuagucuauggugaaauugguuauauguugcuuugcuuuaugucccaguuuccaggaaccuaucaaugacauuaaguaaggacuuacuguacuuuacuauagcugaacaggcugccacccaaaaccauaaugagcuacuaugacgacagucaaucaggagacauaucuguguuucagagaagaaagccagcagcuuucugggaaaaagcacagagggaaacuccccuaagcuggagcuauuuccuagcaguaacuugcugcugcaguuuagcccugucaucuguguguacuccucauuaaguaccacauuaugggccaucauaucuucuccagcugcaaguaaaggcaauguccuggaauugcccuauggcccaaaugugugacuaaugacugagacuuuggcuucuugcuugauguuuggccuucaguauuacaugaaccugcucugaaagacacaacacugucacagauguaugcggacagauuaagcuccagauggaaggcugucaaugucaaucagucacuguucuuacagccuggcuggcuuuucaucuaagcaaccacagagcaugauccugcagcacucaguuccuuagcucaauuaagucuuaggauuggaggucaaguuacccugguuuccuaagcauucucuaccaaaugauuguuuuugccucacuccuacugauucauuuauaguagcuucuuuugaugcauucauccuugagcaugucuucccauuuccaagugacuuguuucacuauucugcagaauguuccagcccuuugaugaacuauauauaauugucgaaucagcugucccacaaagagauaaaaucugaauuaaauacaggacuuguugucaggagagaacagauaaggugaagaauuagaagacuagcugggaagaagugagaugauugaaguuuaugaaacauuuuccccccuccuuugagucucccaaucugcuaguuucagucgguugguuuuguguuccuguugugauauauguuuaguucaaggcuguggacuuugugccuugguuacagguaagugccucuguguuucucaucuuuaucuauccagucacuugucuccucucaaaguuucacuuuuuaaauauauauauguuauuuaauaucaaaagaauaucuucaccuuucauaaauugcuaacccuagacucuggaugccuaggguaaauuuuuaauucuauuuuauuuauuuuaauuaaauuuaaauuaaaauuuguuuuaauuaaauuuaaauuaaauaucuaauucuacuuuuauuuauuuauuuaauucuauuuuuaagucuauggacuugcuugaacacacagcucagcaaugaugcaggcaggauucaaguccaggcaaaucauggcucuagagcuuguguucuuaacuuccacaugacauugucccucgggaggaauauuguaacucccuacguuuccauuccaaacucucaaauauaaaaugauaauuacaagguacacguuauugcaaaacauguauaaaagcauauaaaucaaagauuacauuuugccuccucuucuuuuucccaucccucuacccucauauccacacaauuucauucccugagggagccuauauuaauaauuuggcauguacauuuuugcauacagacauauauuuuucuaaguuucuauaauacauacuguucugucacauguuugacaucuuuucaugucaauucauagagaugcuuguuaauggcugcagaguaauuucaauguauagacauauaauacuauauauaauacuauauugaaccucuuuagcuacuuggucaaauauaucuacagaauacguuacuagacauuucaaggaauuucuaugucaaaauauuucaaauaguuaauaguuccaaacuucccaauccaaguauaauauuuuuauuuauauccacaacaggguaucccccugauuuugcccauagugcuuauuauccuaaccaacugauugauauuuuuaguuuaauuauuuaaaaaaugagguuauaaugaggucccuaagagucccuuaaccuaauuuacuaggaucuacuuuaucuggagaguaaaauaaagcaacuacccaaucucaaaauauccuuuugccccucccaaaugacucuucuggaaucauuuauaugcugaccuccauauaauuuauuggauuuauacgaucuuauaucucuagauugaguuacaaauggaugaaucucuugaaaccuagaccaaaaaauaagaauagaauaaaaaaagaguuuuugguauggaaacugugacucuccaacgucaguagagacauugagaaugguuucccauguccccaggcauaaacuaaaauauccacugcuuuuggacaguauaaaugcagaauaugcccccagaugaauagaaaugagcaaaucuugagugcagaacugaauuucuuggagcuguauugguuaccuggagccaugaauuaaguggaucugauucuaucucuuaaaggaacagaaaaaaaauuauuccaggugauuacugcuccucaagcauguggucacucaaaggaccuucuucuagcuccacgggauacauaguugcuauucaucagcucugcucacugaagaugcugugcuacgcauuccaaauggcgccuuggaggacuaacugauaucauuaacacagacucguagagaugucaucauuuucuucuucaucaucuucgucaagauuaguuuuaaguguugggaguccgagguggguggaucacgaggucaggagaucgagaccauccuggcuaauauggugaaaccuggucucuacuaaaaauacaaaaaauuagccggguguggugggugccuguagucccagcuacucgggaggcugaggcaggagaaugguguaaacccgggaggcagagcuugcaaugagcugagaccgcgccacugcacuccagccugagcgacagagcgagacucugucucaaaaaaaaaaaagauuaguuuuaagugaaccauguacuaguucucaaaucaaccacaucggguagguuccauuauuauuuaauucugcagaugugaauacaaggccacaaguucguaagugauacugccggggcucaaaccacuuauguauuaugucaaaagccaugcucuuaaccauugcacuauacucccuucuacaggcauaaaauuuuaaaaauauauaccagaagagcaaaacaaucccaaguaugggaaggaugaaagagaaggguggcaguuggcacaguggagcauaaugggccagucugacuguaagacuccuguuucauaaugucugcaugucacuaaaaaggaucuagaccaagguucacaaacacaaaugaauaugggggccaggacguuaacauacaugaguaaagaggaccaagugcaugacagaaagaguggugaagaacgugguaaacugaaacacaugccucaagggaagaaggcaauacucucauguguguaugugguucaaauguugccaaaucuaugaauuuuuuuaacagaagaaaaaaaauccaauuuuaaugcaaaauguuucuauuuccaaauuaugauuucaaugucauguuuaaaaacacuuugacgaugacuuaguucccucugaccuccacacauaagcauuaacauggacagaaguauagcagcagugugaggugcuuuuccagcagccaucaguccuucauccuugcuaacauaccuugaucuuucucagguaccugcaggugguaguguguccagggaagauaggccuuacucucagcauaagaggcugaaacguacuggucucagccagugaagguaacugaauacuucauugacauugacuggucugggaugggaugcaugugugacucaguucuagccaaagagaaaucgaaagauaucugcuaagagacuuuaaggaaagauuuucuuuccugaaauggaaagagagagagaggcccaccacgagauggcccuuuuugcucccuucccuccuauccuguguugaaugcuaauccaggacacugugguguugaaagcucuggcagccauuuuguggcaugagguaacaagucuaaggauuaaggccaauacaccgccaaugguggaaugaaagcaugaaaggagcuuggauccuuguuuagcagccaaaucaacacugagacuacuuaauuugagguuucuuauauaggaaacaguaaaucuccuugugauuuaugguacuauuaguuggguguucuguuacuucauacugaauacauucuaaugaaggaucucacuuucaaccuuacuucagaguucuagcuuuuuguuuacagcauccuucaugcaggaaaacuucaaguuuacacagagugugcaacuagaugugagauaaggcucugccacuugagaacgcccacacgcugcuucaaaaauuuaaauuaugcuguuagcuuuucaagauggaugaaauccuucauaggaucauauagcaaggacuaaauugcucucacaguugccaggcaacuguguauaugcugccuagagacaaaaauucaugacccuugacuccccaaaggagagucuuuacccacaacugauaugcaugugcccaagucuaacacuuccauccagcaaaggucaugguguacaucugggcuauccaacaucccaagcucauuauacugccaacuuauaucauucuugaucacaccauaaauuaugauuucugcaugcaaauccaaaugacagagcagagaguguccuggggcauaauucccuguccuuuggccugucuuauuauauagacugauuggguaccauccaggcaaacaaaaaaaagacacaugaagauuccuauuagccugaagaaucacugucagguaaacagaguuuuguaaacagcuuccaauauucaaggaaaguuugaguuuucacagugaguaaugugaucaacuuuaauaaugucucaaggggcuucuaucucacgagucauuuucaacacacacacacacacacacacacacauacacacacaggcuaagaugugcucaucauucuauuagaaaggaaaucucaaaaugcaaauauagaugguguguucacauuuacauuucauaaugaucuaaguguuuuguuuuugcaugugaauuucauaauacuuuaaaucauagaaucauggaauauaaaaaucaaaagugacccugagaucaagaagguccaauccaagagaaauuaaauggcacagcugcuuaggggugaacacugaauccaaguugcuggacucucagucuacugcgcuuccccaaaacuaacaugcuugucccucaggcagucaacccuuaaucauugugaugauaaacaucagggacaacuuaauuucaacuugacaauaaaucaaacucuccauguagccauuaguugcuguacuagucagaaaaagguuaaguugaaugugaaccacucuuucacuaccucccaccucaaaaaaaaaaaaaaaugaacggaagcuugaauauacaagcuuuuauucucucauuuaacaaguuuggagaucaguagucuagugcugacauggcaguucuacagacccauuacagaccuagaugccuucaacuuacuguaucuccauuccuagagggugacugucuuagucugcuuugugccgcuauaacaggaccugagacuagguaauuuauaaacaacagagauuuauuagcuuacaauucuggagucugggaagcccaagaucaagggcccacaucuugugaaagacuucuugcuguguuacacauguaauaaggcaccacaugaugagaaacagcacgcaaaggagcaagaagugacuaaacucacuuggauaacaaacccacucuugcaauagugaacccauuaacauaauaaugacauuaauuuauucacggggguagaucccccaugcccuaaucaccucuuaaacaacccacuucucaacacuguugcauugaggaauuaaguuuccaaaacauaaacucugggggacacauucaaaacacagcauucaucuucuuaacauagccaaaaaggccgggcaugguggcucacaccuauaaccucagcacuuugggaggccaagguggguggaucaucugaggucaggaguuugaaaccagucugaccaacauagugaaaccccaucucuacuaaaaauacaaaaaauuagccuugcguagugacauacaccuguagucccagcuacucaggaagcugaggcaggagaauugcuugaaccuaggaggcaaagguugcagugagcagagauugugccauuugacuccagccugggcaagaagagcaaagcucugucucaaaaaaacaaaaacaaacaaacaagaaaacagcaaaaaguauuaaugagccguuaugucugcaccccaguuggcagcaaggaggaagcuguaaugcaucuucucuuuaagaauucuccuaguuaguguaccccugaaagcaaagccuaagacaaggaccaagggcauagguuuggguagauuauuuggauggugaucucagaaaauuugaaagaaagagaugagacaguaaacacuggaaggaaaaaggaaacagcauguguuaucaacaccuggggugcuaugugaggagcuguguggaauguacccacaacuguccaucugauagaaggcuguggcaacccaccaauugguuaagcauugccuguagugcuguuacuuccccggcuaugcuugugcgugggcugggaagccuucuuuugguuuugaguaaggccuaaaccagaauaguagauguacagcacagcagaacuugaggacccuggcagcacaugacagcaucugccacagcugcaaugaaauuagguggggauagggaauguggcacugugcaccugcuacaagaaaauguccagaaaguugcucauaaaguuucuuauuaucucuaugcaucaggaguccccaagacaauccuuagacucaaugauucacuaaaagacucccagaacccagaaaaacuauguacucauggugaugguuuguuacagagaaaggacacagauuaaaaucagcaaaguaaaaagguauauaggaaagaauccaggagaaaacaggcacaaguuuacaguguccucuaccaguaaaaucacacagcugguucuuaauugucccagcaacuauguaugacaacauguauaaaguauugccaacccaagaagcucaccugagccuugguguccaugauuuuuauugggggucagccacauagacauggacuucccacacgaaugaccuuaauuacccagucuccaguccccccagaggucaaauugauacaacauagcccagggcuucaggugaacagaaacagcauucaccaacaaucacauugucaguauaaacuaucuggcaagacccacaguuucagguauucaaaggcacuuuucucaguuagggugcuucaaaagcuccaagguuaucucuuuggagauggucaagggccagucuuuuauuugguaucugcagaauuugaacaccccaagccuugaguuaacccuuuacugaacaaccuguuuggucagaacuuagucaaauggccauaaccaccugcaacaaaaguaagaaaugcagucuuuguucugggcagcuauauuccuacucaauauuugggaauucuauuauuguauaauggugguucucaaacuucagcacaucagaaucaccuggagaauucauuaaaauagacugcacaacccccuccucagaguuucugauuaaguaaguguagggugaggccugagaauuugcauuucaguaauuuaccagguguauuacuauccgaauaaagccagaacaaauuuacacaaacuuugggcuuaaaacaacacaaauucauuaucuuacuauucugugggucagaagucugacacaacucgcaccaagcucaaaucaagguguaagcagacuccuuucugcagucucuaaggaagaauguuuccuugcucauuccgguuguuggcagaaugcaguucugaaguccuguuuccuuauugccugucagcugaagaucauucugaauuucuaaaggccuuccacauuuguuaggagguugaccccuccuuccaucaucaagucagcaaugagggguuggguucuuuucaugcuuugaaucucaccugccuccucuaucgccauaucuuucugauugcagccugaaaagguucucugauuuuuagagcucauuugacuagacugggcccacccagguauucaggagaauccccccaucucauggucuguaaucuuagucacauaugcaaagucuguuuugccagguaagauaguauauucacagguucuggagauuaggguguagauaucuuuggggggagggcgcaugauucuaccuaccacaccagucaguucacucugauucugugguuagggaacacacuuugagaaccaccaauauagaaaauaagagaaccagaagacucuuccacaauguagccuuauuuuacauuguuggaaagucaaugaaagcuuuuaacaaacugguugacugcagcuuuaccucuucagugggccccuuuccuacucaaaaaguaaugagaaaaaggcagcaagggggaccagagaauagagaaacaaaaacugaaaucacucccugacuagauuaaucagcucuugcauacucuggccauuuaucagauauauucagugaaauucuugguugagagaaagagggagaaaacacaagccaauccugaaucaaaauuaauagagaauucuacuagaauucaacagguuuuucuuuuuuauuuuuuaauggcaagaucccugaaggccuuuaaaauacgaaugucugcuuuaaaucuccaagaaggagggcagaguucuugaaaaugauagccaugguuuuuuucguggcacauauaauggaauugggcugccuggaaaaaugcuugaguaaagguugcuccacaaggggaaaggugguaacucaaugcaccuucacuuucuagguuggugcuucucaauuuggcugcauauugaaaucaucuuaggagcuuuaaaaagcgcugaugucuaggucacacaccccagugauucugaagcaauugcucuggggcaugucuugggcauugugcuuuucccccaacaucucgcagaugauucuaacguguagccaugauuaaggacuguuaugguaggugauaacccuguuuuccugagucuauuagcauauguaguuacuaaccagagucaguaaacuagguauuguucucuguauuuuaauuccugcccaaccaaauuaaggaaguaauuucaaaaauuaaaagagaagagauaaucuagaguggcaggcaguacuaaccaacuccacauucaagaauagcauccuuucuuaaccagcauugcgugauuuuaaacucuucguauccccagaauuuagcacagugccccacacauaguauauguucaggaagaacugugguaaaugauaaagaauuaugaacaaaguccucuucaaaaugaagauugcaggagaaucaagcuucagucagaucuaagugcacacuacucuagugagauaagccaaucagauaagcaggauggggaaccaccauuuugguuuuguuguuguugucauuguuguuuuugagacagagucucaccuaggcuggaaugcaguggugcgaucucggcucacugcaaucuccgccugcagguucagcugauucuccugcuucagccuucugaguagcacgccuggcuggcuaauuuguguauauuuuuaguagagacgggguuucaccauguuggccaggcuggucucaaacuccugaccucaaaugauccacucaacucggcuucccaaagugcugagauuacaggcaugagccgucguuccugaccaggaaccaccauuuugauuggcaugguaccagguacacagaauuuagccaauaaacuauuugaugugugaaagaaugaauaaauuuuggcauuaaaaggcaggcuucgguaugucagagcaagagguaauuggaugaggaccagaggauggagcccagagcaggaaaugaagcucagagaagagguagauguucaacguacugugucuccuccuccaguuuugaguaggucacugaaaacacuuggcauggcagugaaaaucacucaaaagacccccguggaaauggacagacuuguguggaaauuugcagaucuuggcugcuucuaauucauuugucuuucuaaccuauuagaauccaauucagucucuuuggcucuacccaggauaaugcaaaacugaauuguacacauaagcuuccugccuucugcuccuucucuucauaaccaauauguugcuaaacaacaauuucuaauugccccuucccaggacaccuuuugagagcaucucucuuuguacccccugaaauacauaauacuaauuuucuuugacaugcuauauauuuugaggauccaugcaucccuaacaagugcccagucuuacgauggugcagccccucauccaguguucuaucauuuaauucaugaugcuguuuaucuuggcugcaagagagugaauuauuggcauauucagacagucucauaccaccucucguccucuccauuaucauaaaaguuaaaauuauuuauuuaugaaccaaauaacuugucugaauauuuuaacaaugcacgagcacuuauggagguuuuuauuucaauuuggguagagauacaaagucaaauaugauuucaguacaaguugugaugguuuuucucaauaucuuauaugggguuccauuuuugccuuguacaauuaauacaagaagcauaaugaacucagcaauccccuugagaaauaacaaauagguauaagcaauaauuuaucuguggaaugcagggccuugauacauaacuuccauaucuacuccaaaagaaaaagaaaagaaaaaaaauuccuagcuaagagccaugaagaaagaguccaaacacucucacacauuguuguuggaaagguagacuauacaacauacuuggauugcaaucuggcaauaugcuuugaauguucacaauuuuaaaacauauauuuccugacccauuauuucaaagacuguauccugauccugaugaaauaauaaaagaugugccuaaagauauaucauguguggaugcucauuuacaguguuacuucccauaaagagaaauagggagaaacaaauaagaaaccuuucuaauauauuuuguuaucuauaaaauggauugcuaugcagucauuaaaaauaauguuccuaaaaauuaguuuauaggaaaauguauaaaaauguacaugacauaaaguuaaguggaacagcaagauauaaaacagucuaugcagccuauuuccaauauguuuauaauaaguauuuccauauauauuucuacguuggcauauuauucuacacagaaaaugaucaguacauauuuuugaguguauaagcaggguguguguguuuacaaagacaaagaugaaauaccccaaaauauuaauagugguuauggcuagauagugaaguuaugggggauauuuauucuuugccuuauguuauccuacauuuucuaaauagucucaaugcaaauguuguuuuuauaacuuauuacugauuugugagcuaaacagacccauugacauuuucccuggaauauucuagugacacaaucacucuccuguuagauagucccaccccucaugcccccucauuuggucucuuccaagauccaggacuuuagagccagaaacauuuggauucaaaucccagcucuuuacuuucuagcucuaugaccauggguaaggucauucucucuggguguucuggaccuuugggauagaguuguugggagaguuaaaugaggaguguugcauuccuauccgauaguuauuucucccuccccuuccuuucuaauaggaucugacuuugugauuuuauucagguauugacugcccacaaccuauacccagggacaagaggcuggggccuacucagaccuaaggcuugaagcuuaacuagacuaggacaagcaugguaacuucauuccccuugcaagggaucacuucaggguaugguuugaaauucuggccaaucaccaagugggacaauuguuggaggccagggucguucugaaaaaguuuucuucacauuuaagaaaacaaaggacacccagaaggaugaguauucauugccguuucuggccuucagacacugaggauuucuggaugcacuauagccaaacuuggaccauuagaggacaagccugcaaagaaaaguaacaccugaaagaggggagaaauaaaagacagaaaaaaaccuugauacuugauaauguuguugcugaauucuggcauggcccuauuuuuuuuauuuauauuuaaaauuuuuguuuaaaucaguugaacuaggauuucuauuacuuuuaucugaaaggaucguaagugauacaaaaagcaaaagugccaagcucaugacagagagcagaguucaacaaauaaaaaauaaaaaaaagucuuuucuuucucucaccuuccaaauacauauuuaguauacacaguauauacuuguuuauggcuuguaaauguaguuaauagagaaaguaacaagaaagaaagggguaaaugcaccuuuuccuccucuuaaaacaugcacaacaggacccaauuucucuaauuuuuuuauaaaggcccccaaaaacuauggacaaagacaaaguuuuccaaggaaagacaugugcuguaauggauuauaucuugcuaaaaauucgaggccuucuaaaaaaaacaaaaucuugaacaacaaagaccucuuccaaucccuccucccuguaggucuugaacaacuagccagaggcccugcuuuuguaagagguucccuagauagaucaggauggauggaguguaugcuguuagaucaaaagaaaucauuugcuacuuguaugcauggacuaccuuaacugugagucuuaaucaaguaauggagacugacaggcuucuuggccuauaggggcccuauaguaauaaagugugcacuuuucuaaaaaugguauucauaagagucaagugacuggacaauuacuuuguuugauuccacaucccaggcugaacaaccuccucuucccauauucuucugcgucugauccugauggagaagaauaagccagccugagcuaugcuuagauauuuuaaauuuuagugaaaaauaaaauauauguuuuaaagccuggaauauuauuugugauuugggucuaaggucuaaaaaauauggacaagugggaauucaaaaaucacccuaccagcacugcaaagaauucgugaguauucaagcuuuaggaguuggguuugugcauuuuccuuuuauaacuauugcuagccaucccagaauguugcacucaguaagaagggcuaacaguguccugcuggcccuauuccuaugugucaucuugcggcauuuccaguuaauggcaugacuguaaugacuagcaauuuaaauaauagaggcugaagcagaggcagcuauaaggacacaaugcagaaauugccacaguuuaucaacaucacuggcacccagcucuucauuaccuccuugaauagggucaaaguaguuaaaaugaugcuguaaauacaugacuaaaacaaagcagcgguuuauucuugauuuggcauuggguauuuauaacaaacaaguugcauuucccaggcauggguuauuagacacgagaauguaauugauauuaaccaacuuucaggcuccaguaacuuuuuccacugcaugucaguuuaauuuuuuuuaaagcauaagcagcacaugccaaauggaaaacaagaggaagaacacaaaaaaccccuuaagccuucaguacuaagugaaaaacaacuaacccauuuaucuuauagaauccuucagaguuuugcuauaaacucacucggaagagaauaucacagucuucucuuuuugagaggguauucgagugauuuuuagaaaugagacaucucuaacuguaaucuuguuuuuuguucagaacuaaaagaguaugcaagaauaucuaaaaauacaaauugugcaccuacugcauuacggcagagguugaacacuggugacccaugagccaaaucugacccauugcucuguuucauuuggaccauacaguaaugguugacuuuguguuuuaacauuuuaaaauuauuuucaacauuuguaaaucgagagauuucacagaaaaugcuggaagcucugacccuaccggcaccacacuccuacaagauaacaaauggcuggggcugaguugaggcugcucuuauccuuugccucaauuguaucacuccuacagucuccuugucucugaggccuaaugucaauuaccucucuucuucuuaauaguauuguuauuuuuccuaaguaaugaucaaagacaaauauucauuuuggugagccuugaucauaaauggggaaaauaaagauggguuaagaggacugaguguuuuagaaaaugaaaaggcuguaauuccuuauagaaguaaauaauuucuuacuuaacccccuuuaccccauaacagaauccucccagcuggcauccaagagcauugagugugugaaccuuugugaaaagcaucaaguuaaacguucuguguaaaggauaccagacacauggaaaagccaagcuagguucagucucagacaaaagcugucaagcugagaaagggaaaagaaagcacugcacuuguaagaaaaacaacaaauggcaagcacggaauugacggcuagaaagaacaaagcagguuucaauguucuaccaaaaaaugucuuagccccuggcuaaacuccuuuugggaaaaauaggcacaacaggaagaugccuucacuucccaaagucauccagacauucucagugggagcuucugcaucaaccuugugucgcaucuggagcugcagacccucacugcccauugguuuaacaaucucucuccuccugcaagaagagggugguggcaggggggaguacuauaagggauguuuguuuuauuaaaaagaauaaacauacaugcacauacacaccuacccagaaaauacuauuucauggcaucuacacuuauagggaauucacucagaaacagcuuuuuaguaacacaaagaauuaaaaucauuagcacccaacaagucagaaaugauggaagauuaggaagaccauugcauagaaacaaaauuaaaaaaagauaaaacccuuuauagaaccagaaaaggugaggagaacacaaacaauccuuuucacugagauugagaacccagaaaaaccuuuugauauaacuagggaaaguuaaguagagucaggaaaggaauaaguguguauuaauuucccacuguguagaaagcacuccauauacauuuuaauacauuuugauaauaaauaauaaauaauacuuuauauuuuuguucauuuauccauuaaauaaguauucguucacugccuucuaugugucagacaucucuagggauauaaacauuuaaagacaugguuuuccuauuaccaaguuuugagucuaacaaggaacuagacaaacacucuaaugaaaauaauaaugauuauaaauacaaacagcaauaauacaauagcuuaauaacagcuguccuuuacugagugcuuccaaugugguaagaauuguguugagcacuuuacauuauuauucguuuaaucccucauaagugcccuaugaccaaguuacuaauaucuucauuuuacagagaagggaaguaagcuauagacuaaaugauuaccuaagguuauaaagguagcagaugaaagaucugagauuuaaacacuaccuguucucugcacaccaggccaacagauaaucugcgauaucaaccccuaccagcuacgauggaggcaugccaaaaacaagcgaugcagaggggagacccuuaaacccuuuugaauuugcaaagcacuuccccauagagaaaauaagccuccagaauucaucagccccaagaggugguacugguagaaaauauaauagucuuucauaauagcuuaggucagggugugaaagacagagcuauaagggcugguaaaagaacgaaagcuuuccaauccagagacaaaaggaaaagugagauccauccaugacaugucucuugaggacucuuuuaggaccaagauggugaaugcugaacggaccaugcaugccucagucugucaaauuguauguuucuaaggacaaauaggcuacaaaacuuucacccuauuuuuauaugggaagucuguugaaaagaauacaauacauaaaagaugaauuacuuauugagucuuuaauaugucucuagcacagaaauaaacaucuuguguauauuguuucuaauuuccacaauaccaugagcuagaaauauacagaauagaagaacagugggaucagagagguuaagugauuuauccaagaccacacagguguuaagagguagaggaaugguuugaacuugcaacaaugugacuccaaaaucaauacauuuuccuuacacugaaauacaaaguaucaggccaaaucucucugcaaauauucauccuguuucuuuugguucuucauucauuuaauuaaaaacaaguuuauuaugcacauacaaggaacauaguauucauccuugugcaucugacaaguaagucaaggagacagguguguaaauaccuaaccaaacuuacaggcaggaugaaugaggcuaaauguguuuauuauuuaaauaaacuccaugaagucagauacuucaguuuguugaucauugccacauaccugaaacacaaucuugaaccaacaaacauuuguuugauggaaggauaaaugaagaaaaucccacuuaaggaaguacaaacuuaagguagaauuaauucugccuaagauaaaucaacgaaagcccccaagugcagugucauugaauuggacuuggaagaauguaugaaguauauacuagugagaaaugaagugacaggagcuauggcucaggguaaacacaggaauggaagcauagaagcccacaaaauauuuggguaauagaguucaagcauacuuagagcacaggaaaggcgagaaauuagagugagaacuaaagucaaaaagguaauuuggcaccacuuugcacaaagccuucaagucaauuauuaaaaaaaacaaacaaacaaacaaacaaaaaaaaacagccaugccaguagaaugcaguaaucugacagcuuuuagcaaagugggaauguaucaccccuacuuccuccccacugaucuuagaagaauccuaaguguuuacaccuaguuuguaagaucccaagaaacucuccaguggucuaauucccaccacucagcuaagaacucucagcucaaaagauacuggcaucuggaaagccuuuuucaaagucccuaagucugaguuccuuacaucccacacuucacccaucucauaguguguuuuucuuaucucucuccaccaucacuggcuuccaugugagcaggcacuaucuuuguugauuccuagcauguugcaaacagcccggcacauagcaacuacucaauaaauauccuggaaauaauuauuacauuagugaauugaaugauugaugcacugacugacuguugaagaaauagagucaaggagagccauaggaggcugccacaauagcccacggaaaacaccucuuuauaaagguccagauguauuucuuuaaguaggcacuuugcuaacuggggagagcggugguuaguuaaagcagacagcaaagcagaaaaaggcagggccagcgggcaguugcuggggagaccacaauuccaugggacuauagccauuagcaugcaacacuggguaaucugauuuucaugacagacagauuuauuaugacuucuaaauauauaaaucccagguuaugcuuuccagcuaaccuaacaacuugauauaugugucugacaucccgucuuaaaaucagauuccagcuucuaauuaauuuuuauucacccaucgcucuaacaagagaggcaggaagucucagggggauaaacaauagacaggguauuagucguuccuacucuguggcacauuuuccacugagucucuggaguuuucuuuuucuuugcuaccaaaaaaggggggccuuacccauucucucuguggcuucuaggaagaacgaguggaaaacauuacacaggcacccgauagucauuauuucuauuaagcaaccaaugcuucauccaucacuuccaccuccccauucccugcuuucaucuacccaugcagaaauuggaaugacaucauggucuagucaguuuaaagacugaucauugcuuauguauuacuauacaucuugcuuucuccaauaauauuaucagcaaauaguucuugaagcugaauugcaagugccacaaugaccugacuuuaaaccaauaauagugaucauaaaggcuaaaaguaccaccuaccgcuuuuuauauaaucugaacaauauuaauaauucacucacauucagauacuuuauuaacaaugaaaagugauacagcuguacccaggaaaaguuuuguaauccacugauuucuuuaaugagcauucuaugaaucuguguuuuuuaaauauaauuuucauauaugaauacaauuuaaagaacauuuucuucuauguccuuuuuccaaaacaugaaagucaauauggguaccacagaccagguuagaaaaaaaaagauggucacauucaacuuuuuaaguuuuuuaauauuuaguucucacuaugugcuagagauuguucucaaaauguuaaaugcauuaaauccuccucaaaacucuaucagguaucauaauuuauccuugugacauguuuaaaaaguuguuugcagucacaaaagcuagcaaguuguacaacugagauuucaauugaggcugauggcugaggcuuuaccaccuuggucuuaauauacugccuggagauuuaauuacuaaauaacuaauaguauaaguagccaguuguguuugccaaacccauaaagccaaacuacacaaucaucuucacuuugaggacacuauaguguuucuggcuuuuugcaagcagauuuaaaaaauuuggauaccagucuguuuaccugccauaauauggaauauaaacuaggaggagaaacacauucagcaaagaacuuuguuugauggacuucacgaaucaaaaaaaaugucauuuuucuguucauaauaaauaaauaguaaaaauaggauaauaccaaaaaauaugcaaaaucuucuccucccuauuuauuacaaguauauacuuucuaaaucucuagugucuauguaauuuauuugaugguaugaaagauguauuucacauguacaugcacaggcacacaugcgugugcacacacacacauacacaugcaaccuauguauaccagaauuacucugugcucaauuuaucuucaguuaagcacugaaaacaaaauagaaccaaaaaaauggauucauaaagugacaaaaagaaguucauucacuugcccuucagguacauaccauacucauaugaacaaacuuauauauucucccuacaaaaucacacuuaaauaugugauuuaaaguauuuuuugcuaaguauuuuuauuucuuuccccaaaauuauuugugaaaauggaacauguccuauauaucaauaaaugucauuuaaaauaaauaaauuuuuaaauuaaaauuaucaucaaacucuuaaaguauuucauuuuuuaaaaauaaauuuacacuggaauagaagucaaacaaacauuuaaaagcacacagaaagcauucauauuacaacuaaucuaaauggcugauuugguaaguuuuagagccuuuuaauaaaaccauauuuuuacucaaguacuauuuaguuagagcuuuaucaaaauacuuaauuacaaaauaagaucuaagauguucagguaaaacuaugcacaauauaaucaaauccuuagcaugaagccauucaaguugucauuuagagaucuguuuucugagccuacuccaguuuuaaaauaguuuccucaguaacaucaaaucugcccuuccuccccuuugcccucagaauuauuagagcauaauguaauucuuuuaccagccuuaggaaaacacuauuggaaugcaugagccaaaaugcagagaugaaacggaacugaaaaaaaaaguuuuuuaaaaauggaaaaucaauuacuauuuuuaauaaguagaaauagcuuuugugcuaagaaaagaaaaauugcccagagacaaaauagauguucgauauuauagugcacuaaugaguacauuuacauguaauuuucugaaauuuauguccaagacuaacugcaaauagaauuuaguaucaauaggaguuuacaaaacccauucauuuuuccucuaaucauauugaauauuuaaggugcuugauuagacucaauuauuuuucuuucggugccaaaaaagagcccugacagcuuugaaagagauggauuaguggggcauuucccaccaauggggaaacauuccuggcucccacagcaggaaaaaaaaaaacaaugagaaaguucaugccaauucacaugcaugccacugaaugaaaucugcagagaacucagagaaggucagcuugucaaaggaucacggcaaaaagcggaagaggcagauacccaaacuuaguaggacuuuguggccucccagcucacaagccugcuucuucauuucaaggcggccuggagagaagcaucugacaaagaucuaucucccacugcccagaaaagauuaaaagaauaugggcccuagcaaaucuccuaguacuuggaauugagaaauagaaagggaaauguagcuaauuugcaguagcccugcuuccuuguucagauuucccgaagcauaauaaaauagagaggcugugucuccaggguuccacuuccagcugugccccacaacuuggaaaaaacaagaagggacauguuaccuacucacaccaaccugccucuccugcugccccuccugcugccauucuuucaauucauucuaagggagguugucagcccucucugaaaugcuuuaaaaagaagcuauauuccuaacuggucaaggagauuuaggugaauuccuggcugaaagcagaaugaggaaaaaacuguucccucaaagugcccaaucuuugaugcauuauguucuacugucugcuaaaaccaucaucguagccuuuuaauuaaauuuucaaauucugguuugaugguccauguuaaacucaauuuggucaauucagggcaccauccacccagauauuccucccucugagacuucugguagaauccuuccuugccucuuccuaauuuccagucucugccucugucaucaugugacguucuccccucaucugucuguaucacugugucuuuucuccucuucuaugaggacaccauucacauugcauuaagguuccaucuuaacuccaguaugaccucaucuuaacuaauuacaucuguaaugacaguauuuccaaauaaggucacauucugaggcaaugagaguucaaacuucaaauaucuuuuugggggcacacaaguaaaccuauucugugcagggcacacaauucgaccuacuaacacucccauauuaaaucaaucaccaagucgugagcagacaccuaauaccucucaaaucugucaacuucuuucuauacccaccacuacccugaaucccauacaauugucucaccuggguaauuguaacagcuuccuuuaggaagcuccccucauuuuugcauugcuccaauagauucuccaaaaaaaaaaagugcuuauugaaauguaacugauauagagaaaagugcauaaaucagaaugaauuuuuacagggcacacauacccacuuaaacacuacccaaaucaagaaauauaauauuaucaucauccuagaagcacauuucauaucccuucccaauuaauuuccuccugcuccagcccaaaggaaaccauuauccugaccucuaacaacauugauuaguuuuacaugguuugggauuuuauaugaaugguaacauucagcacaugcuuuuguaucugucuucugcuguuagaaugauccuugcuguugcaacuagaaguaauugauucauuuucuuuacuuuauaaauauuucauuaugugaauauacccuuuuacuuauucauucuaauguugaugaccauucagauugaguuccauuuggaaaagcuauuaaaaauaauggagcuacgaacauucucacauuuuuagcguauaucuaguagaagugaaaggucacagggccuacaauuguuuuucacuaaauauugccaguuuucuaaaguaauuauauuaauuuucaaucccacaccacuguaugauaguuccaguugcuucauacccuugccaacacuuaguauuaucaaucuucuuucauuuuagucauucagaugaguguccaaugguagcucauugucucuaauaacuaauuaugauaagagcuuuguaauaugcuguguagccaugugacuauccucuuuuguaaagggcuuguucaaauucauugcccuuuuuuccaaugggcuauuuuucucccauccaaguacuaaucaggcccaucccuacuuagcucccaagaucagacaagauuggaugcauucagggugguauggccguagacuaccucuuuuucuuacugauguguagaugauauuuauaugaucugaauacuaguccuuugccagagauauuguaauuaucaucucccauucuguggcuugccuuuucucucagcuagugaugucuuuaguucauaaacuuuccauuuugauguacucuaauauauuuaucuuuucauuuuuugcuauuguuuuaaaaauaguuuuauugagauauaacucacauaccauccaauucaccaaucaaguguaugugacucaaaguuuuuuaguauauccacagaguuguguaacaaucacuacaauccaauuuuagaacauucuaaucaccccagaaagaaacguuggcccggcgcguuggcucacgccuauaaucccagcacuuugggaggccgaggcgggcggaucacgaggucaggagaucgagaccauccuggcuaccacggugaaaccccgucucuacuaaaaauacaaaaaauuagccgggcgaaguggcgggcgccuguagucccagcuacucgggaggcugaggcaggagaauggcgugaaccugggaggaggagcuugcagugagccgagaucgcgccacugcacuccagccugggcgacagcgagacuccgucucaaaaacaaaaagaaaaagaaaccuuauaccuacuagcugccacucccuauuccucccaacaccuucacccucacuaaacucuaaccaaccacucauccacucucugucuuuauugauuugccuuuucuggguauuucuuaucaauggaauuauaugauauguguuuuuuuuauuuuguuuuugugacuggcuucuuucacuuugcaugauguuuucaagguucauccauguugcagcauauaugaguacuucucuacuuguuugucuaauaauauuccauuguacggauauaccacauuuauuuauccauucaucaguugauggucauuuggguuguuuccacuuuggggcuauuagaugaaaugaugcuuggauaguguuuuuucauguccuguuuaagaaauauuuggcuaucccaaaaucaugaagacauucuaugauguuauauucuagaugcuuuauugauuuagcucucacacucagaucagcaauccaacuggaauuuauuucuguuuaugaugugagguucauuuuucccugcccugauacccaaaugauucagcacuauuuaaugaaaagaucgcccuuucuucauugcuccacagugucaucuuucucaaaauucaagugucccuacaugaguggcucuauuucuguacacuccauucuguuccauuaaucuauugcuauuugcuuauccuugugcaauaccacauuauaguaauuauuguagauuuauaaugaauuuaugaagagcugauagauaguauauguccuccaacuuuguucugauuccccuucagaauuaucuugccuauucuuugccuuuugcauaaugguguuuugauuagaauugcaugaaauuuagagaucaauuuggagagaauagaccucuugacccuauugagucaccaauucauggauauauuguguccuuucauauauuaggucaucuuuaauuucuuucaguaauauucuguaccuuucucuguagaggucuaauacaucuuuuguuagauauauuccuauguuuuuaauauuucaagcuauuuuaagugguaacuuuuuaaauacauuuauugagguaaaauuuacauagcaugaaauucaucuauuuagauguacaguuugaugaguuuugaauacauuuauauaguuauacaaccaucaccucuacauaguuuuagaacacuucuaucaauccaaacuguuaccucaugcccuuugcaguuaauccccacuccccacaccaggcagcaacugauuugcuuuccaucucuguaguuuugcccuuucuaaaaauugaaucauacacuauagauucuuuugugucuggauucuuucacuucacauaauacuuuugaagcauauccagguuauuucagguaugggcuguucauuccuuuacaauguugaguaguauucccuuguauaaauauacuaauuauugcuuacccauuuaccaauugauagauaccuagauugcuucuauaauagcuugggaccauuacaaacaacauugcuauaaauguagacauacauuucauuucuccacaaguuuucauuucaagaccuugaaguggaauugcuaagucuuaugguaaguacauguuuaaccuuuucaaaaagugccaaauuguuuuccaaaguagcuguaccauucacauuccuaauagcuuuauuuaaagguuacaguuucuccauaucuucaccagcacuucuuauugccuuuuuuacuuuagccauccuaguggguauaaauugguauuucaaugugguauauaauaauauuucauacuauuccucuccuuuaaauuugcauuuuccuggugaugauaagcauuuuucaugugauuauuugccauuaauguauaugcuuugguuuguuuucuuauuaccgacauaagaauucuuuauauauucuugauauuaaaugcuuuaucagauaugauuugcaaauaucucaucccauucugugguuugucuuuuuauuuucuuaauaguguccuuaaauaacucacguuuuaaaauguuaugaaguucaauuuaucaguguuuuuuucuuuuaggaaaucuugauuuugguguuauaucuaagaaauauuugacuaauauaaagucauaaaaccuuuccuguauguuuucaucuagaaguuuuauaguuuuaaagcuuauauuuuggucuguaauccauuccaaguuaacuuuguauacaguacaggcuaauuuuuggauaaagacaugcaauuguuccaccucaccuucuuuggaaaaacaauuuguucauaguuuauaacccuuuuuauauguugcuggauucauuuuaaaugguaucuuuuuaaaauuucauuuuguaauucuuuguucugguacguagaaauacaauugauguuuuauacugacuuuguaucuagcauccuugcuaaauucauuuguuaaauuuacauaauuauauguucugcaaauaaaagaauuuuauuguuuccuuucaaaugcucauaucuuuuuuuucugucucucuacauucaccaggacuuccaguacaaugcugaacagcaguggugagaacagucacccuuuucucagaccuaaucuuagggcaaggcucucaauguuucacuuaaguaugauauuugcuguaguuuuuaaaaaauauauagagagucuuuauuaaggauguuuacuuauaguccuaguuuguuaaaaguucuuaucaggauuagauguugaauuuuaucauauggcuuuucuccuuuucuguuauuacaucauuugauuuuugaacauuaccuuaccacucauaucuauaauaaauacaacuuugucaugacauauauuguuuuucuauauuguucagucugcuauugcuuuguuuaggauuuuugcauucuugagaccuccaaaaucucuuccccaucucuuuagcugcugcuuucuauuggacuuuuaagcuuuucaggucuuugucauuuacaaaucaacaaaugcuucaaaaagaaaaagaaugagaauguugaagucacuucaaugcaccuccucccuccaggguucugaccccucaaguccuggaugccuugguagcccuucaauaccuucaaacaaauaucuucucuuuauuuuggcuggcuuuucuaguuauucucuugguggauuauuagcuacccuaucauuaccagaagcagaaauucauccuauaacuaaauaaagucaucauauaaacuaaaucauauuauucuuccuccuugaauuugcuaaugugcugauaaaaacuccauauucuguacuauguccuauaagauucuagugauacagacauagccuuucccuccaucaucuccuaccacucacucccuuguucacuccucucccaccauauguaucuacuuucuguucuucuaaucccauuggguuaauucccaaaucagugcuuuugcauuuguucuucccucucccuggaacacccugucccugaucuucacaugccugccucacuuuugucaauccaucucaguuucaaugucaccucuucaaagaggccuucucaagacaauuuaucuaaucuugugucucuccugccugauuccccacaaacaauauucuauacaugaaagaaaugauaaugaaauuaagccaacagaaauagaguuugaacuuuccaaaagccacaauguuaucucuaucccacuuccacauccaacauaaagagaacaacaaacuaagaauauguaacaccuuuggggaccacuuuuguauauuauuauacagaucuuaagaguauauaaucuuucucuggagugugacaaaccuaaaucaccgcuacaucacuuuccagauguauaacuuccagcaagguucucagccucaacuuccuaaacuauaaaauggggauaaugguagaauccauucgauaauauuguuguaauuauaaaauaaauguuauuuuguaugcaaagugcuuaauacagugcugagucauaaaaaguguuccauaaacaagagcuauugugaugacugacaaugaugcucaugaugauaaugaugacaaaaacaauaaggcucuggagcaucugguaaaaugcuaaguaauucaaucaaacacacacagauguacacacacacauacgcacaaaauuacauguuguaauucauuuccaccaaguagauacagccuuuaucacuugcauugguagauuugguagagacuucauuucuuugauuucuguacuagguaaguuugguggcaagaaauauaggccagcccuagcaagucuauucaaaaauaagaaaaaugaaaagaauacuacaguaucucacaaaauugaaaggagaaugaaaacccaagcuuugugaagaaggaaaucaagguagcuucagagaacugagaggccggaucuuagagaccucccucuagagcacugcuauuugaaugacuaaaauaccauuaauaacuacuuuuugcuuucaauucaaaauucaaaauucuuagaagagagaaucugauuggcauaaucagauaccuagcccuagaucacucaucucugcccucaaguuaaaaagucaaacauuauggucucagcugcugggagcccaccucuguggaucaggggacacugcccagaaaagaguuuuguuuuagaacuggaaggucaucccaagaaauauuacuauaauagaagggacucugucuaagaugggcucucucuaaaagaagucauuuuguucuacuauuugcccauccagaauagcagugaccaaguuaugcaccauuagcugcuugggagggagcuaauuacaaauuaaauauaauugaaucagugagucugcuuucaaguccucuaaauagaauaacaacaugcuaccuuguacagccaauuuagcaaaucgaagcugaaucccuugcuuucuaugaagauaaagagccuuugugaaauuuuuaaaguauagauguaaacuucaaaaaauuuugcaaggcaagucaucaaaaucugggagaaaauauauuggaaacugugcuccaacaggagccaaugaaggaaccuuaugagggaguauaaaauauuaauauucaccaaugccaagaaaauuuucauauuaugcagguauccaaaaugggacuacuaucuuugauuucacaauuccuuucuacuucucuaacacgaauuuuuagugacccaaaaugcugggaagaacuacaaaauacagugaaugcauucuacuugaacauuaucuuaugcuguuguaccuaccaaaaagacaccaugaaaacugcaaguauggcugcgcuggaaaaaaccgaaauaaguagucaucugugaaguacugcaagugugggaaaugguugagagucauggacauuggggaauaucaacaaaagaggaagaaaaagaagauuaggauggagguagaaaugauucccauggaauuacugacaucaguauauauucccuuagccuauuauuacaucagugucuccuacugggaauauuuacugaaccagugguacucagacuuuuuuugagcagggaaaaaaauuuauucaacauuuggaaaacuggcauagggcauccaaaguggggugagaaggcucuugugucagacuaccagguccauucccagcucaauauauacauacugugguaagauauccguaacguaaaauuuacuauuuuaaccauuuuuaaguguacaguuuuguggcauuaaguacauucacaauguuguggaacaacuaccuguaucuaggucuaaaacauuucaucaccuccaagggaaauccuauacccauuaagcauacauuccccgauuccuucuuccuccagugccuggcagcuacucaucugcuuucaaucucuauggauuugcccauucaggcauuucauauaaauggaaucuucuaauaggugaccuuuuuuguaauggcuuauuguacuuagcauguuuuuaaugcucauccauguuguagcauguauacuucaguaaaaaaaaauugaauacaauuguaaauauuuguuugaaacacauaaaagaaauaguuaaagggauugagccuauuuacagaagacuugaacucuggggcaaggagagaugaaaagggggacuaggauagcaguugucauuucaaagacucauuguguguaaagagacuaaguuuuauucuauucagccccaaauuauccccccauaaccaaagaguagaaacuauaagaagagagauuucaauuugacauaagaaaaaucuuucaacaguguuauccaaagacagaauagacuguuuuuauaaauaaugaguuccacuuaucuguagguauucaaguauaaauggaauauucccuucgcagaaaucuuuagagaagcaagcaucagauaagauugaucugaaucagugguuccuaaaagccaaucaacaagcgcaugccaauacaugaugaaguuuucauucacucguggugaaaugccaaaaucaaagagguuuuuauaaagcuaaauauauauuuaauuauuuuaauuccaagauuaugccuuucauccuuuuaguaucaaaauagccccccaaaauagugaaugauaguuuucuucauucaugcccuuuuuuggggcaaaacuucaaggugacaaaguaaagucagcccuuuguuuuaggggggaaauuguaccagucucaaagugugagaaucauuugaauaggugauucuuaagacauuuucaaaauuccaagaacccauguuuaugaccaaggauuguuaugaaaguugcuuuuguuguucauuuuauccauauuucaacuguguaugcaaggaguggagcaccucccaagaggauuuuccccaaggcuucugccuuuguagggauggucugaaaugauauagaauuugaacggauuucuagucucacagggauuuauauuacaugaaaaaagagagagcuuugcuuuagagauguuuauccaaauucaccacggagucaaugggccaaauuccaaaugccaugggccucccagugggugucaauuuuacugggcggcuguguuugggagaaaaaguacauaugcauguguggcugugaauguguguguguagagauaaagagagaaggauaugaacaaauagauagaggcaucaacaaucacaagagggaaagggaugauauauguuuagaauuauaucuaaggacugucuaaagauaaacaaaaauaacguuuuuccccuuuuuugucacccuuguuaaaaucaauaggaaaaauuugaagguaccaaguuauuuuauugucaggcaccaaaagaguaaaaauugaugacaucacuccauacaaaacccccagagcuuucugauucugcuguuuaugcuuucuccugcaacaucuccauuuggauccugcuggaaacacuuuucuuucugucacucacaaucugucaagacagcauuaucuucugugguuuaaaaacagaaacuccauuuaacuucgugguugauaaagacaucucguucacaucccuuaacuaacaauaauuauucuaauuuaccacauaaagacaagaaaaaauaugcacuuaacauuuugcagcugguuuuguaucaaggaacacauggaagagaaauggucccacucuugcgauaaaaaaauaagguauuaaguaaaaaauagaccuaacaugaauguaugcuuuugguacauccucccuacaugccaaucagugaagcaauuaggaguuugggcucucaaaacauacuuggauuccaauccuggauuugccucuuauuaaucuaagaaggcaagacacguaaccuuccuaagucuucuucaucuguaaaaugggagcauauaucaauaucuaccucauaagauuaaauuagauaaucaaucuaugucagcugcuguuacuauuguuguccuccuccuacucguccucaucaucaccacuauuaacaucaaaucaacguauuaguuaagguucuuuggggucaagcaacgcagaucauccugccuaacguuagcaaaauagaaaagagaucuacugcaaguauacagaauagugccuaaaaaucaaaguaaaacuaaaugaagcuuagaaccaacaggaggcugggggcagugguucacaccuguaaucuuagcacuuugggaggccgaggcagagggaucacuugagcccaggaguuugagacgagccuggacaccauggcaaaacccagucucuacaaaaauuuagcugggcguaguggcacccaccuguagucccaguuacuagggagguugagaugggagaauuguuugagucugggagguugaggcuacagugacccaugaucaugccacugugcuccagccugggcaacagagagaccuugucuaaaaaaaaaaaaaaaaaaaaaaaaaaagaagcaacaggagucaggcucccaggaauucauggucaguuaguucuucaggcuacuaucagcaggaagaaucagcaacaaccauuuuccauccuugggucaauguacucaagauucagaaucucugaaaaaaaaagaguggugggguggggguaggggggugggguuugggacuugggcacugccuuggucacaugaccacugcuuggccuggggaaggcaagguguuugacagcuccaauaauacuguguuugguggagaaggcuauuccccaagggaaaaaucuacuuuauaacucaaagaagaggaguacagauacugagcagguacauauaccaagaacuauuuuucuuacaccauuacaucccaacgacccacuacgucaagcucaauuaagccugcacccucuucuccaucauccuuccuauuugguaauuacucuuuuaauacauguuuuuaauuuugaaguuguuguuaaaacucaauuugagaaaagcaaaaaggccccagagcucuaaaguauauaugucccuuaaaaauauauauauauauauacugcuugcugacaauaaauuauuuuguuaaaaaacuuccguauuagaauuuccagaaaauuuauugucuuuauguucaaguuauuuaguaguaaucugugcuauuaagaagcacauaaagcacccauugaaaaaguuaucugaagaugauuuagagaaauaguuuguucucuuagaaagaaaucucuuuuauguuuuaaguucaauaagaugauauuuaugcucauaaauuagggucaaaggcaacauuuuguuuugguaauuuuuuuguggaugaugauguuuuagugagaaaggauugacaauaaaagcaagaauguaagaauaauaaaaauaaauaauaacgaaauacaugaccuacaauuucauuaaaauuuucuuccagcuuacuagcugaacaaaucccaaacaaugaaaauauacagagucugauuaauuugaagcccuaaacaacucuguagcucagugaaaacauuucucauaaagcccagggcccugagggcacacagagcuaagacaaaucccagugugguccacccuuagcagcugugugacucuaagcaacuuacuaaucugccaaaauacccaggucucgccucaucuguaaaugaaguaaacaacguggugggauguuuugaggacuugauauaaugcauggaagggucuugacacuuuuucuggcaaacaaugagcacacaacgauaaacguuuauaauucuauguauggagagagagagagagagacugagaaagcauacaaaagagcaagaaagcaguaguucucaacagggagugauuuuugcucaccagaggacauuuggcaaggucuggagacaucugugauugucaaaaccuggaggguagagggugcuucuggcauccaguggguagaggccaggcaugcugcuuacagggaagcucuuacaauacagaugacaagcccccacaacagaauuauccaagccaaaaugccaauaaugccaagguugagaaacagaaagagauugagaaagagaaagcaaugugauguaaugcagaaccuguaacagauuuggaaggaaagguacauucaaagccgggauaggaaaguagaucagagcagauuugaaauuagauugacaggcaucugccacauguaagcuauugaggaagugcucugagccugaggauucucauuugaacaacgggcauaauauguaacaucaccuaccucaaaaaguuguuagcaggcaugauauucaccccugaccaaaucauuacagaugcccacugcguauaaccaguaggacuucaccaguguguauacccacugucaacccuaagaguuagguacacguaauaaauaaaugguuacuagucuuguuauauauuagaccaacagccagguuugaaguuugacucugcuacacuggaaauacuugaaaggguuuguuaauaucagcaagaauuagugcccucauaaggaaguaaacagcaacuagacuccaaguucaaaugaguuuucccuguagguuagguguccucaacuugggauccuuaaaaccucugaaauuaaaaagaaaaaauuacacauaugcacauauauacauguaugaaugcaaccaaguguguguguguguguguguguauuuuucucugaagagggguccaaaaauggugacgcaucacuggguuagagguauacaguuuucaauauaaaguaauaaccaggaugcaguagaguuucugaagauaucauuguaaugugaaggagacaguauuuggaaauaguuaugaacucagaucugggaguuugaauucugccucugccacuuacugucugugcaaccuugcauaacugacagaacaauaacuucuuugcaucucacaugcaaagguggaaugcucauaauauccaccuaagaagaaucuuagagcaauaaaauuagacaauucccauaugguauucagcacaguacucaacacauaguauagaagucccugguuauccgcaggacagaugcuucaagauccccaguggaugccugaaaccaaacaguacuauguuucuccuacacaugcauaccuaugaaaaaguuuaauuuauaaauuaggcagaguaagauauugacaaugauagcuaaugauaaaauagagcaauuauaacacuaugccagcauuacuacucuugugcuggggccauuauuaaguaaaacaaggguuccuugaacacaagcaccaugauaccaugacaguugaucugauaacugagauaaugauuaagugaugaauggacagggagcaucuacagugcauaugcuggacaaagggaugauucacuuccucacaauggagcgagacagcaugagauuccaucaugcuacuuaggacggugugcaauuuaaaauuuauacauuguuuauuucuggaauuuuauaguuaauauuuuuggaccacaguugaccaugguuaacugaaaccacagaaagcaaaaccgugaauaaggggagaccacuguaugugaggacuaagaauuagauacugcaauggaaguauuugcaaagacuauuauauucagaugguggugaagguuugagccuucucuaacuacguauggcacacacuaucagaaaaauggcagggauucaucaauuaaucuauccauuuacuacuaguucagccagaggauccacuaauucugagacaugccuuguauaauaauaucuauacaauguugaaaaguggacagaaguagcugugaaucuggucacaaaaccucuuuuuauacaagaaagccucauucaaacuuucuccucugacacauuucccagggcccccucugggauuuccacaaacaugauguugugcuugacugugcauuacuauggaacaauucuaagccugucucaccuacauauaagauacagacuccgcaagggccuuuucaaucuccuucauuccucucagaaccugugcaaacaggauuuuaugcacagguaacccaaauaaagcaggguugccuugagacuugcaucugcccaauaacauauccacgaagaaugacucuguaggcauuugccagugcauugcacagcagcacagccuaaaauucuuccucacccauccauugccccaaccuuaaagcaucuguuuuaaaaaaaaaaauucaucuuucccuaucucucauucuaaccuauccccacccaggaugcccucagugccauucugcuuuuucgcugccaccacauuuacugugcucaugacaccuguccccucucuucaggguaucacuccugcaaggcagagagccuggccugaauaccuuucuucuggaagcagcccucuagaauucuggguaacagauuugcuaucuuguucuauagagaaguucauuacaagaaaugccuccauuccuggcucaacgcucacuuaaccuucuucuagaggccacaggcagaugaucuuccaaguuucucuuacccuagaauaguagugaagaaaaaaggaccucaucugcacucuaccugacuugcagggcaaagucaguauuaaucagaggugcccuuuuugcuacugacagacaaaguagaugcacucauaaccaagagcuuuucaccaaacccucagggcuuuaaaucuuucucaaacaaacugcaauuugcaaagaaacacccuaaaugaugcugugcaaggaaguuacagcaggcacagaaggauggaguaacauuucaccaucugcuugugauaauaauaaugccucuaccuugcaaagugucuaauugauugugugacacaggcacaaaguuccugccacaauuucaccaacaaaaguuauuccuaaauuguacccucacagagggagagugcuaaggucagugguccuaaggaccaauuuugagcauaugaacuuucugguggcagaaugauaagaguccugggacacaguuaggcaagauugaaccaacucacccuauaauaguuguuucaagcaauguccagccggggacacagagaacagagagguaggggauggaucuagggcaguguuuuccacuuguggaauggaaaaugccuuaagguaauauggaugaacaacugucuggguuuccuguggaggaagccugggcugcuuuacucucuaggguguugagccagaaggcuuuauucugguacagccaccucauugauagugagguagcaaugccugacaaaaguagauguucaugcuuugugcuagaagagcauagacuuagccagaugccaucuuuuucuaaauuggcagcacucaggccucaacugaagggguugggaaaagugagcuggaaaaaagaggccgggagcggcagcucacaccuguaaucccagcacuuugggaggccaaggcaggugcaacaccugaggucaggaguucaagaccagccuggccaacauggugaaaccccgucucuacuacaaaaauuacagccagcuacgccgaaggcugaggcaggagaaucgaucaaaccugggagggggaggcugcugugaacugagauugcaccaaugcacuucagccuaggcaacagagugagacucaaucucaaaaaaaaaaaaaaaaaaaaagacgggggcgauuccaagauggccgaauaggaacagcuccagucuguaccucccagcgugagcgaugcagaagauggaugauuucugcauuuccaacugagguaucggguucaucucacuggggcaugucagacagugggugcaggacagugggugcaguccacugagcgagagccgaagcagggcaaggcaucgccucacccgggaagcgcaaacauguaccacauguucuuuauccagucuaucauugauggacauuuagauugauuccaugucuuugcuauuguaaauacugcugcaaugaauauacacaugcaugugucuuuauaauagaaugauuuauauuccuuuggguauauaaauacccaguaaugggauugcuggguugaaugguaguucugcuuuuaggucuuuaaggaaucgucacacugucuuccacaaugguugaacuaauuuacacucccaccaacagugcauaagcauuccuuuuuuuccacacccugaccagcaucugcuacuuuuugacuuuuuaauaauagccauuuugacuggugugagacuguaucucauugugguuuugauuugcauuucucuaaugaucagugauguugagcuuuuuuuucagauuuuuguuggccacauguaugucuucuuuugaaaaguguuuguucauguccuuugcccacuuuuuaaugggguuguuuuucucuuguaaauuuguuuaaguuccuuauauaugcuggauauuagaucuuuguuagaugcauaguuugcaaaaauuuucucccauucuguagguugucuauucacucuguugguaguuuccuuuacugugcagaagcuccuuaguuuaauuagaucucauuugucaauuuuugcuuuuguugcaauuacuuuuagcauguuugucauuaaaucuuugccuguuccuauguccuuaaugguauugccuaguugauuuccaggguuuuuauaguuugggguuuuacauuuaagucuuuaagcuaucucgaguuaauuuuuguauaugauauaaggaagggguucaguuuuaaucuucugcauauggcuagcagcuuaacccaguaccauuuauugaauagggaauccuuuccccauugcuuguuuuugucagguuuaucgaagaucagaugguuguagguguacagccuuauuucuggguucucuaaucuguuccauugggcuauguguuugucuuuguaccagagccaugcuguuuuggucacuguagccucguaguacaguuugaaauuggguagcaugaugccuccaguuuuguucuuuuagcuugggauugccuuggcucuugggcucuuuucugcuuccauaugaauuuuaaaauaguuuguuucuaguuccgugaagaaucucaaugguagauuaauaggaauaacacugaauuucuauaaacuguuaagggccauauggccauuugcaugauauuuauucuuccuauccaugagcauggaauguuuuuccauuugucugugucaucucugauuucuuugagcagaauuuuguaguuccccuuguggagaucuuucaccucccuaguuugcuggauuccuagguauuuuauucuucuguggcaauuaugaaugugacuauguuacugauuuggcucucggcuugacuauuguugguauauaggaauguuugugauuuuugcacauggauuuugcauccugagacuuugcugaaguuguuuauaagcuuaagaagcuuuuaggcugagacgaugggguuuucuagauauaagauuaugucaccugcauuugaaugcacuuuauuucuuuaucuugccugauugcccuggccaggacuucuaacacuauguugaauggauguggugagagagggcaucguugucuuaugcugauuuucagugggaaugcuuccagcuuugcccauuuaguaugauguuggcugucuguuugccauagguggcucuuauuauuuugagguauguuccuccaauaaggaguuuagugagaguuuuuuaacauaaauggguauuaaauuuuaucaaaagccuuuucuacaucuauugagauaaucaugcaguuuuugucuuuaguuauguuuaugugaugaauaacauuuauggauuugcauauguugaacuaacuuugcaucccagggauaaagguuacuuaaucacagggaguaagcuuuuugauguguugcuggauucgguuugcuagcauuaggucaaagauuuuugcaucaauauucaucaaggauauuggccugcaguuuuuuuuuguuguaucucugucagguuuugauaucaggaugcugcuggccucauagaaugaguuagggaggagucccuccucaauuuuuuggaauagcuucagcaggaaugcuaccagcucuucucuguacaucugguaaaauuuagcugugaauccaucugguccugggcuuuuuuugguugguaggcuauuuauuauugucuaaauuucagagcucccuauuggucuguucuagguuucaguuucuuccugauucagucuugggugggugaacgugucuaggaauuuauucauuucuucuagauuuucuagcuuaucugcauagagguguuuauaauauacucugauaguuauuuguauuucgguggggucagugauaauauccuccuugugauuucugauugugcuuauuugaaucuucucucuuuucuucuuuauuagucuagcuaguggucuauuuuauuauuaauaauucuuucaaaaaacagcucuggauuccuugaucuuuuuuuauccaaguaauugaacaauucuacaaguauuaaauuuuacaccaggaauguaugaagguucccgaauccuugcugaugcuuguuauuguugucugguuuagugggugugaaguggugucauauugugguuuugauuucuauuucccuaaugacagauaacgcugagcaucuuuucuuuuuuuuauuauauuuuaaguucuaggguacaugugcacaaugugcagguuugauacauagguauacaugugccauguugguuugcugcacccaucaacucaucauguacauuagguauuucuccuaaugcuaucccucucccagccccacaccccccgacaggacccagugugugauguucccugcccuguguccaaaugaucucauuguucaauucccaccuaugagugagaacaugcgguguccgguuuucuguccuuguaauaguuugcugagaaugacgguuuccagcuucauccaugucccuacaaaggacaugaaauuauccuuuuuuauggcugcauaguauuccaugguguauaugugccacauuuuccuuauccagucuaucauugaugggcauuuggguugguucgaagucuuugcuauugugaauagugcugcaauacacauacaugugcauaugucuuuauaguagcaugauuuauaauccuuuggguauauacccaguaaugggauugcugggucaaaugguaauucuaguucuagauaauugaggaauugccacacugucuuccacauugguugaacuaauuuacacucccaccaauaguguaaaagcauuucuauuucuccacauccuuuccagcaucuguuguuccugacuuuuuaauaauugccauucuaacuggcauaagaucguaucucaucgugguuuugauuugcauuuuucuaacgaccagugaugaugagcauuuuuucaugugucugcugacugcauagaugucuucuuuugagaagugucuguucauauccuuugcccacuuuuugauggguuuguuuggcuuuuccuguaaauuuguuugaguucuuuguagauucuggauauuagcccuuugucagaugaauagauugcaaaaaauuucccccauucuacagguugcugguuuacucugaagguaguuucuuuugcugugcagaagcacuuuaguuuaauuagaucgcauuugucaguuuuggcuuuuguugccauugcuuuugguguuuuagucaugaaacucuuugcccaugccuaugaccugaauacuaucgccuagguuuucuucuaggguuuuuaugguuuuaggucuaacauuuaagucuuuaauccaucuugaauuaauuuuuguauaagguguaaggaagggauccaguuucagcuuucuacauauggcuagccaguuuucccagcaccauuuauuaaauagggaauccuuuccccauuucuugauuuugucaggugugucaaagaucagaugguuguagaugugugguguuauuucuggggcucuguucuauuccguuggucuaucucucuguuuuggugccaguaccgugauguuuugguuacugcagucuuguaguauaguuugaagucagguagcaggaugccuccagcuuuguucuuuugcuuaggauugucuuggcaaugcaggcucuuuuuugguuccauaugaacuuuaguuuuuuccaauucuaugaagaaagucacugguagcuugauggggauggcauugaaucuauaaauuacuuugggcaggaugggcauuuuaaugguauugauucuuccuauccaugagcauggaauauucuuccauuuguuuguguccucuuuuauuuuguugagcagugguugguaguucuccuugaagagguaauucacaucccuuguaaguuggauuccuagguauuuuauucucuucauagcaauugugaaugggaguucacuuaugauuuagcucucuguuugucugauaaugguguguaggaaugcuugugauuuuugcgcauugauuuucuauccugagacuuugcugaaguugcuuaucagcuuaaggagauuuugagcugagacaaugggguuuucuaaacauacaaucaugucaucugcaaacagggacaacuggacuuccucauuuccuaaucaaauacccuuuauuucuuuaucuugccuuauugcccuggccagaacuuccaacacuauauugaauaggaguggugagagagggcauccuugucuugugccaguuuucaaagggaaugcuuccaguuuuuauccauucaguaugauauuggcugcggguuugucauaaauaguucuuauuauuuugagauacguuccauuaauaccuaguuuauucagaguuuuuagcaugaagggcuguugaauuuugucaaagaccuuuucugcaucuacugagauaaucaugugguuuuugucuuugguucuguuuaugugauggauuacguuuauugauuugcguauguugaaccagccuuacauccuagggugaagccgacuugaucaugguggauaggcuuuuugauguguugauggauuugguuugccaguauuuuauugaggauuucugcaucgauguucauuagggauauuggucuaaaauucucuuuuuuuguugugucucuuccaggcuuugguaucaggaugauguuggccucauaaaaugaguuagggaggauucccucuuuuucuauugaauggaauaguugcagaaggaaugguaccagcuccucuuuguaucucugguagaauuuggcugugaaucuuucuaguccuggacuuuuuugguugguaggcuauucauuauugccuuaauuucagagccuguuauugguguauuuggagauucaacuuuuuccugguuuagucuugggaggguguauguguccaggaauuuauccauuucuucuagauuuucuaguuuauuugcauagagguguuuauaguacucucugaugguaguuuguauuucugugggaucaguggugauauccccuuuaucauuuuuuauugcaucuauuugauucuccucucuuuucuucuuuauuagucuugcuaguggucuaucaauuuuguugaucuuuucaaaaaaccagcuccuggauucauugauuuuuugaagggcuuuuugugucucuaucucuuucaguucugcucugaucuucguuauuucuugccuucugccagcuuuugaauguguuugcucuugcuucucuaguucuuuuaauugugauguuagagugucaauuuuauaucuuuccugcuuuguguugugggcauuuagugcuauaaauuucacucuacacacugcuuuaaaugugucccagagauucugcuacauugugucuuuguucucauugguuucaaagaacaucuuuauuucugccuucauuucauuauuuacccaguagucauucaggagcugguuguucaguuuccaugugguugugcggcuuucagugaguuucuuaauccugaguucuaauuugauugcacuguggucugagagacaguuugcugugauuccuuuucuuuuaccuuugcugaggagugcuuuacuuccaacuuuguggucaauuuuagaauacaugcaauguggugcugagaagaauguauauucuguugauuuggaguggagaguucuguagaugucuauuaggucugcuuguugcagagcugaguucagguccuggauauccuuguuaaccuuccaucucauugaucugucuaauauugacagugggguguuaaagucucccagucuuauugugugggagucuaugucucuuuguaggucucugaggacuugcuuuaugaaucugggugcuccuguauugggugcauauauauuuaggagaguuagcucuucuuguugaauugauuccuuugccauuauguaauggcuuucuuugucucuuuugaucuuuguugguuuaaagucuguuuuaucagagacuaggauuucaaccccugcuuuuuuuucuuuuuuuuuuuucuuuccauuuguuugguagaucuuccuccaucccuuuauuuuaagccuaugugugucuuugcacaugagaugggucuccugaauacagcacacugaugagucuuggcucuuuauccaauuuucccgucugugucuuuuaauuggggcauuuaguccauuuacauuuaagguuaguauugauaauuguggauuugauccugucaucaugauguuagcugguuauuuugcagacuuguuuaugugguuguuuuauagugucacuggucuguauacuucaccauguuuuuguaguggcugguagccauccauucuucccguauuuagugcuuccuucaggagaucuuguaaggcaggucugcugguagugaauucucucagcauuugcuugucugaaaaggaucuuauuucuccuucguuuaugaagcuuaguuuggcuggauaugaaauucuggauuagaauuucuuuucuuuaaaacuguugaacauuggcccccagucucuucuggcuuguaggguuucugcuaagaggucugcuguuacucugaugaacuucccuuuguaggugagcugaccuuucucucuagcugccuuuaacauuuuuucugucauuucaaccauggagaaucugacgauuauguguuuuggggaugaucuucuugugaaguaucuuacugggguucucuguauuuccuaaauuucaauguuggccugucuagcuaaguuggggacauucucaugaaugauauccugaaauauguuuuccaaauugguuccauucuccccaucucuuucagagauaccaaagaaucacagauuuggucucuucacauaaucccauauuucucagagguuuuguucauucuuucucauucuuuuuucucuauuaucugacugucuuguuucagaaagccagucuucaaacucugaaauuguuuccucugcuuggucuauucuacuauuaauacuugugauugcauuaugaaauuacuauaguguauuuuucagcucuaugaggucaauuacauucuuuucuauauugacuauuuuuucugucaccuacugaauuguuuuaucaugauuuuuagcuuccuuguauugaguuucaauguacuccuguagcucaaugauuuucauuccuauccguauuuugaacucuguuucuguuauuucagccaucucaaccugguucagaacccuuacuggagaagugaugugauugucuggagaaaagaaggcacucugguuuuuugaguuuucaggauucuugugcugauucucucucaucuuugugggcuuaucuaccuuuaaucuuugagguugcugaccuuuggaugcuuuuuuuuucuuuuaaccucuuugaugaccuugaggguuucauugugguacaagauggauuugccccacuggcuucguuucuggaaaauuuuagggggccaacacucagcuuccaacucauggacugugugcuguaacucugggguacuuguauuguuuuaauuuuaaaacaggaaauggcauugcuuuauuuucacuaagucuauuauuacuuucuauuuauggucaguaaugcugcucuuacauucauggugagagucugcaaauucuguuugauaugugaauauaaguaaauaaaagugagugacuuuuuuaaauuaaaauaauaauaauaaaaaaaaaguggucugcauauuuggcccaaagcaaaaaagucugggaucaacucucccugaaccccagcucuucccaucccaaccaccuauuuuuccucaaaagccuggauuugggugugaagguuuuuagauucuccuuucuucuuuacccuuauacucacuugggauccuucacaaccagccuaucaacauaauuugggaaaaguuauuugugcagaaaaggucugguucuuuccuacuggagaauugcagaauaaacaaaacaaaugaaucaauucaaagacgcuuucagccuccagcaacuguugcauuuuuacaaugguaaaaggcagccaaaccucucauuugcccagaaguucuuucuuuuuccaaugguuuuaaauggcucuaaagagaaugauccaacuuagcagauaaaaggccaagccuccuguauagagaggucuuaauguuuucuuuucagcuuuggaacccccugauuauuagcauuguauccuuggacaagucacugagagccugaauuucuacacuugacaaacaaggaccuacuucacaagggagauaaugagcaucaggcacuuaguugagggucaggcacauauaagggcuuuaaagagcuauuacaauuauuauuauuuuguuuguuuguuuuaauauauguauacauugugaaaugauugccacaaucaaauuaauuaucauguccauuacugcccaguuaugauuuguguguguggugagaacacuuaagaucuauucucuuagcaauuucaaguguacaaugcauuauuauuauuaacuguaguuaccaugcuauaaaauagaucuccagaacuuccuccgcucuaauuaaaacuguauguuuuaccagcaucucccuauucccccaccuccucccagcccuuggcaacaaccaucauucuacucucugcuucuaugagcuuggcuuuuuuaauuaauuaauuuuuuaauagacaaauaaaaauuguauauauuuaucagguacaacauauuuuaaaauauguaugcauuguuaaauggcuacauugagugaauuaacauaugcauucaucacaucuuuuuguuuguuuguuuguuuguuuuuugagauggagucucgcucugucgcccaggcuggagugaaguggcgcaugucagcucacugcaaccuccaccuccuggguccaagugauucuucugccucagccuucugaauagcugggacuaccggcaugagccaccacgccuggcuaauuuuuguauuuuuaguagagauaggguuucaucauaucggacaggcuggucucaaacuccugaccuugugaucugcccaccucggccucccaaagugcugggauuacaggcaugaaccaccaugccuggcccaucacaucauuuuuuauagugagaacacuuaaaauuuauucuguagugcuuuucaagaaaauaauacaugguuauuaaccauagucauuauguuguacaauagaucucuuuaauucauuccucccauaacugaaauuuuguauccuuugaccaacaauucuccaacugcccacccuccgcgccaacuccugguaaccaccauuuuauucucugccucuaugaguuugacuguuuaaaauuucgcauguaagugagaucaugcaguauuugucuuucugugccuggcuuauuucacuuaguauaauguccuccaguuucaccaguuugucuccaauaacaggauucccuucuuuuauuaaggcugaauaauuuuccaggguguauguauaucacauuuucuuuauccaucauauauugauggacacuuagguugauucugaaucuuagcuauuaugaauaaugcuacaauaaacaugggagugcagauauccuuagaagacuuauuuuauuuccuuuggauaacuacacacuagugggauucuggaaucauauggugguucuaauuuuuugaggaaguucauacuguuuucuauaauggcuguacuaauguacauucucaccaacaguguacauggguugcuuuuucucuacagcucagcaacacuuauuaucuuuugucuuucugauaauagccugauaaagaaaaacuucagccaaauuaaauuuaaaggaguuuaauugagcaaugaacaguuugugaaucgggcagccuucugagccagagcaggcucagagacuccagugcagcugcgugguagaagaagauuuauggacagaaaaaggaaagugauguacagaaaauggaaguaaaauacagaaacagcuggauugguugcagcugggcgcuugccuuauuugaacagaguucaaacaguuggcuacauuugauuggccaaaagucagugauuggcacaaggguaggcuaugguuuguuuauaccuccgcuuguuauaguucacgauguacggaaaaaccuuuaggcugaacuuaaaauauguaaggaggcagcuuaggcuaaacuugaucuaacaaaccauucuaacaagugugaggugacauuuuauugugacuugaauuuauaguccccugauaauuagggauauuaagcauuuuuuucauauacuuggccauucauaucucuucuuuugagaaaucucuuauuauuaucaucuucauuaucacucuaauuauuaauaauguucacuaacccauacagcuacagugauuuuuguuacaacaggagcuuucugcuuucaaaaaaaagugcugcuaccuuaaguaaucauuuauccuaacucuaggcugcaacuuacuauuauuauuauucauucaacauucacucaacacuuacuuccuagagccacuguuugggcacuggggaaauagcacugaacaacacagagcaaagucuuugcccuguggcucacauucuggugaagcagagaaacaguacacauaauaaaugaauguuaauuacaguauguuuggcagugaugaaugcuagagaaaaaauagccuaugaccuggcaaaggcauuacccauuaagguaaaggaccuaucuccuagagcacuugaguuuuguaucacauaauucaucaaggccuuuagauauuacagucugaucuuugggccaguggucucccugugucacaaggcaagcgggccucaagaaaguaaaaaaggaaaauauuuccucuauuugcuauugccaaaacuuccuccaagagggaaaggauaggacaaaaaguauuuuguguggguguggcagccauagcuaggcuaucaaauacuaugcacauaugauaugccacucucagucccuauaauggcagauaugauuaagguuuccucuuuccugcugagcccagaaccagcuucacaaacuuuuucagcacaguucucugggcaagcaacuuuagugauuaaaguuagccuaaaagacuaaaucuaugugccaucauagagugcaaaguuagguuuaaauguaaauauaucuagcaaagguaucauacugacuuaaaaucacacuaaguccuaaaugacuggucuucuuccaagugaacauuuuauuggagguagggaauggcuaagaagaaaugcuguuaaguguauagaggggaggggcagaaggcauguaugaagaaaaggacagguuuuauaaucccacccacauuuguaucugaacauguguguauggcaaacacaccugauagcaauaacuuaagcauacccuaagaauaacccuguauggcagaugcacuugaaugugguuaggugucccaagcuaagaauccaagaauggccaacccagagaguuguuccuaaucuauaaggaacaucugagccccuggccuguccaauggaacauggcuguauagggaaucaaggcccuuuguuugggguuaagugaagguugccagguagagacugucacagggagagugcuaaguaaauaugccauauaaacugcauguuuuuugcaaguugccugguucuccuguccagcccacugccacuggacucucuccccuguauguaagcccccaguaaaagcccaugucacguuuccugucucugggucucuucuucagccucuugaaccuggugccauccccacugaaguugauagguguucagcacaacagugucauuaggaauuucuacaaugucauaagcaaugucauaaggcauuucuacacacucucacuugaaggaaccaccuccauuaguguaccuuagucuuucacacaaacacauaccugagcccacaaauaaagugcucaaaaauaguggcucucuucuucuaguuguucaggccaaacaccuuggaguccaccaccaaauccuuuuaggacaaccuucaaaagauuaacagccacuucuugccauccaaccauaccauccaugauaauccaaccauuucuugccagcucuacccugaccuccaaaaucaagccaccaccaagucuuggcaagaagggcuacaauaauuccccaacagucucagcuucugccugugauccuggacugucuaucucuacuuaggagccugcuaaaaccuaagucagguaacaucccuccucuggccaaaaaccucuaguaccuuccuaucucacccagaguaaagucccacaaggucccucacgcucuuguucccaacugucucucaggccgcuuuucucuugcccugcuuuguacucuuccuuccagcccacaggccuccaugcuuuccucaaacaggccugcuauguuuccaucccaagaccuuuucccuugcugcugccuuugccugggagacuuuuacuccaaggugccauauggcuucuuccuuacuccagucacaucuucaauguggccaugagaggcccugcuagaucacuugaucuaaggcagcacacaagccagcccccaccuccacccucucccucuaauucuccuuaccuuguuugauaauuccucauggcauuuaucacuuucuaacccaauauccuuccuuccuuuccucccuccauuccuuuuuuccuucuuuucgucacuaucugucuuccaauagaaaauaagcuccauuugcauaggggcauggucuguucuacucauucuucugccuagaauaggaucuggcccagagcaggcugaccaacucuuuacuaaaaacucauccgucacugagaacuagcaccacaccacagaaggaagaaggcucugcaucuacaaaauacagcugcuuuguuugagugcuuugagcucugucuccuguaacugggugacaaaggucuaaacacauaaugauagugcuggugugauagaaagugaaaguucuuuacucuugaaaaaaagcuagauuuuaucaagugcuggauuugcucaguggcauuuagguuuuaccgcuauaaaacaauauuccuauuucuuaaguucuugcuaggaaaacaaguaacuuugauuuuucagucugaaacucuccagcgccccuuaacuauggcccccgaaacaaacauuuuauacugaauuuuugauaacacacaauuuauuaaaaugcagcuauuacauuagugcagaauaagcuauauacauucuaagauuuagcaugcugucaaaagguuuccucauuggaacugauagcuaccccuaaagcagagauggucuugagcauaucauuuacccacuuuaagccucggugccuuuaaucuguaaaaugaauggcuacaccaggcucucucuagcauuuauuccaaaugauacauucaggcaggcaggcaugggauccaguggaaaagacuugggauuuggagcuugagaucuggcucugucacuuacaagccacacugaaucucauuuuuuuucaucuauaaaacauuaaucacuggaaauaacuaccuugucuauaccaccuuuugguaucuuaggacauacauuuggaggaucaccaagacagggcugugaggacaucuauuugguuucccaggaugagcagaguaccugacacaucacaggcacucacgugcauuugcugcguggaggaaagaauauauggacaaauaaaaaaacacuuccacaccuccccagcuguuguaaggacuuacuaaagcaaugcauguugaaagagcuuuuuaaauucuaaaguaauacaaaugauaauaauuacugugauagaucuauuucacauuugcccaguucagccuugguugucauacuaauuuaauaccaacaugacuggaacuggaaagaaacuaauauugauugaggucuuacuauauccuaagcagauacauauguacguaugugcacguauauaauuugagucuucuaccuuuuuaaccaggugggugucuuaauguaguuauaaguucuagccagcagaagucagaaacugagucaaaacugaacucacaaaucagucaacaguuacuuagcacucaguacuugccagccucuaugcguggugcuuugcaggcaugggcacauucaguuuuucaacagccuuugagguaaccacagauaccccuuuuuauagaucaggaaacacagacucagagcaguuaaguaacuugcuucaaguuaacagcuaggagguggcggggccaaaauuucacugucugacuucaaaguccaugcccuuaagcaguauauauuaugcaguacauucauguaagcuuaucacugaagguaugcggaauaauucgggugcuuuuauuuuuguucaauaaaaagcugcuuuagcacucuaucaccacugccuuaauuuuuuuuuuuuuuucuaaaaugaaaaucugugccugggaauauggguauaacuaaaaaugggacaggagaccacccccagaaagacaggcggccccaguuucaaguucuuauuucucacauuggcccuucuggugugucccagcuguauugucauaaccuauagggaaguuccgcagucaggaaggccaaugacaauauauuuccccugacaacacccuggucccuuucugaguuauucaaugacaauugaaaugucuuuucaauauuuucuuuuccuuuucagggcaaacauguccacuugagucauuaugaucaucagcuguucugauuugcaagcaguuccuaauugaguaggacuagugaaugcugugagauaugaaauaucuugcugcuaaauugcacacaggcugaaggcaauaagaauuuguuuagcuaugcauagcgcuuuauauucagggaccagugguuauggagacacuaaaaccagucaucauuaggacaauccuaucuuggcuaccagagaaugaagauccccacacagagcuaccugaacagacuaacggucaagaggcugaugaggcauuaaugagaccaugaaucaaaauuuaccaaacaaacagugccuccaaggcuucuaguuguuucuguuugacuuuaucuuggaacuaacuauggaacaagauggcuguguuuagaugucuucauucauggccuaucuuugaacacuguguguguuuauuuguuuguuuguuuguuugagacagagucuuucucucuuaucugggcuggagugcagugguaugaucauggcuuacugcugccuugacuucccaagcucaagagauccucccaucucagcaccccaaguaacugggacuacaggcgugcaccaccaagacugacuaauguuuuuauuuuuaauuuuuguagagauggggucucacuguguugcccaggcugcucucaaacuccugggcucaagugaucuugccaccugggcaucccaaagugcuggaauuauagguaugagccaccaugucuggcaucuuugaacaauucuuccaagcaacuauuuugacuucauuucuuucuaggaaaaauaaauaaacaagaucauagaguuauauuauacaauauaaaauccaaauacugacaaaagucaaccauauuagucacuuuccacuaaauaaaguugugucuaugguucuuucucugggaaaauuuaccauguaguaacuaucauuuacuuaguaugugcuaagcaccaugcugagagcuuuguuccuaacucuuaguuagguuaccuuagaaagccccccacaccuggguuauuuccuaguucuauguucuagguaccucucugucauuaagcuuaccacaaacucauuuguuuauuugacaucucucuugaauugaacuguaagagucacuagagccaggaccaugucuaucuuugcccccauuguaaccccagccucuaacauaacacaugauauacagcggaugcucgauaaacauuugaggaauaaaugaaggaagcaagucgaagaaacaucccuggguugcuaucgcuguaagcaguagaaguugcauuugaauucagacuccaaagccuguguuccucaccugcagcacacggucucugucugagcugaauagucuguugcaucaaaacacaucaaacaggaaauaaacaagagcaacuauuauuaccacggucccauacagccacuagagagcaaaagggguuucucuaugacuauugagguauauuaaggacucauuacagaauaaacacuacugggcacaaaagcauaugagaaaaguuuuaggaguacaaugaaaucaugcccaaucuuuccucagggucccuuuccauucucuauuuauauuguuuccaguuuauuauuauuauaacugaacauuuaggacccaagggauguuggccaguggagcuacagaauucucaguccucugaggaaccuagcaacuaguguuuucuuaccuggcucuuaggagcaaaaggagaaaacaaaugugcaucccugagcuguugucuagcauauaaaaaagaugcuauuauuaauaacauuuugucuuauuaacauuuguccuacugugauuuauuggcagccagaagcccaagcuuuaggauuagucagaccugaauugagccacuuaguucuuguagggccuccaccaaguuauguaaccucaaccucuuucuucaugcauaaaauaggauuaguaauacuaucuacuucacauaagugcuuggcauagaaucuggcacagaggggaaaaaaaaacaaucauuggugcuuauuuucaucagcuuccuccuaauuauuauuuagucagcugugaguaaaaagaaccuagcguuggccauggaaccuggaaauaugaccuuugacccuguccuguuaaugcaauuguagugagugaauuuuuuuuuacguguucccauccccgagcagucccucccucucucaaggacccgguggacuuccuggucuuggcaaaguaugcaacacacauuuaccuuuauccugccagggaagugaagguuugagaccauuaagcugggggcuucccaccuacaguagcuccccaaugcuuccaguacaaaguuuaaacuccuuagcuugccacucaauacccaacaucauuugauccaagcaacuuugagcuugacaucagggccaaaagaugcuuuuuccacuuaagaacagaaauucaguccaguagacuaguggaggauaugcuaauauuuuacuucccuuuccauccggaacagauaauaugguaaaucaucuguucauuuagucagaaauaacuguuguucuagguguuggggcuauaacugugaaaaagaagacuugauuuuauggaauccacagccuagugaaagaaagagacaauaauuaaauggugccauuguguauaaucaguggauaauuauaauuggaaauaagugaaaagcaagauaaccauccuuggacuggaagagaaaaugccaaaagcccagaggagggcuaagaguucaccaugugaaggagguaucacugugucuagagagagccuggcauagaauggaucugaaagccugauaagaggcaggagcgccaagaguaaaggccaagcacaaggaggcuggagcaauagguagagcccaacuguccagugggaggaaggggaggaaaugaugggagauaggcaaggaggggugacagcaggaaggaaggaaaaugaacaaaugccagauauauucagcagauaaaauagaaauaagcugcugauaaaauggaugacagggaagggaaguccugaggguguggcagguagccagaaugacucugagauuuguggaguguggaaauaaaaggauggaagugccauuuauuaauuuuauucuuaaagauaccuugagacaguugagaggauaugaugagacaacugcauguauacaguugugcauaagguucagagaaacacuccggcuggccauugcagcuuguaggaaaguauagggccugggaagaagaguauugaaaaaagaaaaaggugacacgcuguucauaugagagaugcaagaaugaagcaauaguggcauuccacaagccaggacugagaccgucucccaaacagccagaugacucugaaccucaaaccaacuugcagucaccuuagaauuuuauuagcugcaccagauggcuuacauaauaucauuaacuccuccacccucacuaccuaaaaaugcuagaagauaaaagggacggcugaggaaaauccuggaauuuucuuacagaaacaacauuuacaacagguaacuagcccaucaguuucucuaguauuucucagacauuuccaguuaagucucuagaaugacaaaagcaaaugauccucgggucuugguggugccaucuuaaguuucccucuguaaauguaaaugauuuuuaaagccucgucuaguacuuuaaaaauucaugcaaauuuugcauguuacugcauaauaucauuaugcugcuuuuaauacguacacacacuuuuaauucucccaaauacugaagcaaaaaugaugugccacaaaugugccuccauuauuagccugugacuuugggaaugcccuuguccacagcuuugcaugcaggguugaacucauuaacuaaguugagaaccaugaaauuaaucagaaauggacuagggaaguuuuuccuuagagcagaagacuagagucaugaccucuaaaaaucacucuucguuccuacaaauucuaaaauaagugguaauaauaacauuaauauuaaaaucacacuaaguggauuuuaaauucauucucucacacuagagguaguuacuaugguacauaguaugagagagguaucaauuuaaagauaaagaugaggauacaaacacagaaaguuaaaguaucuuucaaagcaccauaauuugaagccagacaguucuaguccaagccaaacuacuauuguccucucugcuacauauuagcagcaaacucaucuuacuacucuugcugauggcuuauauuuggugauaaucaagaacaauacugaaaagcaugcuucaaaaauagaaaaaaagcuucaucuuccccaaacauaauuuuauuuaacugaaaaauaucagugugcaaauugaacauuuuugguacauaaagucaaguguuacuaauuaaguaaaugagugaugaaucauaauaucaacccagucauuaaacaaaauuauaaugaaauuacauuuaccaacuaguuuacaguacaaaaaauauaaugagccaacuuuaaagaaagcuuccaauaauuuuauuaaggccuuccaauaauuuuauuuaguuaaggauucuguuguauuaucuuaaaagauuaauacaaauagaaaauggaagaguaaacugugcaaugacuucugucccucucaaccuuucucuagagucacaucuuuuaagcaacaugagacaugauuuaauucacccaagagaggucaccuugcuugccgggcaggugccuucuguuuaaauucaguuuacucaaucaaauguaccacggaauagaaaauggggcauauuccuguccugaaauucuuccuauguuaacuaaaaucaccuuacuuuuguagcaaaugagccaugagauacggugccagaaauugauuuggaagaguaaguacacagucugaaaacagugucuguauguuuuguaauaaaaaggcucuggauggcccuagaugccaaagagaggcuauaaaaggacaaaggaaugcaaacaggggcagaacuauacaaaaagauuaaaugcaucaccacuaaaagcgauacuuacucuucuauaaacauauacauuuacugauugcuaauuuuuaucugacgagugguuuugagguggccucagugcaaugucaucuccccugagcuugugucuuggaccuagcuagaguagaucauuacuccccaauacagcucccauuauuuucuuccuagcacuuuaaaaaggcucuaauuauuuucucuuuaguuuuccacuugcuaauugccuauguucccuuugucauuaccagugccuagcucagugucuggcccauagugagaagauacuauaauauauuuaccgaacgaaugaacaaagcugcgaguggcaaacaggauggggcacucuuuugaguucauuuauacaaaucagauucuauuucauuuuauuaaauacuuuuauuuacucauugucuucugaaauuacucuggguucucauuaauaaggagaaacugauucuaucuucaggaaggaggggaaaaaacacuuucagucacuuguuccaaaggucuuucaaaauaauguuguaguauaauuugguuugaaagcaagguccaacauuuuauuaccuccaaauuuauucagaaaagcugaaggcccgugauaaggcucauuaagucgcugaaaggccuaucuucacgugccuuucacacaaaaggucucaacuuaaugccagguaauuacuguucauuuuccccugguuaucucuauuuccugaagauucccagaguaguuggccucaguggacacuacccgcagucugagaugugagcagagcaagaaggacccauguucacuggaggaucuuuuuggagcuguaacgaaagacaauccuaacacuggggucuagaauuuaaacuuagaucaucuacaaguuacccucuauccagaauuaaagccaagagggaaaaguuucuggcauacaaacugguuuguauuuccauuucaaagacaucauuuuucauagcaccuggaccucauuccacaccuguaggguuacagaugugggcccuggcuccagauuaccugggcucaacccucaacuucaucacuuuccacuuuguaacuuugagcauguaacuuagauugucagugugucaguucccuuauuugugaaauagggcucauuguaccuacuggaguguuguuguaagaauugaauguaaaguagaaggaacuuuaucucacacaugguaaguucuccauaaaguuauuuauuuauuaauauuaauuagcauuaucaugaucgucucugauaucccauuugcaagcaggacuuaucccuguuauuuauaacuuugauccuagucccacuggacccaucauggcauugagggagaucaaauuucacuauuugugaaacaagccaacagaaggugaaugaugaucagggaagacauuuuacugggcaccaucauuucaguuuugcacggaagagugguauagccccuuagaggucacugaagucaccauccccaagcauacaccuguuuuuauauuuaaucaauugauggcugcaauuuacuaaucugcacugcagugauccuacaauagccuucccucacagugggcucuccucacuucagccaggucauucauaagagcuuagcuucauagauacugugauaguaauuuuuuuuuuuucgagauggagucuagcucugucgcccaggcuggagugcacuggugugaucucagcucacugcaaccuccaccucccagggucaagcgauucccugcuucagccuccugagcagcugggauuacagccaccaugcccagcuaauuuuuuuuguauuuuuaguagagacgggguuucaacauguuggccaggcuugucuugaacuccuaaccucaagugaucugcccacauuagucucccaaagugcugggauuacaggcacaagccaccgugcccagccuguuauaguuaauuuuacugucaacuugacugagcuaagagauucccagguagcugguaaaacauugcuucugggugugucugugaaacacccugugaggguguuuuuggaagagauuaguauuugaaccucaguagauugaguaaagauaacuguccucacaaaugcauguggccaucauccaauccacugagggcgcaaauaaaacaaaaggcagaggaagggugaauuugcucucucuuauggagcagggacaucagccuucucccgcccuugggcugggacuuacaccuucaguucucugguuuucaggcuuucagacuuuaacuagaacucacaucaucaggucuccugguuuucagcccuucagacucaggcugagacuauaccgccagcuuuucugaaucuccagcuugcagacggcagaucaugggacuucuccaccuccauaaucaaaugaguuaauuccucauaauaaaucucuuuuuauugauucuuuuucucuggauaaccuugauuaacacaaccucugaguuacaagagauaauuaaauauagcagcugagagcaugagcucaaaacuugaaugaccuggguucaauucuucacugucacuagugaaccagggcauguuacuuuauacacuaaggcuaaguucaccaucuagauauaggguuaauagagugguaacaaauccaaaggacuaaggacuaugauaaggauuauauaagaucacuaugggugacucuguaaaacucuuagcauguugucacuuauauaacaaacauucaauaaacauuagcuacuauauuuagacaugucuugggcauguauguuccagaaaucuuuuuauauuagauggucacuacagaaaggcaaucuauaugccaagcuuuucaaugaagcaaacauuauauuugaauacugagucuuaaccucaaaagguuacagaacaauuuucauucaagaacaaaucagaaaucacagguuggaguguacaucaucccuuggcagucucagcaagcuaacccuaccuaaagugucagaagacuuuucucguuuacagaaaugccuuuagaaauccccaaccaaccacugguagguccccaagcuucagucuucaaagguggcacuuuugcaggcuaaaaaauccaaaaaccagaaugucucuucuccuccaaaggaucacaacuccuccccagcaagggaacaaaacuggaccaagaaugaguuugacgaauugacagaaguaggcuucagaagguggguaaugacaaacuccucugagcuaaaggagcauguucuaauccaaugcaaggaagcuaagaaacuugaaaaaagguuagaggaauugcuaacuagaauaaccaguuuagagaaaaacauaaaugaccugauggagcugaaaaacacagcaugagaacuucguaaagcauacacaaguaucauagucaaaucaaucaagcagaagaaaggguaucagagauugaagaucaacuuaaugaaauaaagugugaagacaagauuagagaaaaaagaaugaaaagggaggaacaaagccuccaaggaauauggaacuaugugaaaagaccaaaccuacaacugauugguguaccugaaagugacaggagaauggaaccaaguugaaaaacacucuucaggauauuauccaggagaacuuccucaaccuagcaaggcaggucaacauucaaauucaggaaauacagagaacgccacaaauauauuccucgagaagagcaaacccaagacacauaaucgucagauucaccaaaguugaaaugaaagaaaaauguuaagggcagucagagagaaaggucggguuauccacaaagggaagcccaucagaccaacagcagaucuuucugcagaaacccuacaagccagaagagaaugggggccaacauuuaacauucuuaaagaauuuucuacccagaauuucauauccagccaaacuauguuucauaagcacaggagaaauaaaauccuuuauggacaagcaaaugcugagaaauguugucaccaccaggccuaccuuacaagagcuccugaaggaagcacuaaauauggaaaggaaaaacuguuaccaggagcuacugcaaaaacauaccaaauuguaaagaccauugacacuaugaagaauccgcaucaacuaacgggcaaaauaaccagcuugcaucauaaagacaggaucaaauucacacacaacaauauuaaacuuaacuguaaacaggcuaaaugccacaauuaaaagacacagacuggcaaauuggaaaaacaguuaagacucagaggugugagacccaucucacaugcaaagagacacauaggcucaaaauaaacguauggaggaauauuuaccaagcaaauggaaagcaaaaaaaagcagggguugcaauccuagucucugauaaaacagacuuuaaaccaacaaagauuaaaaaagacaaagaagggcauuacauaaugguaaagggaucgaugcaacaagaaaagcuaacuaugacacugaccaagacaauccuaagccaaaagaacaaagcuggaggcaucacgcuaccugacuucaaacuauacuacaaggcuacaguaaccaaaacagcaugguacugguaccaaaacagagauauagaccaauggaacagaacagagcccucagaaauaauaccacacaucuacaaccaucagaucuuugacaacccugacaaaaacaagcaauggggaaaggauucucuauuuaauaaaugguguuggaaaaacuggcuagccauaugcagcaaacugaaacuggaccccuuccuuacaccuuauacaaaaauuaacucaagauggauuacagacuuaaauguuagaccuaaaaccauagaaacccuagaagaaaaccuaggcaauaccauucaggacauaaacaugggcaaagacuucaugacuaaaacacuaaaagcaauggcaacaaaagccaaaauugacaauugggauccaauuaaacuaaagagcuucugcacagcaaaagaaacuacgaucagagugaacaggcaaccuacagaaugggagaaaguuuuugcaaucuauccaucugacaaugggcuaauauccagaaucuacaaagaacuuaaacaaauuuacaagaagaaaacaaccccaucaaaaagugggcgaaggauaugaacagucacuucucaaaagaagacauuuauguggacaacaaacauaugaaaaaaaaccucaucaucacucgucauuagaaaaaugcaaaccaaaaccacaaugagauaccaucucacaccaguuagaauggcuaucauuaaaaagucaggaaacaacaaaugcuggagaggauguggagaaauaggaaugcuuuuacacuguucgugggaguguaaauuaguucaaccauuguggaagacaguguggcgauuccucaaggaucuagaaccagaaauaccaucugacccagcaaucccauuacuggguauauacccaaaggauuauaaaucauucuacuauaaagacauaugcacauguauguucaauugcagcuguucacaauagcaagacuuggaaccaacccaaacgcccauuaaugauagacuggauaaagaaaauguggcacauauacaccauggaauacgaugcagccauaaaaaaggaugaguuuauguccuuugcagggacauggaugaagcuaaaaaccaucauucucagcaaacuaacacaggaacagaaaaccaaacacugcaaauuuucacucauaagugggaauugaacaaugagaacacauggacacagggaggggaacaucacacacuggggccuuucaguggcuggggcgcuaggguaaggauagcauuaggagaaauaccuaauguagaugacagguugaugggugcagcaaaccaccauggcacauguauaccuauguaacaaaccugcacauucugcacauguaucccagagcuuaaaguauaauaaaaaaaaaggagaagaacaaaaaaagguggcauuuuuucaaaaauuguauuaagugauaagauguuaacauaaaaauuauuaagaugaccaaaauacauuagaagaagcagaaaucaaagguaggcaugcaguagggucucuuuaaccuacuucuucuuguucuaucccccacauuaugcuugcucuguuaauggcaacauuuacucccuuaguguaguaauaaauguucagcaacugggugguggggguguucuaauuguaguguuugccaauuuucaugguguaaauacauacucucaccauggcuggcuucaagauaccaacaugauaucacugaaaagggaguugggaagagaagcuuauaaucagcucuuacaaauacguacaacauggauacucuugagcccaggaaaagaaaagguaugugaauaacauaguaucaaaagcaucuagucucuucuugagccaucagcccauucuugucagguucacuauugggagcauggagaaauauaugaacugaaagcaaaaguuaugaaggcaggggauagaaaauaguaucauuaccacugaagagaaagaauuguauuuuuuccuguacgauaggcaacauggcacacagacauaacaagucuggguugaggacggcuauuagagcaaaacguguuuuagaaucagaauuuuauauuuuaaaaccaauuggcaugauucuugcauauguaucaugaguguaugauugccuaugcaugaguucaguauuaagaaauagccaaaacucucugugguguaggacuuccaucacaccaaccaggcagagaggcuuucuuugaaugcccgaacucugcucauucuccaucauccuccauuaacggagggcaguuaaugcacauaucugccuguguggugguaaaugcuuaacaacggcugguggugggauggggguguucuaauuguaguguuugucaguuuucaugguguaaauauuaauacauauucucaugguggcugguuucaggcuaccaacaugauaucacugauuagggaguugggaagagaagcuuauaaucagcucuuaaaaauaaguacaagcuagcuccaaaaaugucuauacuauguuuccaagagaugaaaaccucauggacaaauacucuuucgcgauauauaugguugcuguaaaguaauuuuuauaugguucauugugagaguuuaaguauuacuucuuuuaaguacuagaaauggaaauauaaucucuaaucccuuuucuaacugaaugaaauguuaacuucgaucauccaucugugcaguuacucuucuaguaaaugugauuuuuuaaacuuucucuccucuuuucagggcuacaucugcuaguguuuuccauuugccagcucccaacauguccccaauuacuucuuuuuuauuuuauagccuccaugcugauguuucaucaguuacaacugcuggguuccacugagcauuaacagucugcagugccucuaggagguuacauaauucacuaaguauaccaaaucauuuuuucuccaaagaauauuauuuaauguaaauacagugugagguuaauguaguacaaaagaaagguuuuucccuuagaaucaucaaaaaacugaaaaaaaugauucacggaagaaugguuuacacgcaggaacaagaaaucacuuguauuuaaggauuauuucaacuggcacuuuuuuacuaaacacaaagcaaaaaauuaauacauuugaguacaugaacaaguuuguguuuuaccuauugaaucaaaauauuuuuaccacaagagaaggaagcuaaaacuaccuuauguuaggcauaugcauacuugaaaacuuaugauagaauagauauuugaaaucauuuuagucaauagcaaagcaaaaggaaggaucaagaaaaaguucuuuguuuuguuuuuaacucaauuuuucuuauaaauaccuaauuguucuccauaaaaaguucauaaauaaccugauggaugaucugaaaauuuccaggcagguagcaggaacucucuagaaguaaaugucccagaaacuuugcaaaucaaaucacucaauucuuaauagauggcuuaaaacuggguauuacauugcaaaguuuuaugaaaaucaucuggcaaacaacugucuuuucuucaagauguaaacaaugaaacaauuagguuuaaacugucuaaaacuaugugcucaaguguccccuuuuacaucagagucuaagugggacaaugauggagcaguuagaauuuucucagguagucagauggggaaacaggaaaaggaugggaggaggaguaaucauucaaggaaauuuuuuuaaaugacaguaucaauauugaauauuucuggaguaucaaucauuauaguaugcccuugacauauagaaucuucuccaguccauauacacugugaaguagguauuaccuauccaauuuuauagauagguaacaggauggugaguugcugcucaggguauuaaguaagugaccaagauccagugcuuagcuaagucuugucuucaacaguguggagcuggggcuggguugggaccucugugguccaaagccccagccacuugacuucauacugcagcuucugguugguaucuauggcaucuaugagucugacagcuauauuuucacucauuuucagucaaauauuuaucaggcaucuacuugagccagacaccauccuaggcagcagggcccaauaggaaacaagacagaaaacaaaaguaaaaaaaaaacuugucuucaugccuuuggggucuucuuuguaguugagagagaaagacaauuguauuaguccauuuucauacugcuauaaauaaaugccugacacuggguaauuuauaaagaaaagagguuuaauugacucacaguuccacaugguuggggaggccucaggaaaauuacagucauggcggaaggggaagaggcacaucuuacaugguggcaggcuagagagagcagguaagggcagggaaaacugccuuauaaaaccaucagaucuugugagaacucacucccuaucaggaaaauggcaugggggaaccacucccaugauccaauccccucccaacugguaucucccucaacacauggggauuauaaggauuacaauucaagaucagauuuaggugggaacacagagccgaaccauaucaacaauaaaacaaaauaaacuaguaaaguauuuagcauguuagcuggugauaggugcuguagagaaaacaaagcccggaaggagcguggggagaguaccagggugggugguggaggagguuccaacuugaauggugugggccucauggaaaucuuguaaaaaccccaagaagaugagagagcaagcccuacuguacaaguuccuggaaguaaagcacauagggcugagggaaaugaagggcagagcaacccuaaaaggcuagaagaaaaguagagagccuggaguggaaugaccaagaaaaaagcaggaggaagggaggucagagaaccacaagcgcgguggcagaugaugcagggccuuguaagccaccaucauaguugccaucucuucuccaaggcaagugagcagguugugaaccaaggagggaucucuccccaacuuacgcuguaacagaaucauuugacuucgguacugagaaucaaccaaaagaugugaagaaagaccccuuaugagccugccacaauaauccaagugacaggugacaguagcuugggcccaagccauagugguggaggugaugaggcaugguuggaugcuggauguaagacuagacacugccauggcuaugcaguuuguucugccacucaguuguuuggcaugacacaaacucacaggaggaauuuuauauaaaagaucgauacaggugagauaagaucuccaauucuuaaacagcagagaaaaucaaauguuaauuggcaaauaaaaugccaagaagaugugcuugaaauaauuaaaauaggcaaaggauugaucaccuaaaaauagaagcagaaaacaaacccccccugacaguuuucaucucucacaguuaaauauuaagcuuuccucuuaagaguaacuuggccaggugugauggcucacaccuguaaucccagcacuuugggaggccgagguggguagaucaccugaggucaggaguucgagaccagccugaccaauauggugaaaccccaucucuacuaaagauacaaaaaauauuuuuuuuuguauuacaggguguggccuguaaucccagauacucaggaggcugagacaggagaaucacuugaaaccaggaggcggagacugcagugagucgagaucaugccacugcacuccagucugggcaacagagcaagacucugucugaaaaaaaaagaagaagaagaacuuuguauuuccuacuuugcucuacacaucuacacauagaagguauuuuaaauauuuaugguuuguugauuuuaaaagaggcuuuguuaaaacgaaaguauuaaacggguaaaaaauagaaccaagucugugugacaauacacuagauuucaaauucucuuuugcaaguauuuauugaacacuuucuacagacaagguacaaugccagauauuagggaucugaagagaaaaaucaguaaacaaaguuauuuagugcaaggacaacauaaacaauaaugaaaaaagaaagagauaaacuccagcugaaaacauaaagaccacauaggaccuguuuguuaaauauaagauucacagaauacagugcaaggccagggaauaaaugaaaaaccuacaacuuugaugacuuauuguaggaccaggcauauuacuuaacauccccgauccucuauuucuucaauuacaaaugaaauauaaaaguaucucuuaaaacaugucagcagggucaaauuauauaacuuagaagauaauagggauucaauauagcuuagcauucuucccuaauuuuuuuuaaucuaaccugcaauuacaauauaggcgacaacauuuucagagcugaaaugcgcuuccgucagcuacacagucuucaugaugaugucccauccacagggguuauaugugggcccguccuaguuugguguucucuuugugugccaaagaaaugauuaucccccaaaagcagcagccaucauuugagaccucucuaguucguugauuucaaacucuguuacuacugggauuuaaacuaaagcuuuaagauugaaaagaauaauaaauacagcaggcucucaaaagggaaacacuuaucuugugaaaaaacaagguuguuuuuuuuuuucuuaauucucaauguucauucuggaagauucaagguuaucuacuaccuguuuuucuuccucuccaaugcucaacucgaaaguuguucaaaagguucacuggcauacauaagccuggacccuauacaugcuuccuacgugaaauauguucuuacuuaggaaaaaugccaagcuccaguaacugugaccuacauaaauucuaaggugcaacguaaggagggcaagcaaggcauuacugaauuguauaugucacgccauacaagcugaugugcagcucccucaaagucucaaaggccucaauaauuguaaauaaacaauguccuugaguccaaaaagacuaugacaucccacaaucaaaguauuaacuuggaaagcauugccuacuuuguauuuucuagaaauguuucauguguucaucaacagcaugccagucccaauguaagacacaaacacagagacauucaguccauaugacauaagguugaaaucauccuaauugucgacaugagaaaaugagaaagcaauuuguggcaucuaaauacaugcauaauuuuuaucccgucugguuuuugcucugguucugugcaaccugaaauaaggagagugugcaacugcuuggugacagauugcacagggauggaggacuguaaauggaugaauaguuggaacaugguugaacucaggaaugaaugaaccagacucuccugaugaaauggcuccacucuggagauggagcccaggagagaugcugaauucacuuuuucacaccccagggaucaauuugguuaauaaccucucugcugccuuaaaaucacuugggaacaccugaacaaaauacaaauucaaagcaagaucuucgaagcuuagagaaacugaauugaaucaggaggugaaaaucuugaacauugacuauuucagcuacuauacaccuauguccauccaauuucaucaagaugcugaaaaaguacuuaggguaauaaguaugaaaaauguuacacuucuuggaaaaccagugcuuaaauguucaguaaaugauaccuuguuucugaauuucccuagcagcacugaauucuuaaucauucacuuauccauuuaaucauucaaaagaaauuuauaucuucacuuuuucuccugauugcaugguaauaccugcuuacuguaaaauauucaaaugagauaguaucacaucaaggagaaaguauaagucucuagaaauuccagaaaauguguauuuguuaaccacuacauucuaggcugugugcuagaggugccacagaguuggcaaaguaaaucugaaaacauuccuguccucaaaaagaccagagucuaguaagagagaugauaacaauaaaaguacuaaaauauaguacaagaaguaaugcaagucauaaaaaaggucugaauaaaugcuauaggagguccaagaaaaagaaacgucugcuaccuaagaauguccagggaaaacuuccuuugcaaaaagaaccuguuucugccauuuccuugaccauacaacuccacguguuguguuacuuaugaguccucugcucagugccgaaaagauuucccuauacuaagaucucagugcuucguuuaacuuguacaaaauucccaaauccacauucuuacaauuuccccaaagauucagcaauucugaauuccgguacaccuccuaacaggguaaacauaaagaaaucauuugaucauuaguuacuuaccauuaucauuguucacagaaauuggggaaauggaaaacuauaagacuggaaaaagauaaauguucccccaggcccucucaaaaaaauaaaaauuuuggacaaaauaaagaagcucuagguuaggaagaaggauaagaggcacacgaacacaggagcaugccacacacauuuaacacucaauacacaagagcuaaagagaaggcuguguagggucaaagugaguuugaaauacauaaaagcugaggcuauauaaaaaucugcauuuacgauaacucuucuaggcagggagguuguugaguacagacgaaaagaaccaggagaccaguggugacagaggauucugucuuugagaagcugggagaacuggaauaagacacuuaacccuuuggguuucaugauucucauuauuaaaauaaaauaaugauccuaggccuguaugaaauucaaaugagauaauauauuugaaagcauuuuacaaaacaguucauaauguauuuuauaaaacacauaggguuaaaguaguuggccaaaguucuaaugaaagauuaguugacucaggacauaaaucugaauuuuccaaaugaccaaucccaaauuguuaccucuacuaucccuuagaaguaaaaaaggauuuaaacaacucaacagguaaaaauaauacuuccuccacaauaaauaccauaucauauuccccuuuguuccuccagcaucuacacagugcuuugcacagagugaguacucaguacucuagaagcaaaacucaucuuucuccuacucuaccuuccuaucucuuagcaacuacuaauuuucugcugcauuuuuaguggacaucagcaucaguaaguugccaucccaaggaacaaagucaaauuggcaaaaagguggaugggcuagcauccaucuuugguuguuaucaaaauauucuccuuccucagcacacucaagugaaggccauaaguggacugucugggccgaaagucuccccauacuuccaccacucuuguaucauuaaacauucuucgcagccuuggucaggagaggacugcguggaugggcacuggacaugcaaaguggcccagguacauagcagucuugucaagcuuggagaguaguggcccacucuuggccccaggccacugccauuugccugucauuuguaagagcacagaccagaacaugagcccagucugcugugcaccucacagcaacauccugacaauucugaaacucaaaaaagguuucguuguuuauuggguauaagccaggcaggacugaaaaggaauucuuuaaagguuaguggugcaauacuggauaagagcuuuacacaucccagucuuccuuccuuggugucagaacgggauuaacaggaagacuggccaacagaugcccaggguaccaaucuaagaggguacuaaaauagccccagaaaacuaacacaaugaagaaaacagcauuuaucagaacuuucuucaagaagggaacuggguuucauuguaagaaauacuucgauaaaacaauugagguagaauagggaugauaugcuuugaaaaaacuaaaaacaaggccaauauaaugcuuucauguagggugguuccaacaaucaaagggcuuucauuuugcuaagcugaguauggaggccaggacacuguaaucuguugucaucuuccuccacaagcagcacuacucaaaucuguuacuucacuugauugcugaaggaauacugaauuagucugcaugggccacccacaugucuuaguugagcccuacaugagaucaccaguucucagaaaaggucuggcuguucuguuucaguuccccaguuuccauuucuugucucccuuaccuuauucauccauagacaauucaauuacaaauauuuacugaacaccugcuguauuucaagcccugggaaggaagagaugagcacaacauaaucuuggugccagauaaacacauguccuagacagacaacuaaguuaauauaaggcaaauggaugggagcucuaugagagaaacauacaaaugcaaacauggggaugccgauaaggagugagggaaugccuuauggaaaaugugacauuuacauagggccucuuaggauuaggaggagcugacaagugcaaaagaaggauagagaaacccaaggguguugaaugaagggcacagugacuugagcaaacuguaaagaguccacagugaccacagcacaggcaacaugguuaagagugcagaagaugaggcuacugauaaaugucagagccaaaauuugaaaagucuuugaagccauuccagaacguuaagaucuuacucuggaagcacaagggagcuaucgaugguuuuaagccagaaguaaaagaaaaaaaaaugugguagauuuguguucagugaaagaacucuggcagaaauugaaaacuaauggauagaaaugggguguagggaguagaagcagaaauugcaguggcccaggaugagaacagaauauagaaaacaggcauuucacaggcaaaaaucaaugguaguuggcgacuauagugcauagugaugaagaggaaagaguuccugucuccuaauucauucauauucauccuuuacaucucagaucaaaugccacuuucuaaaggaagacgucucaaaccccaagaauaaauuagguccuucuggacaugcucacaaagcacauuggacuuuuccuccacagcauugaccucaguuuauaaugcuauauuucuguaauaaauaaaauuaaucucuguaucugcuaccagauugugaaccucuugaggguacaaccaugucuguuuugugguuccuguauuccuaguaucuagcuuuuaguaggaacucaaaaacuauauuuuggaagcaauaagggaaggcacuuaaggaucacauaaagacuucuauacugcaaugccagguagcuggugaucccauuaacuaagacagaacauagaaaaagaggaaaaggggaaaauagggagaagaaaaugaauuccagaauaaacaagguaaauuggaaaaaucuucaagaauuccagauggagauuucaaauagcuugaaacucagcagucaauccagagauuauagauuuaggaaucaucuauguaguggaagagaggagagucacugcuuuacucggguuaaguauaugacuccagaagaaaagaggcucaaagauggagcccugaagaaagccagagguagaauccaagcaaacuaaauaauacagcaaaaauacugggaaagaaagucugagagccaggagaacaaccaugagaggguuguauuuuaagaggucaaggagccaggcacaguggcucaugccuguaauaaugccagcacuuugggaggccgagauagguggauuaacugaggucaggaguucaagaccagccuagcuaacacggugaaaccccaucucuacuaaaaguacaaaaauuuagccaggcgugguggcaggcaccuguaaucccagcuacucaggaggcugaggcaggagaauugcuuugaacucgggaggcggagguugcagugagcugagaucgcgccacugcacuccagccugggcgacagagugagacucugucucacacacacacauacacacacacacacacacacacacacacacaaagaggucaagggagguagagcucaagaaagagaaagugcuuaguggggcccaauauuaccaaggguaggggguuggcucauaagccucagaaaguggugggcacugggauucaggcagugucuauuucuaaagcaagagaucccaaacucccaaagaaaagcugaaaacagugaugaaaacagcaggugugcacagaaggaaacuaaaaaacaugcaagaaaauaauuauucauucaauaaguauuuguugagcuucuacuaugguccaagcauucuauauuggaaguauagcaguaaacaggauauaauggucugugggcccacaggauuuaagagcagauaggaucaagaucaaagaaaaagagucugacuucaaaaagcuaugagacaucucuucaaaggaaggagaaaugaucuggggcuaaagauuauaugggcagaguccuagaaguaucaagaagacagaaaauuuuaggguugucaugaguuggguugcccugaaggcaaaaccugagacaaggacuuaggugcaggaguuuaugugagagaugacuccaggaagcagagaugaggaaauaggguguaaaaagggaagagcaaaagccaacuaaggguacauuaucaaguuuaccacuugccaaaccagcaagaggcugguuuggccagaaccuccagagaaguacacagcuugccuccagaacuguucaccugaaucgcaaaggccggagcacuuauucacauguucaaaugcccaguggcugagaguagccucugagggcauuuauucccacagacguccaggcuccucuucagcccaggccaugcagacucccagcauaagagaugcccuuggggaagaaagcagaaaagcagaaaaguaggggcuagaggugggaagcugacuuggacaaaacuggucaccacaguuguugcugaaaucagagauaauuucacagagggacugugaaaauggccacaggggcaucugccacaaagguaguguuggugagaacuagguggaaauggcuaaucauucagcccaggcuaguuaaggagaaaaaaaaagaaugcuaagagaaaguggcuugggaaguuuucuaaggucuaagcuuucuuucaaugauuuuuggccucugcauaaaaauaugaacuuagggacuuacuaauagcucaaaguuaagaucauagagaaggcguuguacuccucuaggucaagggcauauuaaccacugauauuuauugagcacuuacuaugugccaggcacuuuauagucaucaucaaauaaaucaucccugcaacuguauauacucauuaguauuguuguucccauuuuauaaaggaaggaacugaggcuuagagaguuuuuaaagcuuuuaagaucuaugagguaacaaccuauuucauuuuaaguguaugucaauaacccacacuugcauccuuguguucgaacacacacacacacacauacacacacacacacauacacacaguaaaaucagauaugaggaauuucugguuuuacuagagaauuuaguuuauuuaucuucccugucuauuucuucauuacauggauaaugaagcacuucuagacucuuuaaugaauacauuuauuuaaauuuuaaaaaauuuauaccaauugaucaauguguuuucaucaaauacguggacuagaaauacagaaaauaaagauguuuagauauagaaaacugagcaaaaaccagcuacaaaauaccaccaaaagcacagagcuaguugaagucaaaaaaagcaucauaaagggaaaaacuaaaagcaucuaaauacagaacaaaaggcaaaucugauugaaaacuugucugcaucuuuaauuuggaggcucaugaucaugcuggagguaggaggcaaaauuuaauuuaaggagaauuuuggccaaccaucgcuauuuucuuuaacacaagaacaaggagggagagggaaugagguagacaacauccacggaggaccaggugaaggaaaagcagagagugaucauaucccauauccccagacacuuggauuagccucagggaggcugguuaggcaaugccaccaccaccaccgucaccacgcccccaccccccucacccgacccacccgccacucccagaauaaagcugguuuguaauuaguuuaggcuguagaggcuuguaucauuaaaauaaugaccacugggcauuugccacaaccaagauaauguuucauaaucaaauuaacuuggcucaaaaacuugauuuggaaccuguuuaugguuagucaucaaacagcuuucggggugcuugaagcauaagauaugcaaaaaacuagguaaguagugcaugaacacagaaucagaggaaaauguggcuauguuuuagucacagaguacuuacaauggggguuggagguaggaggacagugacuauacaagaaaaggauuugaaauugacccucaaagaacugaauaucuuuuuaaauaaaaugacaauauuaaaaccacaugcuuaaaauacguacggcuaagugcuucagcagagacugggauaccagauccugaguuccucaaaggcaggaguguccaagucauucacuuuugcuucaccggagccuaacacauugccuggagcaguguugguacucaggaaaaccuucugucgaaugaaggacuaucaugcuguuauaauaauuaggagaggacaacauagaaacauggaaaaccuuuuuaaucuacuggaaagugaaaaugauaugucaauggauugcaaccaugugcaaaaacagguguguuugaggacaacuagaagauaagguggcaaaaaugaaaacacuggugucagguguuaggauucugcauguauuguuguuguuucuaaaacugcauuuaauguugucagaauauaaucuuuguaauuucagaaucuagagaugcuuccauguuggagggagggaaggaacuggauacucaaugaacugauagcuuacaggcaaagguucaaacuccauugcuuagcacugcagacucuuuguggcacaguccccaagaacuccaguuuuauaucauaucccugcuccuuccuucuuccccaucacacugaauaguuugccuuuucuaaaacguaucauagguuucacucuuuuuuuuuuuuuuuuuuuuuuugguacacacucuucucacuauuuguaaugcccuuguuuccgucccuucuucauauggcuaaauccuacccauucuucaaaacacaacucaaauauuuccccucugagaagcugaccugauuccccacacccuaucccagucucaauuuuuggccacgucucuaaguuucuauagcaacuuaugcgcuuaccucuuucagagcccugucucacuaugcugcaaucacugguguacuugccuuucuccucuacuagccuggaugcuaccuacagauaauguaaagauaccuggggcuacaaaggccaguggaugacccacugucuuuuuuaccaaacugugacaguguggucacuuagucaagacucuuuugguugcaaguaacagacauccauugaaacugcuuugagcacaaaagggaaauuuauuuauaaggacauagagauacuucucagagcccaagguuagaaagugcagacacugaggucuggauccuggagcuagaaagccuacagaaucaaggcagcuacucucuuagucaaucagucuuacucucuccccauacccaccucucucccugcagccucacacagucuuuuaaucugcauaucuccagaggccuguuguauuccucucucuuucuuucucccucucucuugcuccgaaagacaguuauacaguggcuacaaguaugagcucauacuaccuguguucaugccuggcucugccauuaaccaacuauaugaccuuggauaaauuacuuaaccgcucugugacucaguuuccucuucuacaaaaugggaauaagaagaggucccaccucauaggaguauuacaaggauuauugaauuaaucuaagacauggcuucccacugcucccaaguuuacacaucuaccuagucuaucuacaaauaugucuuaguccaagaccacacuucugagaaagacaaccuggcugguccagcuugagucagcuguggaucuuugaucuacugagccacagccugggagccaaguuaaaaaccugaucaccagggcccauccuugaagauaaagugacaguucuuagagaaaggggccaugggcugagcagacaccagaaacaaaaaccugcuacagccacuaacuaaccaugcagccaugcuugugggccugccuaggauuacagcugggccuuuucaccucauggcccugagcaaggcucguauuuaaaacacacagcugccugucagacugcaaugacaccuaagggagcuccacacacuggcacuuaauaaaggcuuaauggugaugaugguggcgcugacaaaaaugacgguggcacaacaggccaugcuauugcuucccagcaguucucugcugggccccguggcuugaaguugaaaucagcacauccuucuaacucggcuaauguggcuuggcucuggggccaacccucaucagaucccauccaacugcuaguuagguagauuuauaccccacuaaauccauugucacacaagggcuuccuccucacugccagaguguaaagaacauagacacagcauccaauaaccaaaggaggaaaggccuccaaagaaaauuaaccauuugacuucaaaauguuaugcugcugcucuagaauuuccaaccaaaugaaaucagcugaagguccugcaucuuuaaauaauaaaaaaauaaagaagaaccacagcugugggcccuuacuagcccauaaauaaagccccguaugcaacucuauaucaaacuuuuuuuuuuuuuuuuugagacagagucucacucugucaccaaggcuggagugcaguggugcgaucucggcucacugcaaccuccgccuccuggguucacgccauucuccugccucagccuccugaguagcugggacuauaggcaugugccaccaugccuggcuaauuuuuuguauuuuuaguagagacgggauuucacuguguuagccaggauggucuccaucuccugaccucgugaucugcccgccucggccuccuaaagaucaaacuuauuuuuuauugcaguauaaucucuuuaacaaaaaacaagaauuguagaccaguacaucuuugcuaugaacugaaugucuguguccccucaaaauucauaugcagaaauccuaacccccaaugugauggaauuaggaagugggaccuuguuuuuagagaugggacaucaauuccaggaccaguaucaagaucucacaucauucucuuucacaaaaauagucugccuuugaauuuuuagcucucggugauaaguaaacuacacuuauuguaguuuuuugcuugccucaaauccuuuguagaaguaggcuggaaaauaaauaaauaaauagaauuuccucuaugaauuugaauagcagaguaugcauguaauagacgcuucaauaaauuuugcuguagcaugaagaccaaucucauuuucaaauggugaaucuuggcucauguauaugugguacuauaaucuuacaaguaggguuugcgguacacaucacuuuaaggaaugcugguacuuuaagugaauuugaauagcaagagcggucuaaaaucagucaccaucacugagcacagucauuugaaagccugaaauucacuuuuagaaaauucaucagaaaaaaagauucaaaaacuggcaacguucacucacagaucaaagacaaccuaaguauuuaacucaucaucaucuaugaggauaacgacuuuuaacagcuguccaugcaagagaaagcaaaaaaaaaaaaaaaauaagaaacaaugagaggcauuaaagcauaaaggucaagagcacuuugggggcagccagcccuaggucaagaaguccugacugugucauuuaccagcucuguagcuuugggcaaguugccuaaacacucugaacuuauucagucuuccauaaaacauuuaaauaauagugauaccuaucuuauuggauuucuauacuuaauaaacaaugaauaugaugaugacgaugaugucugcuuuuacuaugaggaaaaugcauucaguaacaaauauaaggaaaaaaauauagaauaaguaaggagacucuuuagcuauccuuauccacuaagaauaccuaagaguuuguaguaacuggcaaggguguauauauaaccagcacugaacauaucauccuuuuugcuauuagagaguaugcaaaagaggaaauauaaagaacggcuuugcuuugaucauaaucaaagggcguggguaaucuccuugagggcaggaacuaucuggguccuauuaaccuagcacagacaguaucaaguagcaagcauacagucaaagcaccaaaugaaugcaagaaugccuggauacacccugaauaugacuacaaucaaagcccgaagcucuugguagguuucacuggccucuuuccuuauaucuagaagaacguccuaccuuccuggucauagccaccacugaaauaaugaaaacaaaauaacaaaauaauauuuuaaacauacauagcauaccaguucauuaaaaauagacuagggaguauuuuacauugagacacuagggagcaucauuacuuugaaaugucacuuucugcuuuaauuaguaugcucuaaugauaaguauaugccauucuuaucuaaugaaagucuugaauacauacggaaucugguucacaguccucgcugggagguacacggauguacaaagaagaaacagaaugcauguguugaugucaacuaguuugcuuaccuuuauuaacauaauugccaaaguuucaaguuuuacaauuugaggauacauauguucaacacacccagaacacuuggcacagucaucugaucaccuuucacauuucucaagacagccuaagcuguuuuagggagaugugaaguuuccggugauuucuuucaagccgacucucggggguaucacucagaacaggaccaccugcuugguggcaucuuuuuaauaaagacagcaauaggucugcuugcucacagggaaauuuauaaggcugucuuugcuuccuuccaccuauuguggugcuuuauccaaguagaauguacucagucuucggagcuucaaagacacugauaauggacuucuuuucaaagagaagucuuagucauccgcuccuuucauucaacagucagaauaagaaaggcccagagggauacagacaaauaccucugagcugccuguuguggcaauaucagauaaagaaauucuguagcccagagagauauuugauccguucauuugaaagucaauacuaaacauccuucccagccacuccacccaagcaaugagaaugugucucagaaacaggacacagaaacuaucucuuacgauguagcuuccacuucuuuuuucuagccugaguggguuggguugaggaaggagagaaagaaagaaaucaagaaccaauguucucugcuuuguguuucccugauucagugaaaaacggaggucauuuauagcuucuucaauuggcugacccagaggaggcuccagcuuucucaggauuguaauggcaaugacauuucucaaaaucaguuaccaaguucguaccaguucccagcaauagaauacuugguuacucagggcuucuuucuuugggaaaucugcaucaccgggaugacugcaguucacccaggcccuacaauggguucucauuuacuacucaaguuucaugcagaucaucucauucacacaagccuacaggaccaaucugccucccagagccauggcucugcaccuucacaauugcaaagcaauuucucagggggagucaaagcuucacuugcuuuuuacagaaauggcucauggagauauuaucuuaaaaugcuuucucuuaaaaaaaauuuuuuuuuuaucugagaauugcaugcugugcugaaauaggauggugguggguucugauuauaucuuuuuuccaauuuugguuucacucuuaaguauagaaaauaucagguugcucucuccucugauucccuuuucucccagggacuaaaacuuuagucugcugagucaaaaguaagcuuugguauuaaauuccaucuuuuaucuuuuuucucccaauaucuaagaacaaugugauuaugcaucauuuuguacuacagaagugcugcugagaacugcaugcaaaauaaaucaagucaaugauguauuugaaugugacucuaaucacugaggugggaaaaagauaccaggguucuacuuuagacugcuaaccugcugugaucaccuuaccuccucuuuuaaaugagugggcuggaagugcuccagcucaugucuaaaauuuagugugcuucgcuaccucauggcauaacaauaggauggaaaaccaugcaaccauuaaaagugaucauuacaaaaaugacauagaaaaagaaaaaauaauuguuauaauauuuaauaaaaaauuauuccacaaauuaucuguacauuaacauuuuucauuaggaccucuuaagccaugccauuaucaaaaggggcaauucaaacauaucaagaguaucuguuaauauuuaaaauuaggcuguuagccuguaaugaacauauuuuaggggaaaagcuagaagucugacacauagaaagaaagaaagggaaaauauuaaccuacaaaauccuuuaaaaagguagacuuaaagcuuuuuuucacuaucuuagugaagaucguuaauauguaccuuacaguguauuuuaaaauuguguuucuuuaccagggaauuuuuuuuuaucuuuaguaaauuucagauuuguuucuuaccugcauggaauguuacccuucccuuaccacaauaugacaaaauuaauaauagccuuacaaauugugaagauacaaguuugagggaaaagauaccaacugcuuuuuaaauuacaauaauacaugauaucaccauuucauuuuauuuaaaagaaauguuuuacaacagaaaucauccaaccaauuaacagggaaaaauaagauggugacauaauccuuaggaaggauuacugggaaagaaaaaaacagucaugaguacaacuugguauaaguuucuaauguuuauguauaguguauguuuauauguauguauaauacauuauaauauacauagcauauaauauuuagagugcaugcauauuauguguuuuguguuacgugauuguuuuugagagauaguugcuuacacuauuggaaaaccacuggucauuuggcauuucuaaacaguuauggugcugcagaggaaagcuuuugaccagccuuugacuagccuuggucuugucguuauuuagcauucagaugugucaagaaaauuaauaccuaaaaaaaauuuucuggcugggcacaguggcucacgccuguaaucccaacgcucugggaggccgaggcggguggaucaccugaggucaggaguucaagaccagccucaccaauaaggugaaaccccaucucuacuaaaaauacaaaaauuagccgggcaugguggcaggcgccuguagucccaacuacucgggagacugagacaggagaauugcuugaacccaggaggcagagguugcagugugcugagauugugccacuacacuccagauugggugacagagcaagacucugucuaaaacaaacaaacaaacaaacaaaacugcagaucuguuuuuggaguuuuaaagugaaaaauugcauucuuuugucucuaguaguguaauauugacaguccaggcaauuauugucaugcuaacauaauaaaugaauuaccuuuacuauucuauugccaaugugcuuuuuuauagcuuuauuuagauacauuuacaaaccauaaaauucacccauuuaaacuguacgauucauucauuuuuaguauauucagaguugugcaaccaagaacacaaucaauuuuauaacauuuccucaucccaaaaagaaagcccaugugcauuagcagucacuccaauuuccccgcuaccccugcagcccuauuaauccacuaaucuacuaugcauauggauuugucucuguuggaaaugucacauaaauggaaucauacaguauguguccuuuugcgacuagcuucuuucacuuaacauaauguuuucaagguucauucacauuguagcauguuucagcacuucauuacuaauuauggccaaguaacauuccauuauaggaauaugccauuuuuguuuauccauucauuguagauagauauuugaacuguuuccacuuuuuggcaauuaugaauaaugcuacuaugaacauucauguacaaguuuuuguguggauauguuuuuaauucucuuggguacauaccuaggaagguauagaauugcuggguuauaugguaacucuauauuuaacauuuugaagaacugucaaacuuuuuccccaagugguugcaccauccuacaaucccaccaaaacauaugaggguuuuaauuucuccuuauccucaccaacgcuuguuauugucuuuucuauuuuagccauucuagugugcaugaagugguaucucacugugguuuugguuugaucuaauuugacuucccuaguaaugagugauacuaagcaucucuucgugugcuauuaaccauuuguauaucuucuuugggaaaaugccuauucagauacuuugcacauuuuuaaauuguguuauuuguuguuuuacaguugaguugcagaaguucuuaauauagucuagauacuaguccaucaacagaugcaaaauuuucucccaucuuuggguauaucuuuuuacuuuugugauggugucauuugacacacaaaaguuuuaaguuuuaacaaagucuaaauuaucuauuuuuuaaauuuugucaccugugcuuuugguauuguaucuaagaaaccuaacucaagaugacaaagauuaauucauaugguuuugccaagggauuuuauacuguuaccuuuuaaauuuaggucuaugauccauauugagcuaauuguuguguauggugugagguacaaguccuaauucauucuuugcauguagacauccccaguuguccuaacaacauuuauugaaaagacuaauauuucuccuauugaauugucuugguucuuuaguuaaaaaucaauugaccauaaaugcgaggguuuaugucuauucuauugaucuaccuuuuuuguuaguaccacacagccuuaauugcuauagcuuuguaguaaguuuugaaacuaguaagugugagucuucaaacuucuuucuucuuuuucaagauuguuuuggcuauucuggauauuugcaguuccacaugcaauuuaggaucagcuugucacuuucuggggaaaaaaauaaaaaaacagcugggauuuuuaaagggauuccauuaaauacauagaucauuuuggccaguauugcaaucuuaaaaauguuaaguuuucugauccaauaacauggcauaucuuuccauuuauuuauucuuuaauaucuuucaacuacuuucuaguuuucacaucuuauacuucuguuaaguuuauucuuagauauuuuauuuuuuggcugcuauuauaaauaagauuauuuucuuaaucucuuuuccagacuguucauugcuaguauauagaaauaagauuuauuuuuguauauugaucuuguaucuugccacauugcugaacucguuuaguaguuccaauaguuuuuuagugaauuugccagugcacuuuuaacuuaaacuuuuaaauuauuuuguccccaucauacuuauaaacaucaguguaugcuacuacuguaccacaauuauccacaauauugagcaauuaaauccugucugcccuaagcucucauucagucccuucaauuaacccuucaggcugaugaucacucuccacaggaaaggagaaagcacgacauaaaacaaauuacuucuuucuuaauccuuucuauuucuagugguuaguaaaaccauacagaguaguaaaaugaaacauaugcugagcuacugaaacucuucugccuagcauuaccuugcuaaaaugaaaucaagcaaaauggaaccaaaaguggauuuugacauuucauauuuugcugaauacuguuagggcucuggcaaucacugucucuuacauacaaauuaacagccuaccaucugucaaguguugggauaaucacaggguuuagugcacaauaugguuauuagaauaugaccugacaaaaaggaaaagaacacaaccuaauuuggacuauaaaaucuaugaucucacuugcaaacgacaguuugacaagcuauuauucugcauuuuggcuucuacaguaaaagcaguuuuaugcauacguaauucuguuauacaggcaacagcccauagaagauugcuuuaaacuacagaaucugcuuggucauacaauauuuuuuaacuaauucuuagacaaauauuugcaccaugaauaaguaggaauguaaugaucugagccuucacauuuccaagugaagcaccaaucauuaggcaaaaaaugucuuugugauauugcugccagcaguuccauagaauuccucaggguauaugcaaagaaacuacuguaggaacuuauuaaaacuauucacauggacauacaucaaagucaaaaaguugacaguuuugaaaaguguaauauaugaaacacuuugguguggaauuuacuucauccccaacagugacaucugcuaaugagcaucauuaauauugcccacuuuuauuuauccaaaugccucaugggugauaucuuuauguacauuccucuguagcaccuuuuguuuccacccaguggaaauaaaucccauacugacagcugccucuaauaaagaugcuuccaacaaaacucuucugguuacagagagaacacagaguaccaaguucuuuuuguuguuguuuucuaccucucaaaacagugcagaaaugaguauuguuccugaagguuauuuaaggguacacccagugugucuaaaauacaugccuaagacagaaauguauuaauuaagucucaaggcaaaacguucuguugaggcgacaaaacaaaacagauuuuuaauauuagcaguuauauuaccuagggagcuuaggcgagauaauaacuauauaauacauuaggcaacucacacugcaaauuauguugcuuuguuuuagacuacacguuuuuccauuauuuucauacuuguuuccuuugacgguagaaaaaaaugauguauuuuucugucauguuggcucacuauaaggugagucagagugccaagguucuucugcaaggaaucuugggauccaauuuuaauaugcugcaauaugaauuuuaagaacagugugugaugaauugucaggcugcaugauauccccaaauuucccaguauugagaccuucauggcuauuccccgaagauaacaaaaaaaauucgaucaagauuuauagaagacuuauaaauguaugaaaauauaaaaaaauaauaguuacauccauggguuuaaaaugauuccccuacaguggcaacccuguaugaaaauacaauaugagaucagggagcagaaaaauaaaugaaguaaagauuuagggagaaucauggcaacuuauucauuuacaggaaagccaguuccuuuuucacccuuggaaaaaacuacaaacaaauuccaaguucuuucuagcuacaauugacauuaucauuuggccaguauauucaugauaaauguucuaaugugaaggcgauccaucauaaauguaauuucaaaaaugaacuucuuauuuuaacuucagaaagaauuauucuaggauucaaaaguccaguuaaauacauauagaaagaaggauagaagggagaaaaguuuaaaaaaaaaaacaaaaaacuaugcccagacaaaagacuggaagaaaguuauuuaugugaugagacuaucgaugauuuauuuucuuuuaauuuuuauuaauguucgaaacaaacacacaucaucuuuuaaugaaaaagaaauucuauaugaauuauuuucucucuaugguauauuuagagggauaacuuauauauaguaaaauacacaaaucuuaaguauauggcuccauggcauuucauauguauaaacccaagaaucuuccaccuaaaacaaaguaugcaguuauuuccagaaaauuaccuccugauccuuucuagcaauagucuccuagcucccuauuuuucuggcuucuaguaucauugauuccuuuugucagcuauugaauuuuacacaaauggaagcauacaguaugcauucuuuuguuuguggcuucuuuuggcaacauaaugcuuucaagaugcauccauauuguauauauuuguuguuuguuccuuuuuguuggugaguaccaccucauuguaugacuaugucacaauuuguuuacaaugaugucuaaggauagacauuuggauuuucucaagugcuuggcuauuauaaauaaaacuuccaugaacauucuuguauaugucuuuuucaugagcauaugcaauaauuucucuugaauuaauacaagggaaaauauacgacauacaguuuuuaacuuuaaggcaaggucuaauauuuccuuuuaugguuauuuuauuuuaacaguauauuuaaaaauucauaacuuauugguuucaaucuaaggaaaauguaaugaacaaaauucagagcauaaauuuguaaaaucucauacuccuagaugaagaguucaaaagaagagaaagaaguuauaugccccaguggggacugcuucuucuggaucuucaugccacaauggaaagauucucaaaggcauaaaguuuuccauagaaacacucucaaucuguuaguuuuaacaauuaaaacuuacguuuaacugaaaguauaguagagaaagaaaacuaauugaugaaacuaaaaguaaaccucucaaauaauuaagaggcaaauauuucagggcugaaaggucaucaccagucacagaaaacauucagagaagugagaaaccauugaaauuggaccaguggauggcagaguaauagaugguauuuccaugacaucuaccccaugccaggggaaaagaagagaaggguuuacuuuggguacaaugacaaggacaaccuucugauauguugcuaaggaucaugccuagggugacuauaaauaauuuauuauccaaaaugagacacuucugagacugaagcaggguaauaaaauuaaauaaaaguaauaaauaaaaauuaauaaguuuaauaaauaaaaauuguuuuauuuauauuauuaaaaauaauuuaauuuuuuaaauauccaccuguugacugaaaaauugguuuuauuuuacugguugacaguugaaauacaguccuauucuaaaaugauuucccaaaguaaaauuauuuuuauuuuuaaaaaaugcuuaacugggccaggugccaugacucacaccuguaaucccaucauuuugggaggcacagaugggaggauggcuugagcccaggaguuugagaccagccucagcaacauagugagauccagucucuacaaaaaauacaaaaauauuagccauaugugguggugcgcaccuguagccucagcuacucgggaggcugaugggggaggauugcuugagcccaggaguuagaggcugcaaugggccaugauugugccacugcacugcagccugagacccuaucucaaaaaaauguauauauaaaaaaaugcuaaacuggacaagaugcagagaaaacugguaaaaacuagggcuauccugagcaaacucagaugcauggguacacuagucaagugucaccuccaacccucuccaguuaauuuaccaagguaccuauaaauggagccuaaggcacugccccuguccuuuucuucauucaacaaguaauuguugaaaaucuuccauauguuuggcacugucccaggcagagagauauaaugauaaaugaguccaacuuuccuuggacucauggaaccuucaaacugucagagaagacagccaaagaacaaguuacuaaaagugugcuaaaugugaaggaagauacagagcccacugagaggcuuuuacaugguagugaucaaugggguuuguauuguccccuagagagauuuuuuuuuggaaaugugaggagcgguggggagcucucuauguuccuucuuuuuuaagagauggagucucccuauauugcccaggcuggucuggucuccaccuccucuugagcucaagugauccucccaccucagccucccaaagugcuaggauuacaggugugagccaccaugcccagccauuuaacucauauuuucugaggggcaacaaggccaccaaauguucuuauguaggacaggcccacaugaugaaaaaugauccuguaucccucauaacuuucaaauguuccaccagacauucacuuagguaaagaaaaaaaauauuauugucuauuuuacauaauagcuuaaaguaucuuuugcacauuuuaauuuucacugaauuuuucagaaaugcaacuagcauuuaaacugaaggaauaauguauuuuguuuuguucaacacuuuaccaguuguucacuauuucagaaaaucccaccaccgacagcaauggggcuuuugguacccagucuaccaauauaacacaacuguauuaguuugcauucuuaucugucaaaugcaaauacguaagagagaaauaggccuagcaccaaauauuauuaaauuggccaugggacaugaaagucaaggauaccaccaaauugcauucauggaaagcauuuuuuuuauauuucauuuuacugccacaguacauaccuuuaaaaaaaaucuguagcacaaugaugagaaaucuacacugugaaaauuacugauuaaaauuauuuacuuacuuuggauuugcuucuuguuucucagucuuacagugaaacugucccuagaggucucccacacaacuucuuuauggcuucuuauauuacugcuucuuuuuccaauccauucccuauucccuguggccuaccgaagugcuuuuuaagaacuagagaccaaauguaugcaucaacauaagacaugauuucaagaugagagguauucuuccugugauucuucaacaccacucagucccuuuucauaauauagggaaugacucugcagcuacccuuuuaaguaagucccacucauuuccaggaauggcauacuugccuauguucucuaccucaaaacugcauuauuuaucuuagcauguuagcucuacuucaacuaagguuauuucccucuuuuucucaucauguauauuacuauuaauauguauccaaagguuagcuuuuauucuaguaucccucaaaccucucaucuuucauuucuuguacucauuucacagaauggcuugugauauucuuuucuuuucuuuuuuuuuuuuuuuugagauggagucucacucugccacccaggcuggagugcagugacgugaucuuggcucauugcaaccucucccuccuggguucaagugauucuccugcuuuagccauagcugggauuacaggcacaugcggccaagcuuggcugauuuuuguauuuucaguagagacggguuuucaccauguuggccaggcuggucucgagcuccugagcucaacugugaggagaaaauaaaacccgcccaccuaggccucccaaaguacugggauuauaggcauaaaccaccacucucggccugauauucuuuucuuaaauccaauuucacucauaucaaguagauauaagcauuugauuaauucauuaugucuucaaguagaguugugcccaagccuuuacauuggaauacuuagcuuauuguaagccacuucccuuuucuuucuucuuuauauuguaguuaaccaucauaccauuuuuuuaaguauauggguggguagguaauuucuauaaaguucaaaagagggcaguuaaucugauaggauuaaacaguugacuggaaucuaauuuggggcagagacucuuuaggcugaaacuuaacgaauggguaagaguuagcuaagugaagggaaaguagaucagggagauagaaaaagaggccaaacccuugaaggcagaagaauccucagagauaacagagcagagagcuucagcuagagaacugguugccaaaaagugguaagugaaccccuggaagcacacagcugaacuuuugcugauaaaaaggcuaacuuuuuaauuuuaauagauucaaguguuuugaaauacauauuagaagaacaguaguuuccauuuaagguggcaaaacaauuuccuuguacaauuaacuuaaauauuagcaaaaauaagcuuuuuuuaauaguaaguguugguacaaauaggacaugaauaugguaaauacauggcuucugaaugacugaaguuggggugcucugaccuauuagcauggagguuggagaaagagguagagcuagagaugagaugagaaagcaagggcuuggucaggcaaaguccuacaaaccacuguaauuauucaggucuuugucuuaaaagcaaugaaaagccacgaaaggacuucaaacagaggaaugagaagaucauagcuguguuuuauaagaucaguauggcaucuaaugagaaauggauuggagguaggaaagauggcuguggguagacgaguuagccaacuuuuccaaauguuuaauucaaagacaaugguggggcugggugcgguggcucacaccuguaaucccagcacuuugggaggcugagaugggaggaucacaagaucaggagaucgagaccauccuggcuaacacggugaaaucccaucucuacuaaaaauacaaaaaaucagccgggcguggugacacgcaccuguagucucaacuacucaggaggcugaggcaggugaauugcuugaaccugggaggcggaggcugcagugagccaagaucacgcuacuguacuccagccugggugccagagcaagacuccaucucaaaaaaaaaaaaaaaaaaagacaauagugguccaaguucaagugauagcagcagagaugaagaaaggaagaggaaauugagagauaacaucuccugaaauccaaguugccauaaauugaaaaauaguuggcuuaaugauagcuuggcugauaacaugaagaaauagaugcuaagugagcauaucaauuguaagauauugcuucagaaacauuaaaauauggaaaauccaugcuucuuuaaauagaggaaauacaauuuuuaaaggguagaaaagaguguguagacacuaaacaaaugacugaugauagugaacccccaguuggaaaaagucaaaauugccagauuucuuuggccucaaacugcuaaacaucuaaugucuugggcuuuauucacuuuuugucuuugagugacaugacagaucauuuuggugauauagauggagcucaaauugacaagguuacuggagaaaguaaaaucaaaaauccuuucucagguaaagauauaccugaguaaggaaugcugaccuucuaauaucagaggccuaaaacuuguaaguggaaguuugcuuacagaagacaauguucacagcauucugaaagucauggccagguuguugcuguuauuaugaaaauggugauuuauagccaauguccauagccuaggccucgagguauguuuacaauuuacaguaagaggggcccagccuuaaauuauuguuagcaagucuugauauuauuuuguaaaaaaugaaauauguaaacacauacauaucaccuuuuaauuuuauuucuuaggggacaagggaaaaaacacaguuugcaacuauguauaucuccucacaucaaaguuuaacuccucaagaugaauacauucugugccucugcucccaacuugaagaaauuucaacugcucuauucuuuccacaacugcccauugucuuaaaaaaccccaaaucgcuggcauuuuaaaaauuaaauacaguauauuuucuagaaagaaaaaauaauuaccaggcucgcacguggcagauuccucuagccaugcaagccuggauauucaugaaagccauuucucacuuggcucagggaaaccucccagaaugauaggaccauuuacacuaaaugaaccgaacauauuacuggaguaacaauugacauuaaguauauuacagcugccaggggcaguaucaggaagaaucccuggaugacagaaaacaugauaauguagaaggaagaaccugcagaaucagaaaggggggaaaaaccccucauaaaacaauuuuaaaaauauauaaagaggaaaucauauuuaaaggaaaaacagagaaauuuuguuauuuuuuuuccuucugccugcaguagccuucugguauuagaccugcaaugcauuugcuacccccuaaaauauucucaacacuaacaagaucagaggaaaugauuuauuccacccccucuccugcuacuucugaacggcagcgcguguccuuggggacaugggauuucugcauugcuuucggccaucugauauugcagcucugcagccuucccuggaaugagccagaaaaaucaaaauaauuacauuaaugcugggaaucaaaguuuauugacucucccuugagguggaaaaccaaaaugcugguuacaaaaguugccagcuuauuuaaugauaccacugccuccucccuguucuugucaaaacagcuuuugaaagcauuuucaaauaaagcccucagaugcgcuccaauucaauagcuuaucuauucccuuuuaaauaaaagcuaguucacaucaucucacccccucaaagggaggacccgacaggcccucuuccccugccaaggcacugccaaaggcaauacucccaggcaauaucccugccaucauuuccgcucucuucaggaagguucugccucauugaauauucuuccaagccaguaagagaaucucaugccuccccaaggcagcaaucuacauuuauuauaacauucauggcugcuaaugaaacuuggagcagcugguuucuuucacuuuccaacaauucuuuggauauucaaaguccccucauaagagaggggaacuuaugagcacacccauuucauggaugagcccgcagacacagagauucaauguggugcugaccuuuguaacuuucacaggacuuugcuacagcccuaaaaaaacagaugcuaaauaauaauugauugaauuaaacugaaggagguagauuaauuuuuuuaauuaaacugaaucaaauagaacagaaauaaacaaacucuagcccucuccaugccuagucaacaccuacuauucuuucuuguuucuuuuuuuuccuuuuuauuauaaaaguuuucaaauaaaaugagagaccaguauaaugaagcuccaaguaccuauccacccagguugaacaaugaucaagauuuucccacauuugcuucauucaucuucuccuuuuuuucuucuucguugaaauauuuuaaagcaagacuaagacagcaugcuacuucauuccuacuuuugucagugauuaugcugugcagaaaagaguuaccauagaaggccugagguugcuauuuuuagaauuuaaaaaaguuugcagguagguagguaauaucuacagacuucacuuuaugaugauaaaagagacauaagagaaauagaccugcuugcaaaguugacucuuggcuggcaucugggaacauggauuugggaagguugccaucauucccagaacugauaagaguggcucacugugcccgaacuguuuguucaaauaaugaaaugcuaaaugccugcuuuccuucugggagucuaaaauguugguaugugcuagccagagaguaucuacgugaccagcccccaauaacagccuugggugcugaugcccuaacaagcuucucuguuggacaacauuucacauguguugucacaacucauugcugaaggaauuaggcauguccuaugugacuccacucaaagaggucucucagaaccuugcaucaaguuuccucugaaguucaccccauacgcuuuuucccuuugcugauuuugcuuuuuauccugcuguaauaaaucauggcugcaaguacaacuauauguugaguccugugaguauuccuagcaaaucauugaaccugguaauggucuuggaaccccuaacucauauaccuaccauuuuuuaagucuacuuaaaccucacuuuuucacagaaacauuggugaccuuggggagaugccaaacuaagggaggccccgguuauccauucucacagcacccugaacuuccucuucauaacauuuaucgaaacggucccuaaauaauguugaaaucauuuguuuguggucuaucucuccaccaagaacccaaagucccugagacaggaauuuugucuguuugguuugccauguauaccuagcaugguacacaugguauacauuuaaaauuuuaaauagauucaagaaaauaccauaccccuccuccaaguuuaagagguaaaguuuauauaauuucccuugcauuacacucauucauucaccaaauaccacucacuuaugguauaaucuauacugugucccaguucaguuuaauauccacuucauuaacaucuuucuguaauuagcaacaucaugccaaugcuucaccuuuuaggugagacaaagcaugacucugcaagggggcuuuccucuugacacuggugacuaauucaucuauuugcaucacauuauaggacccucuuuccaccuuacaauccucuagagauucuccugcaaauacagacucuugagaugauucuuacaugccuacuaaaguuuggaaaaccacuguuuugggucacucaaaaaaugaaaaggcagcuauaauuaaagaaaaccucauggauaugauucuucaccugaauuuuuaaaaagauaaauaaaccacagacuaaacauaaauuuugcuaagcauauucaacuacugaaaauaccauacgacaacagagagaauaaacauauauuccuuuaaagaaaagaagugaguuguccauauguuguaagggauacaucuauauauauauacagauugucuugcacauuuaaugugugcgcagaaaugggucaaguagauuauuuuuuucaugguggaugaaaguaagaugugaugagacacacuugaauggggauuggcaagauuuuuaaagauuauaagcuuugcguuuucauauaaucuaccauccugcaaauucacuucugaguauauauuaauacccaagagaaacuugagcacauaugucaaacuccaucagugaaaggccaccaggaacacccugguagucaaaguuaagugguucaccuuacuguagcaaaggagaaaguaccccagaggaaccuugggagcaucuuaguaaaggggaauuaucaguggcuuccucuaggguuuggggaauugaaacaaacugaaguuugcccagaagcagcagucacucugagaaagacagugauagucagaagaaagggguguuuagucauuuguagggucacagaauggcuuuguuuaugccuuguucugaguauuguuuauguucuaguugccaguagagccauguuuuacuuucucacauauguaccaggaaauguguauaagaacauucauagcagcaccauucauagaagaaaauuuaaaaauuuaacuaaauggcuauugauaggaguacauauaaaacuuaaaaaggacagggaaugaugaacaugagguuaguaguugguuaccucuuacgaagagguagagaugggauaaaagggggcacaaauuuguaaguuauugguaauauuuacuuguuggguuuaugccuguuauauuaugaaauaaauauuauaaaauaaaacagaauuuaccauggaugacagugagucaugaaccaaacuuauaauuaaucuaccucugugaccugagguccacauuauuuuaaaacaaacaaaaaauaacaauaaucauucauauuuacguuuccuucucagccauacauuuucuuuucuacuuagcauuuuccacugugacacaguaggugccaguuguguuuauacagaagcuacaauaaacaagacuuuuuauuaaaugcaaaugucaccacgcaguagaaucaacuauugacuuugugcaaccucucaucaacagaaccaucaauacgucuagcaaggcacaggauuuauugucuaugcacaccuuucagagggcuuccugaaacacaacuagcuuccauaauugguaaccaaauaaaaccgcaggccaccagaagcagaauauaacucucucuaggaagcuguaaauuaaagggagauuugucuaacuaaauguacagugcugcacucacaugggcauuucaucucuugcucuuuaauggaggcaguccuuguaccccuacuucacauuacgaauaugguuucaucucugacagaaaggccagagcaccuggcagaguccucacaugcucccuccuuuuaccuuuuccauugcauuaauuaauuagaacugucuuuauauucagugacauuugauuuugaggacauuuuuacaaaauaacaacaccagguccaaguucacuacagcaauaggaucuacaagaacccaaagaaugaaugcuuuuuagcaaaugagaacacaaagucacaugaucuuuauuuuuaaaaagcucauaaacuaugucaggcaggggaaucacauugccagacaccauaaaacaacauauaauuaaacucuagcaguccauuagaagaccuagugacaagcccuucuccacugcugcaacaaaggugggaugauuuacauguagacugggaaaagucccaugauauuagaccaaaauccagcacugcugcuaauuuuuuuagacugaaaugugauugcccaauauuaaauuguuaccauuaguggggaaaaaauagcuuauucuaacaaauacuuaauuucucucuagcuuuggugcaguccugacuuguaguuuauucuaauaaauaauuuaaaaauaauuuuggucaccucccauaugauccaaaguaaugcuauuugagaucaauaggacuaacauuuucuaucugguauccauggaguuuuuuauccaaugagagagaacauucaggaacuuagccugucucauggcugaaaauagguagaauauguuaggugugcguuugauacaaucuguaaauaaaaggcaaauuauaaaaguuccccucccugcagagacgaagucccacaauagggugcacaagcugcauuucaacccccacccacaccucagauaugcaucuucauucagugcacagaagacucaacuguaggggcggccuggauacacaugccauguuucuuccuugcccacuuggugucuucacauccccuuccccuuaaaauaaucccauuaguugaaaaguuccuggauacaaggagcagccaucaaaguccauggauggauuucaaggggaugaauucauuuaacauuauuaaauguuuacuuugcuaauucucaauacuuguacacaauauaagacaugauuucuucugucuauaauaugaagucugugauuagaguaauauuucaauuuuugguuuguuuguuuugacuuggaauuagcaguaggauaccaacuuaagucaaauuuacuaguucucauuuucccuaauucagcauuuguuuucaucuauagaauuccuuuucuuaagucaggcucuuuggggucaucagcccccugaaaucaugugcaaaaugggaugccuaugugcacaugccucuuucugugaggaucgguaccugagaacuuugaugccaaguuaaaaagacugugccuugaguuuuugacacuagggaaugaaggaaaguaugagauaaagaauauacaacaucugccacaacuacugcauauuuucuuucuauaucacauucaacaguuuauuacaaucaccaggcuuuucauucccauaaagcaauguucagacuucaaaugugcuaauaauuuagcuggagaauuugagaaaacuacacauuccucuccaacacccccacccccaccuccuuagccccaagaaucagauuucaucacucuggaagagaacucagauaucugcacuuuuuacaagugccucaugugauucugaggcaauggugagagacccaagcuuugaaaaacgugccaugaucuaccaucaaguaggaaucauguacauaaguucuuccauuagaggaaaaaauaaauguauuuguuucuuuguaaagauaggacguuggaaauuuucacuuagauuacucuguaagcgacaaggaaauuagaaagcucguuuuuuacaauaaucacuguuacuugacaguuccugcagcauguuaagauggcuguuauugaugacacuuauuaccuuuucccaugcaauaaaacacaggaacauacaguggaagagauaaguauauuuuaaaacaacagaaggaagaaaaauaaugguagucauguccucucauuauuuguguagacugacuaccauggggaacagugaaaugccuuuuuuaaaguuacacuguggcuuuaaauuggguuaacucagugaggauagccaugaaacaaguggcuauagagauguaaagaaugggcuauuucucuacauuucucuuuugccuuuuauuuucccuauggucuuuaaugcauuucucuuuggaauggaugaaguuauaaaguugccuuacauaaaagcuuugcuugaaagauugguaaucacgcacuuugcuacugaauuguccagucuauucaaucuaaaaaaggcucuucucuuuuguucagcucagauuaucuccuuugcagaguguaauagaaauaucuggguauaaaauugagaaauuguucauaaauauuauggaaggcuuuuugagcuguuuacuauuagaggccugauuuagcaaacaguaagccugcuuuugcuggguugggauuuuuuauuuuuuaacuuuuuccuuuuaacugaaucauccacaguuaaaaaaaaaaaaaaaagauacagauuucacagcacuuucacccaugauuagagcagaagaaaacaaauugcuuuuuuuuuuuuuagauggagguuugcuuugucgcccaggcuggagugcaguggcgcaaucucggcucacugcaaccuccaccuccagauccaagugauucucuugccucagccucccagguagcugggacuacaggugcaugccaccacgcccggcucauuuuuuguauuuuuaguagagacggggguuucaccauguuagccaggauggucucgaucuccugauuucgugauccgcccaccuuggccucccaaagugcugggauuacaggcaugagccacugcacccagccacaaauugcuauuuuuaagagacaguuuuaauaucuuguacuacauuuggagaagaaaaaaacaucagcacugcuaucgccuauaggcaacuuucuuaucuugccauuucuuuauuuaaagucuuugcacugaaccagccaaugaaaugcauuauucuacuggccagcguucucuagcagaaacaagagacagcaugcauuacugagaagucagacacauuugcacuaaaucaaaaaauaaaaauaaaaagacucucuagcuagagguuaauaacacaacucaaucaaaaccagugacauuuuuuaucaaacagucgugaaauugccauuuggaacucuaacuugcuacaaauagaauuaaaagugccauucuaauucugucuccuuguacaauacgacccugauauggaaaacaaggugucuacacugaacacauccaguuuacaagagaaaaaacgggaugauuuuuugauucucucaaauauuagguaaguguuuaacacaugacuccugagugggagugccaguuaaagaguuguaguaccugucaacgcugguuuaacauuucaacaaagcaaaucaucaauuaaaacucaucagcaacagucauccuguuaauugaccaaaugauuauccuucuuuuaguuaagacucuaccugacacacuugaagaaauuuuuuucucuguuguaaacccucuggagucuguggcacaccucaccuuggcaaaccacuuugguuuucagauucacuggaaagccccucuuuguucuaagaggggcuccugaaugaaagccaaguucuagucugacuuucugauugcuucuucucagguuuuuuucuugcuuccuaccaggagaaggaaaaagguagucauaggccaucuguuaaacuuguguuuaaagggaaguaccaagguauggccagcuggauauuuuacucaacaugguggaucauacucaagguaguguauaaaugguuuagcagugaauuccaccccauacuucuugggguaacaucuaugcuaucaagcccuuaaaaccaaauccaacuagcucuaaaccauaaacauauauuaugauucaagcauuugcaggaaaaaaauugugcuucaguauaaaacuuugcuucaucuagaauauaaaggaucccauuucccaauuaccauauuaucagauucugauucuaugaggacuaauuuucaacucuguaaauuauagauaaaugauaacaaugcaaaauaauucuugccuauaggcaagcaaauuguguucuguucucuggagguucaauuaaucccccuaccccacccucagaaaccaguuuugcccuccauuuguaacauucuuuucaguauuccugauauauaaaugugucugggcuuuuuggauucucuuuagacuaguuauaauauuuggcugguucucucauuauaaguugaccuaaucuuuaacauguuuucauuuuauaucaguaugagagucaugauuucaccuuuauuugagaauuauucuuuaauacauguauagaucuuggacuaaggcuaucaauuucgagacuucacuuguaggacugugcuguacuccugucucucacacucucugcacaugccauuucccagccuggaauguucuucccuccuccccacuccagcuucuggaccuaguuaauuccuaaucuucacucagauuugggcacaauuauagccuccauaaacaagcauugccuaacuaccccuccucucugccaagaaguuuagaucucccuguuauaguucuugcacuuaacaccauugacauuuaucugucuggauuuucugacuaaugucucuuuuccucacuagaauaaugcucgcugaugguagggaccauauccgguuuuacauaccauugcacccaguuaggugucuggcacacagaaggcugaaacaauauuuguugugaugggguucuugacacacuaccccaaaauauggcaugucggcauuugacaaaacaguggaagcaggaaagucucucugaccuucucccacacuuuuccccugaagcaggccauaaaagaaaucucuagccuuccucuaaagugggucauaggccuuauucaagaggcacccuuccuaugccuggaggaaaggaaugucauuaucucugaaggcacagagauaaagagaaaaaucugaauaaagaaggcuugcuaaguuccccccaguuuauuaucuuuagaucacacccccuauguccaaucauacuucuacacaacugucugcucuucaucaaauuuagcauaaaaauauacaaguuucccuguuucuuugagucuuccuuucuccaugucacauaaaacuuauacuaaauaaauuuaugucccuuucucuuauuaaucuuucuuuuguuauaggggccucagccauuaaccuggcaauggaaaagaaaaauauuuucuucucccuugcaguugcguacaucagcaacacaguagauccauggaucagugaacaaauugggcuaugaauauuccuauuauaaaucagaaaaacagaucuagaccaaagcugaccaaaggagaaggaaaaggagagacugcauuuugauguaaguguuacugauuugaaaaaccauggagaucgaucaccuacuacaagguccaaugguauuccagauucuagaaaagaccuagauaaaaauauaaagucucugaaaguccucucaucuucuccaaagaguccuaaaauccaaaagaaccuaggauuucuggguauuuugaaccugaacaaaggcaaagcacaaaaagcaugguauagaagaaggcuucucaaagugugguucccagaccagcaguaccucuuggaaacucucaggccucaucucagaccuacugaugaaaucagaaacucuggaagagggaccagccaucuagguaucaacaaucgcuucaggugaaacugaugcuuguuagagacucauuggcauagaacaaagaugggccucaacaaagauggaaucaccagacuccacuguaaauagcugugaaacacugagcaaguuauuuaaguucucuaagccugaguuuacuuaugaggaaaaauggggauaauaacaacaaaaacuaucccacagaaaugugguaagaauuuuuuuuuuuuguuucaacuuuuauuuuagauucaggggguauauaggcaaguuuguuaccugaguauauuguaugaugcugagguuuggaguacaaaugauccugucauccagguacugagaauaguacucaacaguuagcuuuucaacccuugcuucccucccucacucacuccuccaguaguccccaguaucaauuguugccaucuuuaugucuaugaguacccaacauuuagcucccacuuacaaguaagaacauuugguuuucuguuccugcauuaaugcacuuaggauaauggccuccaguugcauccauguugccacaaaggacaugcuuuuguucuuuuuuuaugacuguauuguauuccaugguauauauguaccacauuuucuauauccaauccaccauucauaggcaccuagguugauuccaugucuuugcuauugugaauagugcugcaugaacauauacaugcaugugucuuuuugauaaaaugauuuguuuucuuuugcauauauccucaguaaugugauugcuagguugaauaguaguccuguuuuaaguucuuugagaaaucuccaaacugcuuuccacaguggcugaccuaauuuacauucucgacaacaguuuauaagcauccuuuuuccccacagccucaccaacauguguuguuuuuagacuuuuuaauaauagccauucugacagugugagaugguaucucacugugguuuugauuugcauuucucugaugauuagugaugaugagcauuuucucauauguuuguuggccacuuguaugucuucuuuugggaagugucuguucauaucuuuugcccaucuuuuaauagaguuacuuguuuuuugccuguucaaaaaauuuugaguaaugucuauaaauugccuagaaaauugacugacaggcugggcacaguggcucauaccuguaaucccagcacuuugggaggcugagguggacagaucacccaaggucagcaguucaagaccagccuggccaacauggugaaucucugucucuacuaaaaauacaaaaauuagccaggugugguggcgcaugccuguaauaccagcuacucgggagacugaggcaggagaauaucuugaacccaggagucagagguugcagugagcugagaucgagccauugcacuccagccugggugacaagagugagacucugaaaaaaaaagagaaagaaagaagaagagagagaaaauugguugacaaagaauggauacuaaugaaauaauagcugcuauugaauuuaucauucaugucaguagcagcagcagcagcaccaucaucaccauuaccaucaccuugucuagauucuuaaggccuggaacccaggguuggaagaaacuguuguccuuuugccucauacaucagcaaagcgugcauagggcucuuaggaauugggcaggaggaauccaaauuugugcaccauuacugucuucuagcugaugccaccguuuuuugucagucauuuauacuaaaauauacuaacuuagauagguacagaauuuaagagguuacacaagcacuuagcacacaugcuaucugaucuucacaaacaaccugagaguaguuauuuaauucagagaaguuaguggacuugcccaaagucacauugccaguccucacagucaucugaagagccagacuugaauccagguauuuugauuccaaaccuagugcuuucuucucuacuccucgucuauacuucuguuuucauuauaccaccuugccaaggaaacaaacacucaccagacacacuguagaguaaaauagaccugacauccuuuagaguucuucuuggauccuggaaugugguucuuauugucucuacuuacaaaccucacauuuacagaagcaggcuguauuuuuuuaacaccuuccuuauuagcaauaauuggucccuucugcuguauguuuguuugauuuuuaauacacacaguucaagauuaacucaaaucuguucaacaccaaucuuucuaaaaaccaacuuuccaaauauccacuuguaacacagaaaacugcagaucgucuuuccugcuuccaaaauacagucacuuucauaaauguuguccauucauucuagcacugaguguucauaaagcaccuacucauugcuaggcacuaugugaggcaaugggcacacagguguggugucuuaaguaagacagguguggugcuuuccauccuggaagugugagggagucuggcaauaaaaaaaucaacaaauaaaagaaaauagccacagguuagaguaagugccauugcaaagccucaacagguaaaaugaugaaguagucacucacauuuucuucaggggcuggagaagcccagggaaugacuccagacagggugguccaagguccacuucucacucuucagauaaaaacacaaacaagcauaucuugacacagaaaaucuaaugugaaaauccgguaaguggaaauaugaguugacagaaugggugauuuagaaacggauuaucuacuuuaacaugagaauucgauacaggauuuuucuugagcacuuuccuaauacaaauacauuuuauauuuauaucccuauuaaauauauacuauauuuaauauaaauauaaaaguuggaugccauuuauaaaaauucaauuaauaacaaaaugaaacagcuacugccaaaaacuugcauauacagacguuaaaagaaauacggggcugggugcuguggcucaugccuguaaucccaacacuuagggaggcugaggcgggcagaucaauugaggucaggaguucgagaccagccuggccaacauggcaaaacuccaucucuacuaaaaauacaaaaauuagucgggcaugugccuguagucccagauacuuggaaggcugaggcaggagaaucacuugaaccugggaggcagagguugcagugagcugagacugcaccacugcacuccagccugggcagcagagugaaacugugucucaaaaaaaaaaaaaaaaaagaaagaaaagaaaagagaaaagagaauaaaagaaaaggaaaagaaaggacaggacaggaaaggaaaggaaaagaaaagaaaaaagaaaagaagguaccaagagguggaaaggaacagggagaaagaaaacaguuauucaauguuuuuggaggcccaagcacaggguuuuggcauaauuuauuuaguccauaaaacaacucuguauuuagggaucauccacauuuuacaacaaaggaaacccaauuucagugaggugagauuauuuguccaagaucucucagcugguaagugacaaaaccacaacauaaaaaucugaucuauauccaguaacuauaucccauccauucuauaaagcaagaauuggcacaccacagcccacagggccagacuuggacagcagccucuugauaccaccacaaauuaagaaugauuuuuacauuuuaaaagcacugaaaaaauucaaaagaauuauguuucaugacacaugaaaguuuuauaaaacucagauuuccauaccaauaaauaaaaugccauugguacacagccacauuuaccuacugucuagagcugcuuucaaauugcaagaugguguugagcaguugugaaagaaucaguagggucccaaggccuaaaauacuuacugucuggcccuuuacaaaagaaguuugcuaaccccugagguagagaaaaggauccauagaaauaaaaguaacaaacacucucagaaaugugacuucaaaaaugagugacaaaaguaugcaaaaaauggcuauaaaaugcaccugaaagaauuuaaccuaauggcaguugccugaggcacaacuuucucaauuucaccugaagguuucauuuuucuggcccugugucccagugaggaagacccaagucaaccuugugacagggauuuaucacgucuuaacuugagcaaugcuguguucccaccagcacucucagaauggaggccacacaaugucuccacuccugcauucacuggcucaacuugguuucugaagaaugcgaauuuaguucaaggcacgguuucaagcuguuuuuguugauuucccacuauauugucuucucuaaauauuuucugguucaagugcauacgcucaauuaugaaaaugaauucuuacaaacaaccugaucugggcggauaguuaacucacaccaugaagcucaaauuugccaguacagggaaagguauuucuuuuucuuuucagucuucaggcuacaagguugaaagccagaagcuauguguuauaaaaugucccuaguuuuucccauguuuuguagcacacauauugaucucuaugucuuugccauuuacuuguguguggucauccccaauuaguggguuauuuuguacuuuucaaaguuaaauucuaagucaauacuuagggcguacaccuaagucaaagauggccuccaccuugaaggaaaaaaauuauuacauuucaacgaaaaccuacacaucaucuauaaacacacucuuuccagcugucugacucuagccuuguacaaugucuuugagcuauuuugcaccacuucguaaguuguagauaacugauagauauauauaaauucugucuuacaggcugugauuuuaauugacuuccuacuguggagaaaacaguuuuaucucaauuugcaacucaucuuaacucucuuuuaguccauauaaauuugugccauuuugacuuuuccuuugagccaguuauaacaucugccugguucucucaaaucauauaaguaaaauaaaaucuuuagcauguguucauuuuuauaccuauaugagucauaacuuuaccuuuuacugaaaauuauauuuuaaugacccaaaagauuaguaagaauucagauuuauuucaaaaucuaucuuuaaaaacuuuaaauuuugagugauuucaccuuuaauaugaauuuaguuggaaguaauauuaaguuaguuuaaaucauauagaaaaaugaaaugugaugagaagugaacuucuuuguucccuuuuauugcuuuuaaaaugauacaagacaaaaauugugcagaggggcaagaaacaaauguuaaacaaaaauuauucugacauguguuaaaaugguaaggaagacuuuauuaaggacuauugcaauagcaguauugcaacaggggagagagaucagguucaacuccaaauacaacaaagauagauagucagggauuuauagccaguguuagagcagauaagggguucaguggguagaaaacuacuaagaggaguaagggaauucuugcuaaauuaauuccuaacaggauucuugcuaaaggcaggccaaugacuuagacaucaaggguggggugagaaacuugauuagacaucacggugaccagcuaucacuuaaaaagauuauugcuaaagccaggcuagaaagaucaaauacaggaaugaggucuggggccaaggucgcuaguugagaaaagggcucagaggaguauaauuaaaguuugggcaaggagaaaaucuucaucauagguaauagcaaauuuauaaaaggacaauucaauucaauaaaucuuguccucaaggaauuuacaauccacugaaaagagauaauuaagucaccacaaccuggucaaauuaccuugguuuuacuuugcaauuaaauuuuauucccauaugaaucuauauguaaauaaucucuuuaaagaaaacaaauaaaaugagaaguuaaaguuauuucuaucucuguaaucuuuauuuuaaccuuuauuuuaacuucagggguacauaugcaggcuuguuacagagguaaacaugugucaugaggguuuguuguacagauuauuucauuacccacauguuaaaccuaguacccauuaguuauuuuuccugauccucucccuccucucucccacccuccaauaggcccuaguguguguuguuccccucuauguguccauguguucucaucauuuugcucccacuuauaaaugagaauaugcagcauuugguuuucuguucauguguuaguuugcuaaggauaauggccuccaucuccauccguguuccugcaaaggacaugaucuuguucuuuuuuuggcugcauaguauuuaaugguguauauguaccaccuuuucuuuacccagucuaucauugauaggcauuuagguugauuccauaucuuugcuauugugaauaguguugcaaugaacauaugcaugcauguguguuuauaacacaaugauuuauacuccuucagguauauagccaagauuuuuccauaaucccacugguauuagauacccaaaaaaaucccauugguauuauauacccaaaaaauaccaaugggauuaucagauuacuggaccaaaugauauuucugucuuuaggucuuugaggaaucacuacacuaucuuccauaaugguugaacuaauuuacacucccaccaaagguguauaaacauucuuuuuucuccacaaccucacuagcgucuguuacuuuuuuagcuuguuaauaguagccauucugacuggugugagaugguaucucauugcgguguugauuugcauuucucuaaugaucagugauguugagcuuuuuugcacacgauuuuuggccgcauguaugucuucuuuugaaaagugucuaucaaguccuuugcccacuuuuuuaugggguucauuuuuuccuuguaaauuuguuaaguuccuuauagaugcuggauauuagacuucugucaaaugcauaguucgcaaaaauguucuuccauucuauagguugucuguuuagucugcugauaguuccuuuuguuaugcagaagcucuuucauuaucucuauaaucuuaauuuauagacuaaaauauuaauuugaaaauauaccaacuaaaguguaucacacaccuaaaucaaggauuuuauaaaauacacuaaaacagaaacuaaacauagacuauuuauucaacuuucauauaagcaaaagacaccacuauuggccaccaaccucacuacucccagccugugaaacaggaugauuauggguauuugugaaaucuaaacaucaccacucacuacauuaaaaugaaauggcaacaaauuuccacaagucuuuuuacucaaagugugguggcccaacccagcaaucugggcaucaccuggcacuuguuauaaaugcagacccucaggccccaccugcugaaucuacauuguaccaagauccccagaaaauucuuauguacaugaaaguuugaaaaccauggauccagaagugugugaaaacauaacuacugccagaauuuuuagcauauucccuuauucaucucuuuuuuaugaaacuaaacguagugguuuugcugauagagauggacgggggaaaagaaauuuuguugugaccaaaguugcugcauuuuuugccuagggguggaccuaaaguuucaugucaaucauuuuguuuugugagcaaaaucaaagucauggggaaaaaggagagggugcagaaagaagaaaauugugaauacauagaauuuuaucacuggaagacagaaaacaaucucaauuauauauauaguauauguacucaauacaguaaugguuaaauaaaccaugacacaacuaugcaagagcauauauaaagacauuaaaaauaacaaggucauuuuucauguaccaagaugcagugaucucuaauguaaacuuagcuuaaaauaugcaaggggaaaaaugcaagggcagcacagcauauauaaugacuuauuauucauguaaggaaaaggacauaagugugcauaugcauagaacaucucuggaaugacacacaagaaagacacacaaugguuacugcccagaggggagcugaggcacgagggacagaaauggaaggagacugacaucccacugugcaucuuuuaacaucuuuugaauuaugugauaguauuauccaauuaaaacaauauuuuaaucuaagcauugaagaauuccuaaaaaguagauaaaauacaguuacuaagauaauaaaggaaucccuucuucauuuucccucauagaugguuaugugacuauguccaaacacuuucugugaguuacagaucugagaaguugugucuaaaauucacugacacuggagcuuaaauccacgugccuagaaugcuccucacugcccccacacaaccccugagagcccccacugaugccaguucucucugcaacacaaacuaagccucuuccugucucagcugugaacacauuugcagaaggcuauugugguuuuccuuagucaggggucagaauggccagcaggggcaggcagguauccuaaacgaguaaagcaggccuagccaaaacaaagugagccuuuaccccuccaccugcaaugaaacagggcagcaacuauucugcuccaaggaaauacuaccauggaggagacagggccagauguugccaugucuucccagggaugucagaagcugcuaaauuuauuuuaaauaccuugauuuaaaaauguuaauauuuuaauuuuuuaaaaacaguuuacagaccaaauaaaauacaugugcagcuagauguaaccuagaaguucauaauccauccugucaucuuucguguguggaaccaugaacauuucucuuuuuguuauuuucucauuggagcugcugaaaagaaaaaaaaaaucucuuuuuaaaaaacucaaacagcuauauuuuggagauucgacaauuuacuaaucuaucacuccaaaaugugcuguauaauuuauuugacagucacugugcuugccuaagaacuaaaaauaaccucauuguauguguguguguuguuucuaaagaccugugguauuuauuauuguuagaaugcuuucgaugucuuuggugguaugaacugugagguaucucugaaggauagcauuucacuguauuucacagaauauacauauacaguccaucaaaacucuggggguuauuugcaaaacauaguucucauuuuccaacaagcuuucagcggaagaaaguuucauagaaaaaaauacaaauuuccuaccacucuacuuugugagaaccuaaagagacuguuagguuauaaaaaagaaaauugagggauaaauuuaacacuuaaaagugacucuucuagcaggagguuugggcacccagccagauuaaggagaaguagcuuuauacacacaucuuaacagcagucugaauaucaaaucuucacuacucuuugcuuaaagcccaguaccuacugagucaucccagccagcaugucccuucuaacuugucauccuguuuguuaucacucuaugcccucugcaguacucuggacuuugaaugugagauuacuuuauuuaagugaacugcaauugaaaaaagaacucuuuugauugaaucuugaccugcaguaauugggaacuuauguaaggaccccaugauacucauauuaaggggagugugggaggaucccacuacuaaagccuggcugcagaagagggauaauggaaacugcagguguuagaaagguaccaacauacaucuucccccuauaguacauggacucaguuuuuacauauggcuaugcuuucuauucugcuuaaguaacauaaaaacugauuaggaaacucaagaucuugcacuacauauaaaaucugcauccauugcuuauggucuaaaguaaaugcaacaacugacaauucuuacagagucucaaaaccaagaaccaccaugauaaaacaauuauacugcaaugcugaggaaagagacauuuaauuacagauauaauuuaugugaguaagcauaaucauuuuaaauuucuaaauaaauaggcaugucauuaaauauaaagcaucaggaaaggauuucaaaaucuguaugguucaucugcguuggcaaauuugaucuauucagaguuuacucugggcgggggggaccucaugauuccaucuuuauggcccaacuguugauuaacuuccaaaugaaaaugcuugauucagcauguauuuucuguaagaaagguauuuuucacaugcuauagccaggccaaucugugucuucaauuguuguuaagacacuaguauaucuuuaaaucuuuuccacuuauuaauuucagcagauuauuuguacacauuucucaggcuauucugauauuucaaaugccuugaaaauguuguagcuacauaaauuaaaugggcaauuaagaugucaccaugcaauucuauacaauacauacuugcaaugggauacuugugaggguaccauuauccaaacuguccuauucaucagccuuucuagaacuuuagagaugggagucagucagcuggguuccagucauggugaauggcaugcaaugaucucgaggaaaccacaaagcacaucuuccuauguuugcauuuccucaucuauuaaaugaagagaagaccuggauccuaacaggacgucugcgaaacccucacgaaagguuaagaaaagaauaaagaacaugacaaagguaagguuuacaugcucuuauuguggcagaagggaaaaaaaagcagaaaugcauauaaauaccucacaguuugucacacaaagcacacauuuaaaaaacaauaacaaaaaacaacaaaaauaagcaaccaaaaauaauuaacaguaguucaaguaauuuaaaccuguauucucuccugaagaaauaccagauagguaaaauauacucccgagccaccacaaacucuccuaaaaucccuuuguccauuucugccacuuucaacauccaucuuccacccagaugccagcuugaccaccucccccaucaaagucaccagacugagcucuaggaaagucuucauuaaauagugaacacaugacauauacuaucaacucagcuugaccuuacaacauaggugcuaugguuugaaugauggugucccuuccaaacuuaaauuuaauuaauuaauaauuaauuaaauuguugaaacuuaagccccagugcaacaguauugggagauguggcccuuggguagcgauuaagucaugagggcgaggcucucaugacugggauuagcacccuuauaaaagggcuugaggucaaaaggaguacucucuugcccaugugucccuccugccaugugaggacaugguguacuucccuccagaggaugcagcaacaaagcaccaucuuggaauuagagagcagcccucaacagacaccaguccuacuggugcauugaucuuggacuucucagccuccagaacugugacaaauuucugugguuuacaaaugaccaagucugugauauuuugcuacagcagcacaaacagcuuaagacaauggauaacuaaucuaaguuccaaaacuagugggcuuuugacaugccuuggaaguagacagauaaagcaguagccaagaucuuuucucaucuuugcauaagcaaaucguaauugacaaacaucaguaucucagagcauucaacaaaguggcaauaaguaaauagauaacugaugaacauacagaaucgaaaggcugacguggguuucagguuucucuggguuguggggcaucccauggccaaguacugaaacucuuccuugaauaacuaucuccagaguuugagccauugaggcucuuggugacaaagacaacugauaugcuuggauccaucaaauaacauaucagcaauucaugccccacugauaguagaaaagugcugcaaucauuuuauucugaagagagcauaaagauuuacaccacaugucaaggcuagauguuguucugccaccaggaaacuugcugugugagacacacaaaaaauuaaacaccucaagaaauacagcuuucuggaaaacaucaauaccucuucuuuuuauuguuacauuuuucuaaugaaucuuucacugcaacaacuuaugcagagaaguuauguauccuggaauuauucuacuuuuugauaaccauuuuuaaagcuuuauacuuuauaaagcuuuuuuuauucucccaauucacuuaagaauuugcaauauccaccucgagguuaaccugaaacucaauuucacagcuaauuccaacuaaacgucuucuccagcuuuccagaugccaucuaaccaguuauauucucacugauucagcagcauauucaaagagacagagaagaacugacaugaugcugaugaagcuuaaacuucagggucccuguugcaugggcccucagagugccaagaguccuugggaguccguguucuagcugagaggaaacaugaagaggcauuucucuguaagcauuuguggcaaagagaucuugaaagaaagggaaccggccgggcgugguggcucacgccuguaaccccagaacuuugggaggccgaggcgggcagaucacgagguaaggagaucgagaccauccuggcuaacacggugaaaccccgucucuacuaaaaauacaaaauaaauuagccaggcauggcggcgggcgccuguagucccagcuacuugggaggcugaggcaggagaauggugugaaccugggaggcggagcuugcagugagccgagauugcaccccugcacuucagccugggcgacagaguaagacuccaucucaaaaaaaaaaaaaagaaaaagaaagagaaccaaaucauuucacugaaucauuuugaaauaaauacucaccuuugcaucuaauuuuguauucauaaucuuuuccucuuuuucuuaaagaggaccucccaaauuguaugagcuuccaacuccacuaaaccugagucugccugauacaagggaaggcauguaaaaauacuucuuaguuuauacucuccacugcgcaaguuuucaaucuauaaaaaaacuccugaucuuuaaaaauaaaaaauaaagguuggggagaggguaguaaaaaguuacuuuaaauguauauuuuuaagaaugcugauuucauuauguauuuuccaauaccaaaauauaaaauaaaauagaaccugcagaacuuuuggcucucugacauuucuccccagugacuuaaaacuuucagaugaaugggacaucuggguucugagaagaaugguguauuauuacugcucuccacaauagcaggccuaaauggauuuuucauguuuagacuaguaaacauaaaaagcaaaccuaucucacaugacugauacguuugccuuuaacaaaacaaccccggccaaaaauuauuagaaaacagaucagcagccccacuggacucugaagcaauguaauuagguaguccaacacuacauuuugucaaaaaauucugacaaccuaauaaccagauugucaucagauagacauuaaaaaaugauaccagguuugcuccagcauuaaaauaccaccacuuucuggguuuuuuuuccuucuguaaaaauaaaaauuaaaaaucuaucagugaugcaucccauuggucuggaugguguuuaaaugagucugugccacuugaaggauggcaaaggaaguuuuguuuugauuuaaaguuuaagaaagaauucuucuuaggaccaccugcuuaacguuaaucacgaaaucccuauguguuaagagggguaauuauaaaauggaaugauaauaacaauaguaaccggcaguuauugaguguuuagauugugccaggcacuggguuucauucuguugaaugaaaccauuacuggacucccaacaaccuugaugagaggugcuacucucacccucauuuucagagguggaagggaggcuuaucaaggcuaaagaauccacuugcacacccaacagaggccaccucaugcucuuaaccucugcaauguguugcugagaaggugguuaguuuggauuugacagggugagguggugggcauuggggauaagagguguuauuuucaagaaaaccauuacguauguggccuuccagaauauaguaaucuaguauguagucuggccuguaagccaaauuuuauguauagugugacacugaagaaaaaaacguuguaauuauagguuaauucacacaguuaaugcaauuaaauagaaaaagguagaaaccuuaagauauagccuuagguucaaauauacucuagccuccauuuaauuagucaauuauaaaaaauuguccacuaaccuguacaagaauaaaccucagggaguacauuucuaagaugaccuuuggaacccuaguaucugaaaaucuuaccauuuuaucuauuaggauauaaaugaguuaucugguauaaaucacugucaaauuugcacaaacaaaugguguggcugacagucaguaauaauucaaugacaccaauuuuuuccccaacaugaaaacaccccagauuacucagucagccaugccauggcuagauuugcaaggcacuauaaaguuuccaaaguauuuguccaccacgugauuuuguuugacauccacaagccuacauuauuucuuuuucuuuuucuuuuuuuuuuuuuuuuuuuugagacagagucucacucuguugcccaggauggaaugcagcagugcgaucuuggcucacugcagccucugccuccuuguucaagcaauucuccugucucagccucccaaguagcugggacuacacacaugugccaccaugccuggcuaauuuuuguauuuuuaguagagacgggguuucaccauguuggccagaauggucuugauccccuaaccucguuaucugcccaccucggccucccgaagugcugggauuacaggcaugagccaccaugcccagccaagccuacauuauuucuuaaacacaaaaagaucauuccgaauuucacaaacaauguugagcaaaauaugccacacacaaagaagcccauaccguaugauucuauuuauuauauaaaauuaguccaggcacagugacccacaucuguaaucccaacacuuugguggcuaaggugagaggauugcucgagggcagggguucaagaccagccugggcaacaauaaugagacucugucucuuauaaaaaacuaaauuaaccaggugugguggugcauaccuguggcccuagcuacuugggaggcuaagacgggaggaucaccugagcccaggaagucaaggcugcugugagcuauaauugugccacugcacuccagucugggugacagagcaagacccuaucucaaaaaaaaaaaaaaaaaaaaaaaaaaccacccaaaaacacacacaaauucaaaaacaugguaaaaccaaucgcagaugagucaagauagugacagccucaguggaagcaagcaugguagugaguggaagauggcaucagagugucauguucuaccucuuauucuagaugcugguuccuuaggcaugaugacuuugggaaaauucaucaagauguacaacuuggauuuacaaguauacaaauccuauagcauguuaugcuucuacagaaaauugacauaaaacaaccauucucucccuuucaguuugcuaacuagaccaagaagaaaagauacacugagaaagagggugggcacucugaaaacacugagaaguuugacuuuacaaacuauugagcuacugacagucuuguuaaaaccucuuagcgugccuuucccucacggcaucaauuuauauagcaauucacuacauuaauucuuguaaugaaagugugaggagaucuguagucaaucauaauugugcccugcaaauuccagaaaauguuugcugggauguaagccucugauggcuggcucagcaagugauuuagagcaauguggugaacuuucauaauaacagcucauuaacaauugcguuuaaaauguaaacaauugauauguuuuuagaaacaccaguacugauuagguuuauuucacuuuacaggaagucagaagauaauaugcuaagcagauuuuccuuucuucccucucaacgauaaauucaauaauaguuagguuagaccuaguuuuguuuucaguuuccaugaaugagaaaugugaagaccauggggguuccaacucagucucucuucuccaguuuuguguuuaggaagcacagacuugaaauguauuuugcaugucuuccaagacuaaauaccgagguuauguuugugcagcugucugaauaaaacugaugcuaccucaaaaaauaaguugauucagucacaaaaaaguaccaagcaaaguauuaauugauuuaauugcccugcuuuuauuuaaagcuagacaagaacuaugggggagggaccuuaucaaugauguuaacagauauauauguauaugcccagcaccuagccaaauuauagaaagagcaugggaacugcuuaaugauuugcuuuaccagucaaucuuuauguggaguggggcauaguuaaugauaguaaucauuuuaggccugaguuccuuuaaauuaucaauuuaauauuuuuauuaaauauaugcauuucaaguacauuuaucuccguugcuuuuucgacuaaaaaauaaagacaaggaauucaaauguuuggauuauuuucccucacucauaccaaauacaaggaaaguaaacauaaugaaguuaaaguaauauucuuagcuugacaaaucacauauuggggacaugagaagccuaaauuaucugaagucaauuaauuguucuuugucaacggaaagaagaauuuagcucccaaacuggauaaaaucccagccaaguaaugaccaauaauggcaauaauaguaacauuauauuuuuccugucucuugauuaucaacaaucaagaggcuauagcaaauaaauauacaaauauauacugugaaaacaucaauauuuguaucuacaagaaggaugaaaaauuaacuuuguguaguaauaucccuccacuguauuuaggaaaagacaauacaacagaccucuaagaauggguguuccuucugguacuugaaggaagcacacaaacaaauauauuauggaacugguggggaaaaaaacagucauccagaaucacagggcugaagagagcccaggaugucaccuggccugucauguccagaauacuaacaaguuucauuuaauuccagcaucacaggcugcucugauauucccuggguucccucuccuggcucugccuaaagacagacccaaagaccaaaaaaaucuaccauguaguccaagucgucuaaugcuagcaagccccugaaucuugccacauagggcccacuuauaauugcaguaacaugucucuuuccuagccuaauuacuauucuuggagaaaaaucucucuuuguuuugacaauuuuuccuaucccuuagaaaaaaugguucaggaauagauucuaguauuauuuuucauacaugaaauaaauauucuauuuauucuauuacauuucuguucuauaaguguaugguuagaugacuguuacuauucuuucuggcuacuggacauaccaagucugguuuaaauacucuaaccagaauuaguccaugccaacauaagcauuuaaugagaaaggauccuggggcuacaugcuccauagucaugugaaaucggauacucugaaggggaaauaacuuucucugaaguguaaccauuaacugaaagagaaagcuuggugugguaugagucauggguaacaugggugaaucacaguccugaugggcagguggccaucucugaagaggauuucagaaaugcucuccccaccuugaucaauuaaauucucuuauuaggauagaaaacauuguauuccacgguuaaaguaugaaaugccuacauaaccagauaaaaugacacaacuguuccaaaaguucaguuauuuacauacuccuuucaugauuuguauaauaucuaugagccaguguucuauauuaauacaacauuucucuuuaaaucaacucaauucugccagucuaaauuaccuuuuugaagaagacaauuuuauauccccacuguaaauauccaaugucacugguauacauauuguauauagccaauaucacuugccauaaauagaaggaaacugaaaagauuucaugugacuaaccaaaaauguauucauucaucucaucucauguaccacauggaauacuguaacaaacugguuuaaauucauacuagagaguaaaugaaugauagaauucucaacaccccuccauccuguccuauuaaugagauuaaagguugagggaccaccaaaagagguaggcagggcccugagaaccugaaggagcauguauucaggauaggggguauggggggugggguuggaugucacaagcuaugagaaguaaggguacaaaagagcagacaguagcccacuucaugauuauuuauaucuggggcugucccugaaugugucauagaggaaguccucuguacuguuugauuugaaggcccuucuacuucuaugcaccaucucuuuuagacauccacaucugagcucacaaauuauccaucacaaagaaaucacaugcuguuaauaggucucuucauuguggcugacagugcaaaacaaaugccagucccugugcugagauacagauuucuggaauacuaacugggauucccaauguggggagacacaguaguagaggucacuccaaggacuccuggaacaugcuccugaauucuguugcuucuugccauacuugccacagagugccguuauguucuagcucucucuggguauccuucucuccaaucagauucucaauucucucaucaucuuucuauugcucuuaauaccuagcucucagcaaaacaagugcccaauuuauagaaaaagcgaguaagugacucugaaugaaucaaccacaagugaaugaaugaaugaaaacagaucagcuuugcagaaagaagcaccugcuuaccuaagguauauccccaaauuaucccaaccucaucuaaaguuaucagggaacacagcacaaauucauuagcauccugcugccuuuucagagaaaugacagguucuucuccccuugccugaucaaaagauuugcugcacucucucucuuaaaaugccuccuuguuacaaacugugcaaucuuggucaacuuaccuaaccucucugaacaucuguucccuuacuuguuaaauauugaagaacaauaucugccccaugaauugugauaaagauuaaaugagagauuucaagaaaagugacuguaguauaucaaaagccaaaaagccagcuacauuuuuggaccagaucacaaugccaugauaaauaucaauggaauaaugguccacaaugucacaccacaugcuuucauucugcuguccucaugacuucccuguuugccagcaucaggguuuuucacguuuacaaagaaaauggagcagguuagcaggucucgguggcauuaaugggcaaagcaucaugggcaacuguuguucauaaaugcuccuucucaaauguauccuggguuggugaugaccacaauucauuuccauuuugaagcgcccuccauuuuuuacuucuuucucagucugaaucuccuauacuuguaauacugacggagcuucgcuaguuucuaaaucagaaagaugagcacgugcagccacaggaagagaaaucugggaccugaugccuauaauauuuuucagacagagaauauucccccagugucucuacccaggagauaguaaacuacucugacauuucagcuguugccccuccaagcagauucacacaccucuucggcuaacauccccuuugggcaggcaucuacucauguuuacaguuauucauuaugacuggcuauacacagacagugccucuggugucaaacugaauggccccuuagacccccauuccaagacagccagaggauacagacauauauuaaauaagacacaggcaggaaaacugcacugacuuccuugagauggggaggcugaagccaaccaaagcugaccugcuagagaguccuccagagcuccagugugggaugacucacagcaaggagcacgggaucaaaauuuuugaggugcuucagggucagaaaguuuuccagaacagcuucugcggaugucugugaacaaauaugccagcaaggaaaaagaccaacuauuuugcaggggaaucaucuugaaccagaagggccagcaugcauucuaagugccagggcaaguucccaacccucugagcuagcucacaucuauugugauuccacacaucucuccauggaauaaucuguccaagaacacacaagcagagaagugcccuucuccaucuacaagcaucuaaauguagagucaugagagaaggugagaggcagugacuucaagagguggccucuagaccucagaauccacucuaaugaacacgcuguguuuaaacaagggaucucacauuuucucaaaaggcaguuagacacauucacauacuuaggagugaaucuaagaacucuagaaagaacggcacauuucccuacugacacaguuguauugaaaaaucaaucuguggcucuaagggaaaugagaaaacacaacuggugauuucuagcacggcauccaaucuucacuuuugugaucccucaauucucaguucaaguauaaauagacuuuuucccccccacgaaguaggaaaaggauuaaguaggcaggacauuuucuaaguucuguguagcauauguucauaagcuuuccuuuuguagcauuuauggauucauucuggaguaggguuaagccggagcaaagcaauuuggcaugcuugcaauuugcuuuaucaggagaagcaagcacagacugcagaggccaccucgaccugagcagcaaagaagcuucccagaacccugagggagacacugauuauuuuccuuacagggaugcucaagcugagccaaccuccuugcaaaauagucaaugagcuucauucagauuauccucaggaaagcaguggccaagcagacacaagugaucaucaucauacgaacuuaauuucugaccaaauuccacaaucacacugcucuuccugaagucagucaggcaguaucuauacugcuacacaaaccucagggucagcauuccaauccaucccagccuaaggaucccauucagcagcagaggugcuuuucaaaucuguacauccacuucgguacuuucuauccacaugagagaacacacugcagcaggagaugaggaugcaguaggauaauucuuaauguucacaauauaauguugaauggaaaaagcaguaugugccauuuucuuaaaauacaugcccacauaaagaacuaacugggaaaaaaacacccagaaaugucacuuggagucaucucugggcuguaggauuauacacaauuucuauuuucuucucuuagcugaacugguuuccaaauauucuaaaaugcaaaugcauuacuuuuauaauaguaauaaaguaauucuaaagugauuuaaauauauagacugugauucucaaaaugcaggaguuaaagaaaaaaauaaagacauagacugaaccuuacaaaaaagauuuuuauccacaaaacaaagaagcauuuucauuaaaacaauauaauuaaccugcaccauuaggaaagaacuacaucauauuucacauucaauuuuguuauuaucaccaucacuacuucuuaagcaucugcuguacacaaugcccuguagcggguauaaguacucaaaaauaaaccaggugguaacuaaguuauuuacaucacugggacucuuccaguguuauuaaaguugaagaacuugaaaagcagcauuuauuaauaacaggggcauuaauccagcugccugcccuguacuccacuuacccagagagucucucccaguccugccaagcaagauuaaguagaauuaagacggcagcuaaccagguagaccuugugcccugggccacaggugacucuggcaagggugggcgccugaccuacaucaaaccauucagauucuuucccccaggaaggaggaauacaguuagucucuaucauccccuugaaugaggcacagggaguugcacggguagccauagcuggcuggauaugcaaagaagccagucugcagacagaagaggugagaggcuaugaggauccugagacagucuccugcucuuuaggaugggaugcugagagauauguuuguccauuuacccaucccacucugguuaguuuuugagggucaaccacuuccuggccuaaggcuucaggaagcucaccaucuaaccuuuugucaaaugaguaagcuauccuguggccuuguagaagccucaccuuucaucguuuuugucacuguuucuuuuguauugguucuugaaaacaaauuaucucuaagacauaguugcaagauucagaacucugaacucucuucacccacuccuuacaagcugaaucccuccuccuguccuucuuuucagaucuuaacuuaaacgucauuaacucugaccgcuccaaaugaggaggccugcuauguuuugccucuugauguuuccuaaauaagauuuacauaacuuuuaauuguauaugcuuuguugguuuacuaguucugaucugucuccuucccuagggcauaaaauaaucugcccgacccauguuccuuguaccucacacagcacauuccuagcauauuacagaagaucaauaguauugaaugcaucagucagucauguaggugagugcauauucauucacucaauauacaaauaaugauugagcacuugaaaucugcaaggcuuaguccuuucuugauaaggaacuaaggaacuaaugauucaaaaaggagauuagguacauaugcaaagacaagaacauagacacagcagacacugcugagggccugucacacagaaauuucccucuuugacaaagaaggccauuacaccaugguaaagggaugaauucaacaagaagagcuaacuauccuaaauauauaugcacccaauacaggagcacccagauucauaaagcaagcccuuagagaccuauaaagagauuuagacucccacacaauaauaaugggagacuuuaaaaacccacugucaacaucacacagaucaacgagacagaaaguuaacaaggauauccaggaauugaacucagcucugcagcaagcggaccuaauagacaucuacagaacucuccaucccaaaucaacagaauauacauucuuuucagaaccacaccacaccuauuccaaaauugaccacauaguuggaaguaaagcucuccucagcaaauguaaaagaacagaaauuagaagaaacugucucucagaccacagugcaaucaaacuagaacugaggauuaagaaacucacucaaaaccgcucaauuacauggaaacugaacaaccugcuccugagugacuacugaguacaucacgaaaugaagguagaaauaaagauguucuuugaaaccaaugagaacaaagacacaacauaccagaaucucugggacacauucaaagcaguguggagagggaaauuuacagcacuaaaugcccauaagacaaagcagaaaagaucuaaaauugacacccuaacaucacaaauuaaagaacuagagaagcaagagcaaacacauucaaaagcuagcagaaggcaagcaauaacuaagaccagagcagaacugaaggaaauagagacacaaaaaacccuucgaaaaauuaaugaauccaggagcugguuuuuugaaaagaucaacaaaauugauagaccgcuagcaagacuaauaaagaagaaaagagagaagaaucaaauagaugcaguaaaaaaugauaaaggggauaucaccaccgaucccacggaaauacaaacuaccaucagagaauacuauaaacaccucuaugcaaauaaacuagaaaaucuagaagaauuugauaaauucccggacacauacaaccucccaagacuaaaccagaaagaaguugaaucucugaauagaccaaaaacaggcucugaaauugaggcaauaaguaauagcuuaccaaccaaaaaaaguccaggaccagagggauucacagcugaauucuaccagagguacaaggaggagcuaguaccaguccuucugaaacuauuccaaucaauagaaaaagagggaauccucccuaacucauuuuaugaggccagcaucauccugauaccaaagcugggcagagacacaacaaaaaaagagaauuuuagaccaauauccuugaugaacauugaugcaaaaauccucaauaaaauacuggcaaaccgaauccagcagcacaucaaaaagcuuauccaccaugaucaagugggcuucaucccugggauacaaggcugguucaauacacucaaaucaauaaauguaauccagcauauaaacagaaccaaagacaaaaaccacaugauuaucucaauagaugcagaaaaggccuuugacaaaauucaacaacccuucaugcuaaaaacucucaaaaaaugagguauugaugggacauaucucaaaauaauaagagcuaucuaugacaaacccacagucaauaucauacugaaugggcaaaaacuggaagcauucccuuugaaaacuggcacaagacagggaugcccucucuuaccacuccuauucaacacaguguuggaauuucuggccagggcgaucaggcaggagaaggaaauaaaggguauugaauuaggaaaagaggaagucaaacugucccuguuugccgaugacaugaauguauaucuagaaaaucccaacgucucagcccaaaaucuccuuaagcugauagguaacuucggcuaagucucaggauacaaaaucaacgugcaaaaaucacaagcauucuuauacaccaauaacagacaaacagagagccaaaucaugagugaacucccauucacaauugcuucaaagagaauaaaauaccuaggaauccaacuuacaagagaugggaaggaccucuugaaggagaacuacaaaccacugcucagugaaauaaaagaggauacaaacaaauggaagaacauuccaugcccauggguaggaagaaucaauauggugaaaauggccauacugcccaagguaauuuguagauucaaugccauccccaucaagcuaccaaugacuuucuucacagaauuggaauaaacuacuuuaaaguucauauggaaccaaaaacgaccccgcaucaccaagucaauccuaagccaaaagaacaaagcuggaggcaucacgcuaccugacuucaaacuauacuacaaggcuacaguaaccaaaacagcaugguacugguaccaaaacagagacauagaucaauggaacagaacagagcccucagaaauaaugccacauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaguuaauucaagauggauuaaagacuuaaauguuagaccuaaaaccauaaaaacccuagaagaaaaccuaggcaauaccauucaggacauaggcaugggcaaggacuucaugucuaaaacaccaaaagcaauggcaacaaaagacaaaauugacaaaugggaucuaauuaaacuaaagcacuucugcacagcaaaagaaacuaccaucagagugaacaggcaaccuacagaaugggagaaaauuuuugcaaucuacucaucugacaaagggcuaauaugccaaaucuacaaugaacucaaacaaauuuacaagaaaaaaacaaccccaucaacaagugggugaaggauaugaacagacacuucucaaaagaagacauuuaugcagccaaaagacacaugaaaaaaugcucaucaucacuggccaucagagacaugcaaaucaaaaccacaaugagauaccaucucacaccagguagcauggcgaucauuaaaaagucaggaaacaacaggugcuagagaggauguggagaaauaggaacacuguuacacuguuggugggacuguaaacuaguucaaccauuguggaagucaguguggugauuccucagggaucuagaacuagaauuaccauuugacccagccaucucauuacuggguauauacuaaaaggauuauaaaucaugcugcuauaaagacacaugcauacguauguuuauuguggcacuauucacaauagcaaagacuuggaaccgacccaaaugcccaacaaugauugacuggauuaagaaaauguggcauauauacaccauggaauacuaugcagccauaaaaaaugaugaguucauguccuuuguagggacauggaugaagcuggaaaccaucauucucagcaaacuaucacaaggacaaaacaccaaacaccgcauguucucauucauagcugggaauugaacaaugagaacacauggacacaggaaggggaacaucacccacuggggcuuguugugggguggggggagggaagagggauagcauuaggagauacaccuaaugcuaaaugacgaguuaaugggggcagcacaccaacauggcacauguauacauauguaacaaaccugcacauugcguacauguacccuaaaacuuaaaguauaauaaaaaaaaaauaaaauaaaaaaagaaauuuuccuguuucaccucacagguaaagcccugugcugguuaauuuucugugucaacucaacugggccauggggugcccaaacuaaauauuauuucuggaugugucugugaggguguuucugggugagauuagcauuuaaacagaaggccaucacccaguuuguugaacagaagaaaaggaggagaauggagaaauuugcccuguuucugcuucacugugugagcugggauacaugaucucaucuuugccggcccucagacugggauuaugccauuggcucccuugguucucaggccuuaggacuuggacugaauuacaccaccggcuuuccugggucuccagcuugcagacagcacaucauggaacuucucagcuuccagaaucacauaagccaauaccucacaauaaguaaauaaaccaauaaauaaccuuuugguucuguuucucugaagaauccugacuaguauaagccccaguuuuauuaggguggccucccuccauaaagcuauguacucaagggaaggugagauuaucccagaaaagagauaaaacccgauuaguuuaaaacagggaaaggguuaacagcugcucugauaucccuuuagcuccaagggcagcugggcagacccagagcagccagagaccccacacccaugcccuacacacacacaucagccacuccagcugugagcagccucuucugauugcuuaacaugccggccaaauuguauuuucuaugugcaccauaacaagaacaaaguugggaagcaccaaucuaagccaccagggaugagccccauuccgcgugccagugucugauuuaggaaggagcaugggacugcaaucaacuaaaugagacuuaaggggaagucagcucagggguuacaggaacaguuccuugcuuuuaaaaagggacauauaagaacagauauuuuauuuugccaguggauguugccaugucugccuguagcucccaaaaaggaaccagccaucuuagaacuaugaaggcagccagucuaagaacuaagucaacacacugaagauggcacaggaaaaagagcaagaaauagacacuuugguaacaauguugagccacugaauuaacaaaacuugaaacugcaccccucccaggaggucuuauucccugagauaauucauuucucuuauucugauggguuuuuauuugguggauuuucaaauguaacuugguagagcaauucacaaaauaauugacagugcuuagcaaucugucaauagcugagugcucaaaauccucucccugcuacacagugacaaccaucaaaggcacccugguggguccccaguugcuuggcaaaaguggauugcaguuagauuccagacauuuggagccaggauucuauaaugccuucccaucaaucaugacaucccuggggcagcagguagacuugcagagggcagggagcuuuuuucuuuuaauuccccuauuguuugaaccauuucaaguugacuuuuugauuauuugcagccaaaggcaucuucggugauaaauccaucuucacauaauuagcagcaaauuuauguggccuccuuugagcaaagacucaggagaaaaugaugcagagauucauaauuccacccacauuccccaaaaucuuuagaugaugggucuucagugaauucucucuacaaaaaaaaagacaacugagaugccagaaaaaggauuaaucaugugaucaucugacacuuaucaugggagucauaaaguaccacacaaauggugaggcaucaccuugucucaguguugaauuaggggcagcauaauuuuaaaauaucaauuuguacucuuuguuaucccuccuguguauacuguucccuuucgcaucucaaaaacuucaagacuuugccuucuucccuuugucucccagacauauucaaacgcaaaagaugcuaaaagacaaccaccaauccccuaaauccagucuccauuaaagacuuuucuuuuucaaaaaagccuaaauucauugaagggaauguguuacaucccagcagaaagguccaaaauaaagacaauuuggguuguuuuguuuugcuuaaaaguguuguucuuugaucuguuuaggugggcacuuggaguacaguaaggauugggcuuuccugguauuggagagaagcuggagcaguuccuuaaaguaguggacgcuggcacccugcuuccuggcagaacucuagagaggugacaggacuuuugaucgggauagugaugggauacugggaaaaugacuaccaaggccuugaagccacagcgaaaaucccagccuucuuugcacagauacaacaggacuacccaacaaugcauggacaagaagccucucauggugaccagaguggacuaaaguucagggggccuuuuuaaaaauguuuuaugcuauaacagaccugcagcauuuuugcaucaaugaccuuaagugagcagacacuccaaacaccacuuagaacuucccaacauuuagagaaaaaaaaaguaaccaguuaugcauguaugcaugcuugcaauucaugcagcauucaaaacaauuuuucagaaugaaaucuuuaaaucagagugcacacucaguuuguauuuuuaguugauuugacacaucaugagcaaccacaggauuccacaauaccaggccaaguucccacuguagggauggaaaggugugauaccuuuccucaccucucacaagagucacagccaacauuccuauaacaaaagacaggucagcaagagaaaagcauaacaaauguauuuaaucaaaguuuuaugugacauagcagccuuccgaaaugaagacccaaagacuaaaggaaaauaguuuuuaugcuuagguucagugaagaaugcacagcuguguagaaaugugguagaacaaaagggguguguucuacuggaaauagaaaauagauuggcggugguggggguggugguggggaucagcaaggccugacuauucagauucuuauuggccucucuguguaacguucuuucuucccaguauggagcagggccucuauggaaugaggaucuucaaaggagaaggaagagagugacuuuucuagguuuaauggcuugcuguggggaagagacauucuaguuucuaugacccaccuuagggaagaggaauucugguuuauacgacuugcuuaaggggaggaagagaaguaggagacaguauuaugggagacugccacaaagaccuugguucugagggcuuuccaauguauuuccuucaguucaaaguacucaggaugcuaagguaccauacuuugggggauuggguucuaagacccgacaccacuaguuauuuaauauuuuccuuccugcaaauccugcuaccuuaaaaaaaaggaaaacuaacuguacaacagguaguucuguagcuaaugagcauuauuaaauauuuucaaaacauuccaauaaaaggcaauaccaaacggcuuuuauccuaauacuuucuaaauaacgccacauucauuuaugaggaauugcauuucccucaauguucugggcauuaaugaagauugaauauaaauaaaagaauugccuuauauguauagcacuuuaaagaguugagauucccaaauaauacaaaagcauuuucaagucacacaugguauguaaagugaaaauguucuugaaggaaauauccucuaauaauacuuaccuacuucagagggugaugggaagcucuauuaacaccaaaagaacacuuuuagaucuucaaauaaaagcacuauacaaaugcaaaguauuauuauuauaguucugaaauaauuucacaccuagggaugagaaaaccccaggccaaauuuuauugcuucucucauacgugauaaacaagaaaugccauaagcaaggggcgaggggggugguuaguggggggugugauagugggggaaguggaaaucaaacagaacaaagacuucaaaguuucucuuucacuaggacuuuguauuugcccagaugucauuuagggaacucucagggaagaaagaaaaaaaaaagucccuuaaaggucagaguuaaguacagggacaaaguucucauugcuuuuguaccagauaaagcaacaaccggcugagcugaaaaaaaauaagcuugucuacuucuaugggacauaauuucucccaaagcacuucucaaaaaaaaagaaaaaaaaauggccagaugaauuauuacugaaucacccacuagugugaugaucucaccuaugaagucaaaagguagcugcuuuaacagacaccaggauuucuagucaauuacugagagcacugagcaagacauguuauugcugaugguagugguggugaugaugaugaagaugauaaugauguugaugaucaugauugugaugaugguaauuacgguaaugauaggauauggaacagaaguucucaaaccugcugaucaauggaaucaccccuagagcuuuuuacaauacagauuuuugguucuccaccucagccccacugauuuugaaucucugaagauagaacucagaaauuuuuuuuaaguagccaucaggauaacugaagugacaguauuuguaaguaauauaaugauuaagaaugcaggcucugugaacagacuggcuggugucuucucccaguucuaacacuuacuagcuaugugaccuuggaaaaaauacuuagccuuaagucucaauuucuacaacuauaaaauggaaauacuaauaugacccaccuaugaaauugacaugcuauuacuaccuaccuuauaagguagaugccuaaaguaggcaaauuuuuuuaaaagcacauauuaauuccaagaaagacaaaaaauuuuauauuaaagaaaacauaacaaauaccauucggcuuagcaacagaaaaaaauuacguaaucaugauaauguaaauauuaccuguugauuuaaauaaaaauuguaauauaacuaugucaggaggcuguggggaccagaagugguaagaguggaaaggaucagagagcuauugcuaaaauugauaaauuaggaaaaaauaauauaaguacauuauuuagaaagagagaggugaacaccagaaauaucagaauagaaaguugcuaauucugggaagcaauccagagagagguagaaagaaggcauagauguugcaguuuuuaaauauuugcuauuuaaugcuguuuuauuuaaacaauguagauacacugcuuugauaaaaauaaaaauaaaauguaaaagguaauuuguaaugcauauaaguacaauaugguauuucuuuauacacugaggcuacuauaaagcuuuucaauuuaccaaaacuugcuuuuaaaaaaaaaagauauaauaucuccaacuaugcaaucaaaauguccauuucuuaaaaguguacaauaaagacuuacuuuuuaccuggcacacucuaaauccuaaaaagauauuugcugaauugggcugaggaugguggaaaaauauauaaagaacaaaguuccuuuguacaaucaaggucacagcaggaaggagaugacaucuucaccuggggugaaggcaggguuaagggaagaccacuaagggauggucuagugugcuggacuuagcaaaaauuccauuaacacuccagacucaaaggggaaaagggaagaggcaguuaccagacaguagaaaaagcuguagccgcugaagagaggcccccaaccggaacuguggccuuccuuagagggauacagccauugccaacccacaaugcugcagggaagaaaguagggaagaauauuucaaccucguguucccaggucuucauccaguuccuuccccuggcuaauacaacagaaagccagcaaacaagggagcccagagaaugccugcgauagagguuaggcccauggugcagagccauuuagaagagagaggagcuggaagcacaaaugugaauacccagcacaagcacuauacaaggugguuguugcuguugucguuguuguuguuguuuaaucugucucuuuuuccuacucagccuccuaaaacaagccccucaaauuuucaucuguuuaagaaauauucauggcaugauaguaauaaacugauguuaugcauuuguuaaaauuuacuaagcacuuucauauauauugucuucaugugauccucaaaacagcccugugcaauaaauagggcaaaaguuauccucauuuuacaggugaggaaccucagaucuuaaagaaaguuaggaaucuugcacagagucacaaagcuagcaaauggcagagccaaaacuagaaggaauguuuccuaauaccccagcuaaggcucuuccuuccauauaauacugucaugcuauuuauucacaguaggagugcaaaauugauauaccuguuaaaaaaaaauuaacaaguuuuguucuaggcacugcacagagcacagaaguagucaacaaauaagacacaaggggaaauagagaaaacuugcccauuccauucucauucuacauuccacaagcaaugccagaacuggaaguaauugaguuuucaaucacauuuuacacaucauugaaaagaaggugcucaguaggguaagaacaguguucaaaugagaaauaaaaauucagggaaaaguagacaaaugucuaaagaauauaccuguuguguuugggguugcuggggguaaaccgaagaaaaucucagucccuuaacaauccccaugacacaaagagaccagggccccagaaauugggagggaugacuucuccgcuucucuucucauuuccagcucuacgcccacauacauacaccuucuuugagagcuaagagaagcagccaagagugacuuuucuguaccaaacacaggaguacugggaaguucagcaaaauaacccauuuuugagagucuaauaaagaacucuguacuuuuuguaaucuacugcaaaacacugagcuacuuacacaugaugaaagaaaguaaugaguggcauuuuaauuguaaaccuccaaacauaccauauuuauuccagaucuagcucacuaaugaauagacuauacuaucaaugaggguucuguaguugcaagcagaagaaacaaauuggcuaauuuaagaauuauuggaaggauacuggagucucagccaauccauggcagaauggaaaauaagguuuggaggccaugacuacuagccaagacagacauggaggcaacaguggucucauaguacauguuggcagaucagaaugcccaccuaggacaagggagaauccuuuagcuaaagaaucaaauuccaaagaaggagcauuuacuuagccaagcuuguggucauacacccauccauaggcagggugcaggccccugaguagggccccugguuacaguuccacuagccuaauuaccucaaaaagaaauaaagaugcuguuaggaaggaaaaacauacacgacagaaaaaaaaaauugguggggggguucccucuauacuaccaaggcuuucuuuaaaaauucuugaagaagcuaacuagcaguagacucuuaauuucucaagacuauuaacuaguaauugaugacaaccaaggaagguaguuuuccuaauaccuacaaaacuucagccuaauaacuuuucacuuccagaggccucacuuccuguauuaccugaaaguuaccuuuucauuugauuccuaaggaccaagcagaauuuucccuucuuugguagcaacaugcuuauuuuagaaauauuauccugaagcuucuaaaaagaauagacuuauaaaaauguauaaugaauaaauucauaaagaugcuguugcugcugcugccgccgccgaugaugaugaugaugaugaugaugaugaugaugaugaugauauuaauaagagcaguggcagcucacaucuacugagcacuuaucaugggccaggacuucuaaguccuugacacagaauacuucauuuaauucuccacaccuacaugaagccaaaaacaguauuauccccacuucacagaucaggaaacugagacucuaagagggugaauaaguuguccgcaguccaacagcuaguaaaagccaaaucaugacuaaacccaugucugauuccagaguaccaauucaacaaaagauuuucauugagaauaaagaaaauggacugugccuguguggaaacauuccccaagaggaaaggaagcaccauaucugugccaaaagauuacaaaguuguuaagauggcuacaucaccaccaaauccaauuauucaugagcauuuauuucuaaaagcuaucaaguauuucuuuauuccaagauguggcucaaugguccagagacauguaguuguauggccaaaaauaagaauuaucuacugcuuaagauaguaauuucuucacugauguucaacaauuauggcaaaauuccaagccaaccaguuuucaugcaccagaguuuaguugccccaaagcaaauccuaagaaaagaggauuuuuuuauaacucauauuuuuauuaucuaaaagggguuuucuccaauaucccuguaaaauucuucuuugcccuccaaauaaacaugaaaaauucagccccagaaauagauuugucaagaaguuaggaagaacuuaaaguacaugguaaaucaaaauggcuuuucaacuuuaacuaaaguggucauaguaauaauugcugcaauaaaaaugacagaaaaaaacccuaaaaguaucaaaaauguaauuuaugaugaaaacaaauguaaaauuauagcauauuucacccuggccaccaaagacucuugaugaaaccgcagcccuauaauugcccagaaugaauucuuuaaauuaaaauacuucaugcagaacagaaauuaaacaaugaaucaaagaacaaagcuguacagagguaugcucauaaauauaccuagcaaagaggaaacaauuacauuuuuccauguaaaaaccaacuugauuguaauguuucacaagagaccgaguagguacuuuucccauugcuucaagcuuggaaguucauuuccuguaauucauuuagggcucagagugacuggguggaaugaaauuagauacaccaaauucaguggcucuuuucuuucuacaaaacuggcucuuccaugcaacugcacaacugacuuucacaauaaauuucauucaacccaauugaaaugccacucugcauuuuauuuuaaaugcuuuauuuggccagcuaguuuuauuuaacuauuggccagaagugguacaagugcauucuuuuuccaucuagcauuaaucuuaguaaacuuagcuccauuggaaugucuuagcugcugagaagaaagcaaaagucagcaagcauacaauugcauuugucuacucucaacacaucauuuuauuuccuccugcucucugcuaacuauugcucagcacuuuugccuaagagggaggacaagcaggugguuaaggaaguuguccugucagcuauaucuuuaguccaaguguuuaaaucucugaauaaaagaaaaaucaauguuguaaaggcaauguuugucaaggccauguaauaaauacacuuaccuuuacagacuguucucaguggauuucucuucuuuccugagcuucaaagcuacaaagacauaaaaaugaaagacagaguugucugugaguacaacaacaaacauuuucuccccaugucucuaaauagaauuuccauaugccaugguauauggugcuagccaaauaaaccauugauaaaacuugugccucauaccucccgcacaagaggccaaaaaaagacagucagaaacugaaaauggugcacacaucuacccagaauugaagcacacaaaccuuggccaaaucuacagucaaaucuuuuggaguguguacuccucaacagaaugggaacggcuuauagcgagaugaaaaucaaauuaaacaugagugugacauacucagucugacuaagcauuuuauuuucuuauuucuuuuugucaucuuucuugcaugcucuauuuccauuucucugaaaaaguuucacuuagggaugccuauuccauuuauaugacaugcaugguccuucuaauauaaaccucaccacuugcuccguaaguauaugugugcaugauuacagggacaaucacccuuccuguauguagacugcagccuucucucggaagaaacucacaaaacagaggaagccacaacuugacauuucaaaucaaaucuuguuaacuucagcucucugugaucaaaacauaaauacuaugcacugaccacacacaaaucaaugugacaaaagaucugcaaaagcaacaguaauaacuuacaguaucgugaagcugguucuuuaaucauccaaucuuacucauaaggugccucuacagucaccaguaaugggaauaugauucuuucucucauuuuuggcuagguccuaacaucuccgaaaggugcaguaguuggggauagacagcuacaccacagcuuuuccaugguucuuuuuuuuuccuucaauaucugaagggauuguuuuagcuuuuacugggcuguuucccuccacaucccucuauuccaucaaagaaugcauuaccacugaugcaugaccaccaaagaacaggucagacuuacgggcuaagauguaaauuucagacuauuaaugcaggagguaggucccuucuaugggacagcaucagaaauuucuccuucccccugagcuacaccguuuaccaaugaguuuagaacaagcagaguuuggagaauauuagauaaaauaguguaauauugcauuugugaaaucuaagagaugaauaaucugauaacauggagauugagcugaaucccuuuccacuucaaacacagaaaugcuaaacaaaauacaauaaugacuuaaaauacauauauguguguguauguguguauauauauguguguguauguauauacauaugugcauauauauacacacacauguacaaauauacauacacauguguauauauauaccuacauauauauacacgcacauagauacacacacacacacacacacacacgcacauacacacacauauauagccaagcccaaaagaaagagaaaaagccgucugggaagugagaagcgccucugcucagccgccaaccaucugggaagugaggagccccucugcccggcuggccaacugacugggagugaggagcgccucugcccggccgcccaacuaucugggaagugaggggccccucugccuggccgcugcccuguccgggaagugaggagcgccucugcucggcagccgcccugucugggaagugaggagugccucugcccggcugcccaaccaucugggaagugaggagcgccucugcccggacgcugugcaaccuuccaagugugaagugacagccuugugugugaucuuuucuguucuuccccaaguuugcauuuuugacauuaaaguuuacuuuuucguuaaaaaaaaaaaaagagagagagaaagccaauauaaaaauauauggauguagaguuucuagaaugaaagacaugaguccucuggaaaaaguauaacaauaucucaaaaagauaaauaaaagcaaaugcauacuuucauauaucagaaugaaaccacagaacgcagagauaaaaauaaaaucuuaaagucaaccagagagggaaaaaaaagagacuucuagcaaaagaacaugucauuagcaaaaaugaaaguaaagcaacagugcggacacugugucucacgccuguaaucccagcacuuugggacaccaaggcaggcagauaaccugaagucaggaguuugagaccagccuggccaacguggugaaaccuugucucuacuaaaaauacaggccgggcgcgguggcucacuccuguaaucccagcacuuugggaggccgaggcaggcagaucacgaggucaggagaucgagaccauccuggcuaauauggugaaaccccaucucuacuaaaaauacaaaaaauuagaugggugugguaccaggcgccuguagucccagcuacuugggaggcugaggcaggagaauggugugaaccugggaggcggggcuugcagugagcagagaucgcaccacugcacuccagccugggcaacagagcgagacuccgucucaaaaaaaaaaaaaaaaaaaauuagcugggcgugguggugggcaccuguaaucccagcuacucaggaggcugaggcaggagaauagcuugaacccaggaggcagagguugcagugagcugaaauugcaccauugcacuccagccugggcaacaagagagaaacuuuuucucaaaaaaaaaaaaagaaaaauuauaugcccaugcuaaaccuaacauucaagaaugauagagaacaauagauaaaucagaacauuuuucaaaaaaaaaauuguuuagugcucacaguaguuuacuuuugccaaaagaaauacuaaaauaagauaugcuugaauaagcgggaauuuaucccagaaggaagcagugagaaacaagaagcaauaguaaacagagaaauuaguaagcaugaugguaaaucugguaacuuuaauaauaaguaauggguauugauuaauaauuauuaagcucuacuuguaaaaaaacaaaacaaaacaauuuuuagcauuugccaauaaagugaaacugagugguuuaucacaaucauauggaauaaagaaggggguaauaaauuguuuacaaggaggagagaaauacuacuuaaggcauuaaagauaugcacuaaaacuacugauuaacuuguuaaggauaaccagcauuucuuucucugucuauauaagcaaagaggcccuuacacauguacucacagagauuuguacaauguuuacauucuacaaauguauugccaggauggcaaaaaauacagaaaacaacccaaacaucuaucagcaauacgauaaacacuuuuuuuacauauucuuagaauggaguauuauauaacuuuggaaaaucagugaaaguuacccacaucaacauagauaccucucaaaauauaauguaaaacaaaagaagcaagucacagaaagcuauacauauuauucuauuuguauaacauucaaaaaggcaaaaauaaauacuguguuguuuuugaauauaaaguauaagugguacaaaacaaaauaaagaaagggaagaaauuuacacagaauucaggcuaucuuuaucuugagagugggagaggagauggaauacgugagaggaaugggggggcuucuggaauaugguaaugaucuguuucuuggccuagaaagagguaucuggacaaucaguuuauuauuuucuuuaaacuguauauguacacuugcacaaauuauuuugcauguaggcucuauuuccgaauuuuaaaacauacaagaguaaccaccaaaagaacagaaauuuccaaaucaauagaggaaacaacauagaguaaacgcaaucgauucucuauacaacauugaaauggaagggagaaagaagcaaaggaaaacacgcugaauagaauauaaaaaagaaaauauuuuaacuaaguccagcugugucaggaaucaggguaaguacaucuguuaaaauuuuaucaaaacgaauguuuuaaaaucuugcuauguguuguuuauaagaaacaaauuuaaacauaaguuuugaaaagaaaaguguggauaaguacacaccacggaaauaggaaccaaaaaaaagcugacggaauaaguuauuguuaggcaugacgaaaguuagcaauaauagaagagaaaguauuuauauucuuuuuuuaaaauuuuauuauuauuauacuuuaaguuuuaggguacaugugcacaacgugcaaguuuguuacauauguauacaugugccauguuggugugcugcacccauuaacucaucaucuagcauuagguauaucuccuaaugccaucccacccaccccccgccccacaacaauccccagugugugauguucuccuuccuguguccauguguucucauuguucaauucccaccuaugagugagaacaugcgcuguuugguguuuuguccuugugauaguuugcagagaaugaugguuuccagcuucauccaugucccuacaaaggacaugaacucaucauuuuuuauggcugcauaguauuccaugguguauaugugccacauuuucuuaauccagucuaucauuguuggacauuugggucgguuccaagucuuugcuauugugaauagugccacaauaaacauacgugugcaugugucuuuauagcagcaugauuuauaauccuuuuaguauauacccaguaaugagauggcugagucaaaugguauaucuaguucuagaucccugaggaaucgccacacugacuuccacaaugguugaacuaguuuacagucccaccaacaggguaaaaguguuccuauuucuccacauccucuccagcaccuguuguuuccugacauuuuaaugauugccauucuaacuggugugagaugguaucucauugugguuuugauuugcaugucucugauggccagugauggugagcauuuuuucaugugucuuuuggcugcguaaaugucuucuuuugagaagugucuguucuuauccuuuucccacuuuuugaugggguuguuuuugucuuguaaauuuauuugaguucauuguagauucgggauauuagcccuuugucagaugaguagauugcaaaaauuuucucccauucuguagguugccuguucacucugaugguaguuucuuuugcugugcagaagugcuuuaguuuaauuagaucccauuugucaauuuugucuuuuaaugccauugcuuuugguguuuuagacaugaaguccuugcccaugccuauguccugaaugguauugccuagguuuucuucuaggguuuuuaugguuuuaggucuaacauuuaagucuuuaauccaucuugaauuaacuuuuguauaagguguaaggaagggauccaguuucagcuuucuacauauggcugccaguuuucccagcaccauuuauuaaauagggaauccuuuccccauugcuuguuuuucucagguuugucaaagaucagauaguuguagauauguggcauuauuucugagggcucuguucuguuccauugaucuauaucucuguuuugguaccaguaccaugcuguuuugguuacuguagccuuguaguauaguuugaagucagguagugugaugccuccagcucuguucuuuuggcuuaggauugacuuggugaugcaggcucuuuuuugguuccauaugaacuuuaaaguaguuuuuuccaauucugugaagaaagucauugguagcuucauggggauggcauugaaucuauaaauuaccuugggcauuauggccauuuugacaauauugauucuuccuacccaugggcauggaauguucuuccauuuguuuguauccucuuuuauuucauugagcagugguuuguaguucuccuugaagagguccuuccccucccuuguaagauggauuccuagguauuuuauucucuuugaagcaguugugaaugggaguucacucaugauuucacucucuguuugucuguuauugguguaaaggaaugcuugugauuuuugcacauugauuuuguauccugagacuuuccugaaguugcuuaucagcuuaaggagauuuugggcugagacgaugggguuuucuagauauacaaucaugucaucugcaaacagggacaauuugacuuccucuuuuccuaauucaauacccuuuauuuucuucuccugccugauugcccuggacagaacuuccaacacuauauugaauaggaguggugagagagggcaucccugucuugugccaguuuucaaagggaaugccucuaguuuuuguccauucaguaugauauuggcuguggguuugucauagauagcucuuauuauuuugagauaugacccaucaauaccuaauuuauugagaguuuuuagcaugaagaguuguugaauuuugucaaaggccuuuucugcaucuauugagauaaucaugugguuuuugucuuugguucuguuuauaugcuggauuacguuaauugauuugcauauguucaaccagccuugcaucccagggaugaaacccacuugaucaugguggauaagcuuuuugaugugcugcuggauucgguuugccaguauuuuauugaggguuucugcauugauguucaucagggauauugaucuaaaauucucuuuuuuuguugugucucugcccagcuuugguaucaggaugaugcuggccucauaaaaugaguuagggaggauuuccucuuuuucuauugacuggaauaguuucagaagaacugguaccagcuccuccuuguaccucugguagaauucagcugugaauccaucugguccuggacuuuuuuugguugguaagcuauuacuuauugccucaauuucagagccuguuauuggucuauucagagauucaacuucuuucugguuuagucuugggaggguguaugugucugggaauuuaucaaauucuucuagauuuucuaguuuauuugcauagagguguuccuaguauucucugaugguaguuuguauuucugugggaucgguguugauauccccuuuaucauuuuuauugugucuauuugauucuucucucuuuucuucuucauuagucuugcuagaggucuaucaauuuuguugaucuuuucaaaaaaccagcuccuggauucauuaauuuuuugaaggguuuuuugugucucuauuuccuucaguucugcucugauuuucauuauuucuugccuucugcuaguguugaguguugcucuugcuucucuaguucuuuuaauugugauguuaggguggcacuuuuagaucuuuccugcuuucuuuugugggcauuuagugcuauaaauuucccucuauacacugcuuugaauggguccaagagauucugguauguugugucuuuguucucguugguuucaaagaacaucuuuauuucugccuucauuucguuauguaccccauagucacucaggagcagguuguucaguuuccauguaauugagugguuuugagugaguuucuuaauccugaguucuaguuugauugcacuguggucugagagacaguuucuucuaauuucuguucuuuuacauuugcugaggagugcuuuacuuccaacuauguggucaauuucagaauaggugugguguggugcugaaaaaaauguauauucuguugauaugggguggagaguucucuagaugucuauuagguccgcuuggugcagagcugaguucaauuccuggauauccuuguuaacuuucugucuuguugaucugcuaauguugacagugggguauuaaagucucccauuauuauugugugggagucuaagucucuuuguaggucacucaggacuugcuuuaugaaucugggugcuccuguauugggugcauauauauuuaggauaguuagcucuucucauugaauugaucccuuuaccauuaugcaauggccuucuuugucucuuuugaucuuuguugguuuaaagacuguuuuaucagugacuaggauugcaaacccugccuuuuuuuuuguuuuccauuugcuugguagaucuuccuccaucccuuuauuuugagccuaugugugucucuguacaugacauggguuuccugaauacagcacacugaugggucuugacucuuuauccaauuugccaaucugugucuuuuaauuggagcauuuaguccauuuacauuuaagguuaauauucuuaugugugaaucugauccugucauuaugauguuagcugguuauuucgcucauuaguugaugugguuucuuccuagccuugauggucuuuaaaauuuggcauguuuuugcaguggcugguacugguuguuccuuuccauguuuagugcuuccuucaggggcucuuuuagggcuggccugguggugagaaaaucucucagcauuugcuugucuguaaaggauuuuauuucuccuucacuuaugaagcuuaguuuggcuggauaugaaaugcuggguugaaaauucuuuccuuuaagaauguugaauauuggcccccacucucuucuggcuuguagaguuucugccgagagauccgcuguuagucugaugggcuucccuuuguggguaacccgaccuuucucucuggcugcccuuaaaauuuuuuacuucauuucaacuuuggugaaucugacaaugaagugucuuggaguugcucuucuugaggaguaucuuucuggcauucucuguauuuccuaaaucugaauguuggccugccuugcuagauuggggaaguucuccugaaugauauccugcagaguguuuuccaacuugguuccauucuccccgucacuuucagguacaccaaucagacauagauuuggucuuuucacauagucccauauuucuuggaggcuuuguuuguuucuuuuuauuauuuuuuuucuaaacuucucuucucgcuucauuucauucgucuuccaucauugauacccuuucuuccaguugaucgcaucggcuacugaggcuugugcguucgucacgugguucucgugccuugguuuucagcuccaucaaguccuuuaaggacuucugugcauugguuauucuaguuagccauucaucuaauuuuuuuucaagguuuuuaacuucuuugccauugguucgaacuuccuccuuuagcucggaguaguuugaucaucugaagccuucuacucuugacucaucaaagucauucuccauccagcuuuguuccauugcuggugaggagcugcguuccuuuggaggaggagaggcacucugauuuuuagaguuuccaguuuuucugcucuguuuuuuccccaucuuugugguuuuaucuaccuuuggucuuugaugauggugacguacagauggguuuuugguguggauguccuuucuguuuguuaguuuuccuucuaacagucaggaugcucagcugcaggucuguuggaguuuccuggggguccacuccagacucugugugccuggguaucagcagccguggcugcagaacagcggauauugaugaaccgcaaaugcuacugcuugaucguucaaguuuugucucagaggaguacccggccgugugagguguuagaacgccccuagugcgggguaccucccaguuaggcuacucgggggucagggacccacuugaggaggcagucugcccauucucagaucucaagcugcgugcugggagaaccacuacucucuucaaagcugucagacagggacauuuaagucugcagagguuacugcugccuuuuguuugucugugcccggcccccagagguggagccuacagaggcagacaggccuccuugagcuguggugggauccacccagagcgagcuuccuggucucuuuguuuaccuacucaagccuuggcaauggcaggcgccccucccccagccucgcugccgccuugcaguuugaucucagacugcugugcuagcaaugagugaggcuccgugggcguagggcccuccgagccaugugcgguauauaaucuccuggugugccguuuguuaauccugcuggaaaagugcaguauuacggugggagugaccugauuuuccaggugccaucugucaccccucucuuuuacuaggaaagggaauucacugaccccuugcgcuucccggauaaggcaaugccucgcccugcuucggcucacacacagugcgcugcacccacuguccugcacccacuguauugcacuccccagugagaugaaccugguaccucaguuggaaaugcagaaaucacccaucuucugugucgcucacacugggagcuguagacuggaacuguuccuauucggucaucuuggcuccaucccccguuuuuuauugacauauaacaaauuauccaaaaacuagauauuuaaaaauaaaagugguggcuggcagccaagauggccgaauagaaacagcuccggucuacagcucccagcaugagcaaugcagaagaagggugauuucugcauuuccaucugagguaccagguucaucucacuagggagugccagacagugggcgcaggacagugguugcagagcaccgugcacaagccgaagcagggugaggcauugccucacucgggaagugcaaggggucagagaucucccuuuccuagucaaagaaaggggugacagacggcaccuggaaaauagggucacucccacccuaauacugcacuuuuccgaugggcuuaagaaacggcgcaccagaagauuauaucccacaccuggcucgaaggguccuaugcccacggagucucgcugauugcuagcacagcagucugagaucaaacugcaaggcagcagcgaggcugggggaggggcgcccgccauugcccaggcuugcuuagguaaacaaagcugccaggaagcaugaacuggguagagcccaccacaucucaaggaggccugccugccucugugggcuccaccucugggggcagggcacagacaaacaaaaagacagcaguaaccucugcagacuucaaugucccugucugacagcuuugaagagagcagugguucucccagcacgcagccagagaucugagaauggggagacugccuccucaaguaggucccugaccccugacccccgagcagccuaacugggaggcacccccaaguaggggcugacugacaccucacacggccggguacuccucugagacaaaacuuccagaggaacgaucagacagcagcauucgcgguucacgaaaauccgcuguucugcagccacugcugcugauacccaggcaaacagagucuggaguggaccucuagcaaacuccaacaguccugcagcugaggguccugucucguagaaggaaaacuaacaaacagaaaggacauccacaccaaaaaucuguacauaaccaucaugaaagaccaaaaguagauaaaaccacaaagaugggaaaaaacagagcagaaaaacuggaaacucuaaaaagcagagcgcuucuccuccuccaaaggaacgcaguuccucaccagcaacggaauaaagcuggauggaaaaugacuuugacaaguugagagaagaaggcuucagacgaucaaacuacuccgagcuaaaggaggaaauucaaaccaaagacaaagaaguuaaaaacuuugaaaaaaauuuagacgauuguauaacuagaauaaccaauacagagaagugcuuaaaggagcugauggagcugaaagccaaggcacgagaacuacgugaagaaugcagaagccucaggagccgaugcgaucaacuggaagaaaggguaucaaugauggaagaugaaaugaaugaaaugaagcaagaagagaaguuuagagaaaaaauaauaaaaagaaacaaacaaagccuccaagaaauaugggacuaugugaaaacaccaaaucuacgucugauugguguaccugaaagugauggggagaauggaaccaaguuggaaaacacucugcaggauauuauccaggagaacuuccccaaucuagcaaggcaggccaacauucagcuucaggaaauacagagaacgccacaaagauacuccucgagaagggcaacuccaagacacauaauugucagauucaccaaaguugaaaugaaggaaaaaauguuaagggcagccagacagaaaggucggguuacccacaaagggaagccuaucagacuaacagcggauaucucggcagaaauucuacaagccagaagagaguggaggaggcccauauucaacauucuuaaaggaaagaauuuucaacccagcauuucauauccagccaaacuaagcuucauaagugaaggagaaauaaaauccuuuacagacaagcaaaugcugagagauuuucucaccaccaggccugcccuaaaagagcuccugaaggaagcacuaaacauggaaaggaacaaccaguaccagccacugcaaaaucaugccaaauuguaaagaccaucaaggcuaggaagaaacugcaucaacuaacgagcaaaauaaccagcuaacaucauaaugacaggaucaaauucacacauaacaauauuaacuuuaaauguaaauggacuaaauguuccaauuaaaagacacagacuggcaaauuggauaaagagucaagacccaucagugugcuguauucaggaaacccaucucacaugcagagacaaacauaggcucaaaauaaagggauggaggaagaucuacccagcaaauggaaaacaaaaaaaggcagggguugcaguccuacucucugauaaaacagucuuuaaaccaacaaagaucaaaagagagaaagaaggccauuacguaaugguaaagggaucaauucaacaaguagagcuaacuauccuaaauauauaugcauccaauacaggagcacccagauucauaaagcaaguccugagugaccuacaaagagacuuagacucccacacaauaagaaugggagacuuuaacaacccacugucaacauuagacagaucaacaagacagaaaguuaacaaggauauccagguauugaacucagcucugcaccaagcagaccuaauagacaucuacagaacucugcaucccaaaacaacagaacauacauuuuuuucagcaccacaccacaccuauuccaaaauugaccacauaguuggaaguaaagcucuccugagcaaauguaaaagaacagaaauuauaacaaauugucucucagaccacagugcaaucaaacuagaacucaggauuaagaaucucacucaaaaccgcucaauuacauggaaacugaacaaccugcuccugaaugacuacuggguacauaacgaaaugaaggcagaaauaaagauguucuuugaaaccaacgagaacaaagacacaacauaccagaaucucugggacccauucaaagcaguguauagagggaaauuuauagcacuaaaugcccacaaaagaaagcaggaaagauccaaaauugacacccuaacaucacaauuacaagaacuagaaaagcaagagcaaacgcauucaaaagcuagcaaaaggcaagaaauaacuaaaaucagagcagaacugaaggaaauagagacacaaaaaacccuucaaaaaauuaaugaauccaggagcugguuuuuugaaaggaucaacaaaauugacagacagcuagcaagacuaauaaagaagaaaagagagaagaaucaaauagacgcaguaaaaaaugauaaaggggauaucaccaccaaucccauagaaauacaaacuaccaucagagaauacuacaaacaccucugcacaaauaaacuagaaaaucuagaagaaauggauaaauuccucgacacauacacccucccaagacuaaagcaggaagaaguuggaucucugaauagaccaaugacaggcucugaaauuguggcaauaaucaauagcuuaccaaccaaaaagaguccaggaccagauggauucacagccgaauucuaccagagguacaaggaggaacugguaccauuccuucugaaacuauuccaaucaauagaaaaagagggaauccucccuaacucauuuuaugaggccagcaucauccugauaccaaagccuggcagagacacaaccaaaagagagaauuuuagaccaauauccuugaugaacauugaugcaaauauccucaauaaaauacuggcaaaccgaauccagcagcacaucacaaagcuuauccaccaugaucaagugggcuucaucccugggaugcaaggcugguccaauguaugcaaaucaguaaauguaauccagcauauaaacagagccaaagacaaaaaccacaugauuaccucaauagaugcagaaaaggccuuugacaaaauucaacaacucuucaugcuaaaaacucucaaugaauuagguauugaugggacauaucucaaaauaauaagagcuaucuaugacaaacccacagccaauaucauacugaaugggcaaaaacuggaagcauucccuuugaaaacuggcacaagacagggaugcccucucucaccacuccuauucaacauaguguuggaaguucuggccagggcaaucaggcaggagaaggaaauaaagggcauucaauuaggaaaagaggaaguggacaaauugucccuguuugcagaugacaugauuguauaucuagaaaaccccaucaccucagcccaaaaucuccuuaagcugauaagcagcuucagcaaagucucaggauacaaaaucaauguacaaaaaucacaagcauucuuauacaccaauaacagacaaacagaaagccucaucaugagugaacucccauucacaauugcuccuaggaauccaacuuacaagggacaugaaggaccucuucaaggagaacuacaaaccacugcucaaugaaauaaaagacgauacaaacaaauggaagaacauucuaugcucauggguaggaagaaucaauaucaugaaaauggccauacugcccaagguaauuuauagauucaaugccauccccaucaagcuaccaaugacuuucuucacagaauuggaauaaacuacuuuaaaguucauauggaaccaaaaaagagcccgcaucaccaagucaauccuaagccaaaagaauaaagcuggaggcaucacucuaccugacuucaaacuauacuacaaggcuacaguaaccaaaacagcaugguacugguagcaaaacagagauauagaucaauggaacaguacagagcccucagaaauaaugccgcauaucugcaacuaugugaucuuugacaaaccugacaaaaacaagcaauggggaaaggauucccuauuuaauaaauggugcugggaaaacuagcuagccauauguagaaagcugaaacuggaucccuuccuuacaucuuauacaaauuaauucaagaugcauuaaagacuuaaacauuagaccuaaaaccauaaaaacccuagaagaaaaccuaggcauuaccauucaggacauaggcaugggcaaggacuucaugucuaaaacaccaaaagcaauggcaacaaaagccaaaauugacaaaugggaucuaauuaaacucaagagcuucugcacagcaaaagaaacuaccaucagagugaacaggcaaccuacagaaucggagaaaauguuugcaaccuacucauuugacaaagggcuaauaucccgaaucuacaaugaacucaaauaaauuuacaagacaaaaacaaacaaccccaucaacaagugggcgaaggacaugaagagacacuucucaaaagaagacauuuaugcagccaaaaaacacaugaaaaaaugcucaccaucacuggccaugagagaaaugcaaaucaaaaccacaaugagauaccauguuacaccaguuagaauggcaaucauuaaaaagucaggaaacaacaggugcuggaaagguuguggagaaauaggaacacuuuuacacuguuggugggacuguaaacuaguucaaccauuguggaagucaguguggcgauuccucagggaucuagaacuagaaauaccauuugacccagccaugccauuacugcguauauacccaaaggacuauaaaucaugcugcuauaaagacacaugcacacguauguuuauugcagcacuauucacaauagcaaagacuuggaaccgacccaaauguccaacaaugacagacuggauuaagaaaauguggcacauauauaccauggaauacuaugcauccauaaaaaaugaugaguucauguccuuuguagggacauggaugaaauuggaaaucaucauucucaguaaacuaucgcaaggacaaaaaaccaaacaccgcauguucucacucauaggugggaauugagcaaugagaacacauggacacaggaaggggaauaucacacucuggggacuguugugggguagggggaggggggagggauagcauuaggagauaugccuaaugcuaaaugaugaguuaaugagugcagcacaccagcauggcagauguauaaauaugugacuaaccugcacguugugcacauguacccuaaaacuuaaaguauaauaauaauaaaauaaaaaaauaaaaauaaaaguaagaauuuauuaucucucacgguuucuacggaucaagaauccuggcaggguucagcaggauggcuuuucuguaugcuacaaagccugaggcuuccgcuagcagacuugaaaguuaggggcuggaaucaucugauaucucaugcccucaaauaucuaagcuaggggcugggaucaucugaagacucaugcccucacauaucugccaguuguugcucaggguuagcugagaccacagcuagagcuagcagcuggaauauguccauguggccucuccauguggcuugagucuccucacaacaugguggcugaguuccaaagacgaguucugagagaagcuguauuuuuuaugaccuaggcucagaaaucacauaacaccauuuacacugcacuccacuggucaggucagucacaaacccccacccagacuaaaagaaagagaacaacagccuugccgcccucaaugagggagugucuguuacacuguaagaagagcacaggauuggauaaaugugcugaugugaucaccuuuggaaaauacaaucugccacaacauucuuuacaagcacauaugaaacauaagcaaaaauuaaacauauaguaggccugaaaguaguuucaaugaauaucaaacaauagauaucaaagguuucuuauuauaaugcauuaaaguuggaaaagaauuacuaaauaugauuuuuaaaauauguuugaaaauuacaauuuuaugacaguuucccuuugugaauugggauuagacaaggaccuuaacuaaaucccacuggaugaagguccacaucuggagucaaaagagaucacuaauuugguuguggauacauugaauuugaagugccuuagagacaucuaaaggaaaauauccagguaagcaguuggguagaugggacuguagcuaagaggggaggucugagagugguaaguuaucuguaaguaggaaguaacugcaguugugaauauggaugugacuguccagggagucaguauaaguagaaagacaaaagggccuaggacugauccgugagcaaguucaacaucuaacaguuguguugaggaggaugaauccuacauaagagagagaacaguugccagagaaguaaaacuaaauccucaagauucacagaaaggucaagcaauauaaauacuaaaaaaagcccaauaggaaggucaucgaggaacucagcaggaacuguuuuguggacugauggaggcagaauucaguuuggaguugguuaagacagaaguggaagucauuaaacaaagacaaugaguaaagacaauccuagauaagcuuggcugugacuggggaggaaagaguggcaacuaaaggacaaagggcuggaagacgguuuguuuguauaguuuuuaaacagaaaaaaggccgaguauguaucaagguaauggagaagaucuauuuaagaugcagagugaguguagaagagaaaggguaaccaguacugaagguuccugagaagguugaaagggacaggugguaggacugguuuuaaacugagcuuuggccucaccguaaucauauagugucuuaugauaggaacccaugcuauugucuuaaugcacuacuuuaucguguguuuauguuuucucacccuaauuagaaucuaagcucuauaaaauguauggccuuuauuguucaaaccaaccccaccuuacucacacauugaaaaccccagauucuaucccagcacccaacagucauucaauaaacacucaugugucacuuaguaaugggaguauauucugagaaaugcacccauaggugauuuugucauugugcaaacaucacugcauguacuuacacaaaccuagaaaguguagcccacuauacacuuauccuauaugguauagccuauugcuccuagguuacagaccuguaaagcauguuacuguccuaaaugcuguaaguaauuauaacacgaugauaaguauuuguguaucuaaacaucuaaacauauaaaagguaugguaaaaauauaguauuauaauauuauggaaccaugguccuauuugcaguccaucauugacugaaaugacauuauguggcacacaaccauacuuguugaauaaacuaauacaagcagauucuaucaucuuuguguacaucuuuguguaaaucuaaaaauguguguguguguguguguguguguguguguguguguuuguguguguccuggcuauccaaaaugcgagcaagucagaacccaaaaguucuuguuccagaguauagauaucuagacaauagucaggaauagccacucaaauuagcccucucuuucccauguuuuccuugaccuaaaaauccaaggaucuaaacuacaggccaugaaaacauuuucaccuacaguuacaauauuauaccacuucccacuuuccucaugccuaauucguccauauuuuguucuagagcagacaaacucuguauccuucauuugaccuccugcaagacauaaauuaaauuuaaaugaauccaaauacuuugggcuucaguucuccuaaaagaaauaaacauggaaguagagcaguacaggccaguaacacacugauuuaucuugcugauuuuucagaggauagcccuccaaaaaaucuuuacaaaccucaagccucucaauccauggauccaaaccccagcucccuuaaaaauaggucugaauuuaaacaaauaucuuuccgaaauauagaaaccugcuuugauggugacucaucuuaucccaguagaaaccuuucucuggguaccauccaacugcaccauucuuaaggcaacauuaccuggaacugagggauuugccucuauuguugcauucugcagcccucaccugacuuaacugccacguuaaggaauugguuauugaccuuuaagucuuuaacaauuauuuacauaccuaggaaagagucugugcauucagguacaagaaugaagacaccgaauaaauucagcccucguuuucauuuuuaugcuacguucagugagcuguuacugcagacaaauuauugcagcauucuuucaaaugauagccaauuuucaacuaagagaagauucuuaaaccccuuucuaaaaccuuuuccugcauaucggugaaaaccaggcaguuggaaaacacagcccugguuaaaccacauaauaauaaauuaauacuuuaaacacauggaauuauuuaagaaucugcauaauaauuuaaacccucauaagacauagcagcaaaggccccaaaaaccuaacacuucucagauauauuccuagaaguuuuauuucaauuuauauguaugcauuucuuacagaauauuuucagaauuucugaaacucagauacauuuagaguccagggaggugaccagaauaauucuuacuuuuguuauuuaccuggggagcuaaucaauauuguuaaaauguaggugaaagucuuucuauuugaccauaaguucagcaauaauacggaccacaucugucuuguucuauauuaaaucuacaucuucuagaacacugucuggcacauauacuccguaaaauuucuuuaauaaaagaauauuauaaguuuucacuauuacuaggaaugaaaauugauugcaaauuauuaaggaaagguuaguuuugaguuuuguucuugguuuucauucauucucuuaauuuguaccccaugcuuucacaaaacaauaaguuaucucucuacugaagccuacccuucuauggccugagacacauacacacaacacgacaugcccuugccacaucuauucaaugcugucauauuugccaugcaucagaaaaauaaauuuaccaaguagcagaagcucuggaaaaucauuaggugacaucugaggagcagaauaccaaucagccaauaauuagcaucugaaaauucauagagucacagacaaaucaaauuccaugaaaucucagggagcuuggcucccugacccuggcuggguuggugcccaggcaauggguaagcaguaaauugugccaccccaacaggacuggaaggugccauggcuagucuaaccccagggggagacauucugacaauguggcauuugcacagggaugcccuaacauggccccaguauguuuucucagaacgggaugacauuuuaagucaaauagcucuguucccaauagcacagguccucucccaaacucuaauagccugaauuugagaaaaagagguucaucuuggggagaaacugauguuuugcagaugcaauauuaaaacaauccauuuauaaggaaggcaaaaccagauauucaguguuuaacuucauuuauuaccuuuccaucauuacauagaccucagauagccuuagacuuaaaaagucauucacauuuaagcaaaacucuguuccuggagcaucuacacuggauacuuuucaaugaaugcugaaacugguuauaaaguugugcuaccaagaggcaugaagagugacugucaguaccuuaccaaaccccugcugacuggaacaugcaagucaguccaaggaugcagggccaccacuguuacugcugccuccagccuaacuaaggucaccuuuccugcaugccugccucauucuaaaggaagaaaacagagagguuggagaauaccagcuccccauuugguuucuacaguugccaacucuacccacaugugacuuggggaaagcacccuuaagaagagugggguccaacguccaaccagacugacccagccuuggggguaaacauuccaccuccaccacguggccugugugcaccugauuugaaucugcuccuacccugagccaagggugaccauucugccagguccccacuccacugcagggucaggcagcagccucugcuccuggcuccuggcccagugcucggauggcccagcaacgucacugcggagagggagucugguugugcccuccucugaacucuccaucuggaagacucucuagucuccuucccucucauuuuuaaucugacagacacugcggacagggaaacucagagcagaccaaaguucaucuucccuuuccugcuucauggcuggcauaaucacaggggcagaacaagguuggcauggaccaggaugccaggaauuaaaugagggucccugaccacuggaacacauuaguccugccuuccaaagucuuaauuagucuuccugugccuggcacaccuaccaccagggagguggccggguaaggugccaugcucacagcaaguauucaacaaaauauugguagagaauggcggucacaaaugccugcuggcucauggcuuugcaacaacagucagcucugaggucugggcaccagcggcaagauuucugcucucuuuacuaaugcagacaguucuagcagcguuauucugagugauauucagccaccagcucaauuuggaagcaaaaugaucuuaacaaacaguggcagacuugauagacaggcugcugagccuggggaccaaaacaaaggaugaaaagaaaaagaaaggaaggguugaugacaagacgaggagugggaaaugaauacugcaaagaaaaaugaggaggauuacaguacuagauacuucaguccggcaacucugaaaugagcugugaacauaacaacagacucaaggguggaaacaauggggggaaucaaggcaacggaacagggcagcaucugucacgaauuuugaugcugggacagacuuagcgcuagcaguggaauagauuugauaguaaguaauauuugagagguuucaaaagacaaugggucuuaauucuguccuguuuugcaccucuugaacuacagugacauaccaaaauuugcuauuuuucuaagaggacauugacagauacaaugaaaauugugaauacauuuuuuccuucugcauucauuaucucuggcccuuauccacaggccuauugcagacuaaauuggauuuuggaucacugguacugaggugcugcaauuaauuaacaauagaaacauaauauuuauauccaggccuaacaacaucugacauuuaaacuauucugccagucggacaaauuccauucgacaaauuuucauuuuaaugaacaugacagaccacaguuugcaugauaggccaagcagcagaacagaguugaccucuuggcauguguuuucaaggacugaccaugcuccagaagaaacaaucugagaaacugucagaauaacagaaagaccagauccccaguuccacccagacagaccaaauacauaccacccucaugucccccagcacagauccuaguaugaaacuguccucauuucaugugcgagcucaaaguuaaauacuuacugccccuuguaauccacuggauaauuuuucuaucuuuggguugcugacauuuucuuugggguacugaagucccuuagcccuuccuaauuaaaaagugauaaacauuuuugcaaggcauccaauaaugugcaaaguacacaagaguuggaacugaugcagcuuuuucaguuggcacaaaacuggccuuccacauuuugccagaugguguaucucaguaaguccccaaucccugacucgagugaggggcauugucaauaugaugcugaagcagagacuaucuuuaaaugcuaucuuauuuugcauuauacuaacacgaugggucuaacacuuauucuugcugaaacuuucacagcuaaagaaguuuucauucuucugugacucauuauucaagccaacagaauaugauacagauaaggggaaaaauucugccccucuuaagaaccauauaaauuugcuggaaaccaaugucagagagcagaucucccagcaagacuucccauugcuccucuauggguuacugguccaaagcacacugggugaaauaguauguauuuacccaagcccaucucuacuaccccaaaaacguggaugucaaggauagagauaaagaugaaaaaugcaaagacagcaaggcagauagaagcuuaauagaucugggaaauaaguaaggucagugaaaaacaauauauuguagcugggaucccuaagggccguauaguucuaguucacauaucuacaacauuccuuauucuaguuuuuaugucaauucaaaagaacugaaauaaaauuccacuuuaaaaguaauacuucuuuggaguagggauuugguucauggguuccaaucucagcaacugaaaugacuaccuacaugguaauuuguuuucaagcuguggcucugacuagacccaaaaugguaaccaugcuuauguuacuauuuuauuuuauuuuauuuuauuuuauugacauggaaucucauucuuaucgcccaggcuggaaugcaacgauaugaucucggcucacucugccucccggguucaagcaauucuccugccucagccucccaaguagcugggaccacgggcacaugccaccacacccagcuaauuuuuuuauuuuuaauagagacgggguuucaccauguuggccaggcuggucuuguacuccugacaucagcugauccacccgccuuggccucccauagugcugggauuacaggcaugagccaccacauccagcucauguuacuuuuagauauggccaugauaccagaacauuaagcacugaaaggaugacagcauuuccaccaguguaaccuaauuuagaaucaauaaugugucacucaaaucggcagcauguacauauauacauacaguguggauggacacacacacacacauauauauauacauacauuaauuauaguaauagccacauguuugagguuuuuacaugcaucuucucuuauauaacaccaugagauaaguacuauuaugaacucuguaacacacugaggaaagggcaguuacaguucacugaccuccuuaagagguaaagucaaggucacaggcauguaagcggcagaguuuaagugcaaauccaagucugcccuuccuccagagccugugcucuacacaacacaguggcauaugacagcauccgcaagggaaacagcaugaaggaauugauuccuuuuggcaacagucaaaauaucuuuuaaauaucagguauaaaacauuuucagaccaccagaugcuuauucaauuuugaaaaaucaauuuuuauggaguugcuaugaguaguuucauguuuguuaaugccugguuauauucuugaaaaaguagcggccucauagagaaaaauauauauauuuuuuugaaaguugggaagaaaaaugagaccuuaacuggauuaaauugaaaauauuugacagaacacaaaugaauagaaucuguaacuuuaacaugccuuugcaggaggcauguucuaaaauggucauaccaaauucagaacacaauagacuuaacaugcuucuuguuguaaacaaaggcauuggguuaaaugaaaguuccaucaaagcuuaauaaccaauucaagugaacacaaaguuaagcguuauauacuuucugcgguuucaguaauagcuaaucuaauaaugguaaauggaggguuauuguugauuccuuugccuguuucauaaauuagauaaagcaacguggaaguuagaguacuuuagaguuuuauuggacuaagugauuuuaaagcuaucucaaaauauaacgaagucaugacuugaaugacugcugaguuguagcuuguuuuccaucaccauguuaguacuuuucaccaguguuaaauaaaaagcuuccuguuaacuaaaacaauucuauaaauacaaugucuaucuacagaaccaaaccauuuaagguaaagugucauugauacaguaugaucugauauucuauuucaccagggccaagcuuauaaaauauuaacuauaagagcagucaaguguuauuuauuucuucugauacaaaacucaggaacaguagaauuucucugcuuaaugauuuuccauagcacauuuccaauuuucuacuacaguuuauugaucuggaauacuaaaacaguuuucuucccugucuaaagaacacaaaaagcccugugccccuagucccaugggaugugccuccaaagauaacagucguggcaucucaucaggcgcugaggggugguaaugagaagcaaggcauuuuccuuacugaaagaaggugcuagucaaaucucaggccuuuugauaacgggaaacacuucccaagccuuugcauuuggagaugaggcuccacaccugcaguucugagagcagaugaguugcccuucacaaaggcagucuauuuuccugcauuuccccuucaugcccugauaugguuacuuucaauuacccugauaguccaggaagaaaaauaucccucucuccauauuucauucacauaauaagaaucugcaagcuguucuguaugacagaugaggacugugugcugaagcaacuuguuccgccugucagccuccgagaacccacagcaaugagauacaaucgugaugacauuacuagagaagaagugggucaaauacauggucacuuuaaaacagaaugucaaccauucuuucuacuucaguaauuugaugcagugguacucaaaacacagacagagagagagaaaaggaaagagagagagaaagagaaaaaaguucaccacuauuaguuuaguguccauacauacacaaaugcaaaugcaaauaauuguuaaaauuacuguucccauauacccuuacaugacuuuuuucauccuccagccaauuagucaagaaauguuuaguaagcaugugguaugagccagacacugaaauggguagaaugcugaaaacagacacagccccugcccucuuagaguuuacagucuaggauaaaggacaaagauuaacaagcaauugagauuaauguaaugaagccugaaaaaaaacgaaguagaagguacuaaaagagcuuacaauauaagaacuaaccaagucuuucaggucaguaaagguuucucugaggaagagacauuuaaguuaaggucagaaguauuagagcagccagauaagaggugagagagaagagugacaaguggaggacuuuucuccucagaauguuuccuuucaaagaaaccauuaagacaaaggccucaggacacaguagaagauauaauggaguaaaugacgccaucaagucuaccauugggacuuauugucuuuccuuauuucaaucccuaguuuagaaaauuaauuuuuaaaaaaaauuuuuaaacauuaguauaccucuguccuaucuugccacauaagggcaaaaguuaaucauaaucacauuuucuugcugaucuaaauauuaagguagauuuuacuuuaaaaaaucuaauuuaucuugacuguacugguuaaaauccauggguuauuuuuaaaaauauguuuugacagcagugaaacuugcagcacauacaauaccaagagcauaaauuuguucaggguauaaguacaugaaaauuaauauaagcaguugguaaaugugacuuauaaaaaaaaagacuguaccaacuacaugccacaauggguggaaauaaagaagaaaaagguucuuuuucucuaauauuuggucaugaaaauucugauuuguucuugcagaaaauuguuuuuggaucauuauucaucucucuuacagcauagaacuuuuuuccaugggaucaacaaauuggaauggagaggaaaaaccggauauauucaugaguauguuugcccuuucuacuaaagcccgagugugauguucggauuauuuucuuuccaaacucaaaauccauucccagaauccaaaaucaauaaaaaugguacuagcaaaacugaggguugaauuuggccuaaaaacucaaugacuaaguagagcuacuaauaugaggagagguuuuuaaaaaaaugucuguaguuauuaaucaccagcaaugacuuuagcagcugcucuaaaguaaacacaaucuacagcuacuuuaaagcaauacaguguaaaaaccaugagaauuaacauucuacugggugaaagguggcagaauaugccaccccaaaauauaccacauuggcauaagaauuauuuucaagcuaaaggcacuuauaaaaaaauaauuuaaaaaaaaaaacagcaggugcaagaaggguuuucugacccucuucuuuuucuucauaaaagcaagagcuaaaaucccuguauggaaaauauucuccugacaccagaaggaaaguaacauucuuaucaucaagggcgggauacugagaccaagagaacucuguacaaacaaaccuuauuaaacuagcucuuauuuuccucgucaccucuccacccaguuaaauauccuggcccaaggcccuuugccuugucacaucuucacaauuuacuacucuuuauccaauuccauauauaaguguucaauucuaacuucaucuuugggucuucauuuccuuaugagggcucccaugucacaaaaaaacuuacauuaaauaaauuuguaugcuuuucuucuauuaaucugccuuguaucaauuuaauuuuuaagcccagccaaaaacccuaagaagguaggggugaaauuuugcuuccccuacaucuguuacuuaggucuuaucuagaguucaaccugaaaggcauauuuuaggaggaauauuggccaaacuggaaaauaucuccaagaggacaacuagaauggugagagguucugaacuucacauaagaaaccuggggauguucagccuggagaaaagcaaugggagacagcaaaacuaccuucauacauucgaugggucauucaucaauaaggccauuccguuuuacugagcacuuccucuauacaagguaccaugcaaggcaaaggagauacagcacugagagagaaagccagucuuuucuuaccaugcggaagggaaaauggauuuucuccaugucacuucacaagauacuguagaguagagcagagcacagauuuuggaaucagagcacuagaguaaaaaccuguacuggguugaaugccauuccccaccccuccaauaugucugugucaaaucccuggagccugcaaauauuacuuuauuagaaaaaaaagucuuugcaaauauaauuaagaaucuugagaugagaucauacuggauugucugggugagcucuaaauauaaugaucaguguucuuacaaaagaaaggcagaugcagacagacagaaaagaagaagauauagaagagaaggccaaaugaagcaaacaguuaugugggugcaagccaaagaaugcuuggggccaccagaagcuagaagaggcaaggaaguuuucuccccuagagccuguugagggagcauggcccugccaacaccuugauuuuggacuucuggcuuccaggacugugaggaaauaaauuucuguuguuuuaagccaccaaauuuguagcaauugguuacaauagcucuagaaaacuaauauaacucccaauuacuuagcuagcuguaguaccuuacuagcuguguuacccauugcuaauaacucuagcccucugagaaccaggcccucauuaggaaacuggagacaauagaaauacucaucucacaggucagagauuaaggagguaugucaaacgugcagcacagggccuagaacaaaguaaguuuucaguacauaauaguguuauuauuaauggauucagauuuacugggaagcuuguguagaccuuagaacaauauaucaacagguguaauaacagcuaauuuaugcaguagggcucucucuacugguaaauauauguagagaccagauaaaucauuuuccagaaauacuggaaaagggauguuuauauuguuugggaggcuggaauaaacauccacuagccuuccuucuagaucaacccaguaaccauuucuccuuggugcaucaggucaagauccuuaggcagguuaacccaguaagggaagugagguauacacaggguuuggcugcuaccuuaaaaagucccuuccccucgcuguaccuuguugucuuuagcuauaaaauaagcauauucugaucaugucuuaguauuuccaacuugaaaaugccaagacacaaugagaaagacuuggaucaaugagauaguuuggguauuuguccccccaaaucucauguugaauuauaauucccagugucagagguggagccuagugagagguaauuggaugauggggguggauuuuucaugaaugguuuagcacuauccucuuggugcuguccucauaauagugagugaguucuugugagaucugguugugcaaagguguauggcaccuccccuuacuauccucuugcuccugcuuuugccauaugacaugccugcucccauuuugucuucugccaugaguaaaagcucccugaagccucccccaaaauggagcagaugccagcaccaugcuuguacagccugaagaucugugagccaauuaaaucucuauuuuuuuaauaaauuacugagucuccuguauuucuuuauagcaaugcaagaauggccuaauaucaucacacacuuaaauuuucugauucucagaaaugaagcaauuagacuagaguaaggauugcuaaggaccaguugacaaaccaggaccaaaccauaauauuguuuuuaaccaguaccuagcaaaaugagaaaaauuuaaaaaauaauaauuuuuuaaaugucuuugcuuggcagaauuaaaaguuagcaauccuaugucagcucccauccuaucucacuuccuaauucaaaaauuauguuuacagccucugaaauucuaaaguuuuggaacugguauaucacagaacaaucuauuaaauuugauuccuacacuaauauucugugauuuuuuuaaaggacauuucagaacuguggauucuaucacugacguguucaaguucaagaauaagaagucauccuuuuagaauuuaaaaauacucacugguaaaaucauauagaacuaaauguucacaacaguaaaauggaaaaaucuaaauaaaaugagucgcuaguaaauaugaugcuauaguuuuacaaaauguuaucaugaagagaaauuggguaacgcauaggcaugaaucucucuauacuaguucuuacaacugcaugugaaucuagaacuaucuaaauaaaaauuucaguuaaaaaauacucacuggguugugugcaauggcucaugccugaaaccccauuuuggaaggccaaggugggaggaucccuugaguccaggcauuugaaaccagccuggacaacauaauaagaccccauuucuacaaaaaguuuaaaaaaaauugcuaggugugguggugggcaccuaugguuccagcuacucgggaggcugaggugaaaggaccucuugaguccagaaguucaagguggagccaugaucaugccacugcauuccagccugggcaaaagagugagucucggucucuuacggaaaaaaaaaaaaaaugcucacugggcucuaaaaguucuuaauguuguuuauuaauucaaacaauggucagauucaaacucaauaaauauaaucaacugugcuuuauacauagcauauggacaguuacuaugaaccauuuguuuggcaaagauguacugaggaucuucuauauuccaggcacuaugcuagguacuagagucugguggccaacucaguucuucccuucacagagaguaacaccuagcuggagaaaaaggcaauaaauaaagagacaacuucaaauuguaacaagugcuauggaaaaaagaaaggcugaggcagaaaacacagggagggauaaggaacuacaugagccauacauauggaaaaugaaacugugaugcaggaaugugcccuuauuuuuuguaugccuauauuauugaacuggcauaaauucugaauaaugaaaauaugugcuuggguugugacuguggugggcucuuaaagguaggcucugcccuucugcaccaauaaaaggagugagaaaaaaaaaguaaaguugacauuugccuuuaacaaauaaggcaauacaagacuguccauauguaaaaguuaaacauacaaugggggccgggcaugguggcucaugccuguaaucccagcacuuugagaagccaaggcugguggaucacuugaggccaggaguucgagaccagccuggccaacauggcgaaacccugucucuacaaaaaaaaauacaaaaaucauccagacaccaugguguacaccuguaaucccagcuucuugggaggcugaggcacgagaaucgcuugaaccagggagguggagguugcagugagcugagaucuugccacugcacuucagccugagggacagagcaagaccuugucucaaaagaaaaaagaaaaaacguauuccauaaacauacaauggacacagcacucugugagaugaaauucuuuaaaagguaugugagucauaauuucccauauaugcccaccaccccuuggaggaggagggguuggcucucuaccuaaacuagaagauaaaacucucucauaaucaaagacaggggaggaccagggaggucuucaagaggagaaacauaccuuugaaauucucucccuucuuagaagauucagaauauuucaaauacugcaaaguaugcccugggagccagucaaaauauguaguaggccagaccacaggacuaggaaauuaagauacagcugccugcuccuauuaggccuaggugcagggccagaauauuaagguuaacuugggcccaguuuggcugaaaagacacaggcuucaaauaagacuggacaggagagcagguaaauaaauagaauauucacauaauggaacauuauauaacagucaaaccaaauaaagcaagguacagaacaauguguauuguacaauaucuuuauauaagaaaggaaggaaaauaacguacauacauauuugccugugugcuaauaaaaguggcuacuaccuuaagggagauggguacaaagaugaggguaugagaagaggagcaagaacaaaauuucacuuuauaccuuuuuauauuguuuuguaaaaauaaagagcuaaaagauuauaauucucauugcugguguuagucacacauuuggagagggcaauucggugguauacauccagguccuuaaaacuggcauaucccuagacccagaaauuccacuuuugaaaggaaguuaucuaagaaaauaauaagagauuuguguacacacacacacacacauucacugcagaauuauuuaucauaguuaagaaaauuuuuuuaaucuacauguaaaauaauaaagaaccagugaaggaaauuaugggccaucuaaacaauccaguaacaugcaacugucaaaaacuacacuguaaaacauauaccguagaauacucaguggcacagaaaaguauucauaguauauuuuuuaaaucauucauuaauuuuucaauaccuucuuuagagcaucuaccagguacuaggcacugagcuaaaugcugauuuaaaaggccaguuacaaaacaguauauaaauggacaauuccauuuuuugugcaucugugcauuuauaacuagacuagaaggauagacaccaauaugagaguagugauuaccugaguggcaagauuaugggugaaauauauuuucuauaaugaacauauauuauuucugcaauaugagaaaaaagcaccacuuuuuuaaucaggcuaacaacucccaggaucaagaaugugucucauucaucucucuguccucucacccccuccugacucccugaauacaaacaugaugcuugcuucagcugcagcaauucuguggccauuauggaaaggccaagaacugcaagauacacucuccuugacaucucugagcugcugaacuaaagccaaagcuaaccauuucuagacuucuuuuuauguggaagaaacaaaccucuauucuuuuuaagcagguuacuugcagcugaaagcauuugaagcugacauaguaaccuauuaaauaauacaugacacauuaaggccaguacaggcaacccagcaaauuucuuugaucaaccagcagaaacugaagacugaugugguuaauugccccacuagcuucuggcucuguauucucuucucugaagcuccugggaaguagagcccaggagaagcuguuagugaggauucgagauccauaggggagcacugcuugcugcaaagaaaaaccaggcagcuacuccuacagcuuuacaacguggcccagcauucccacuccuggaaaugucuccuaagaaaaaaucaugaaugugauuaugcacacgugcaaauacaucagaaaaaauggugaggaaaaccuauauguugaccaagugggauagauuaaaaaauaaugucauguucuaacaguggaauacucuguagacauuaaugccaugggaaaaugcauacaauauauugacgagugaaaacagaaaacaaaacuguauguaaaguauuauccaaauuuagaaaaauguguccauuuucuguuagaaaacuaacagaacaaauaugcaugcaauaaaaacaauggaaaaaaagccacacacugaaauauugauagugcuaucaugaaugggugaaaugcaauguuauuuuauuuuuugaguauuucuauauuuuuuuaaaucuuccaaauuuauuuucuugugcaguugguaagaaaauuucuucuaaauagcaccuucuuacagaauauucugggcccuccgaccaagauguucaauucauccacaccaacuuugucuaauaccugccugcagauccaauggaguuaacaagaaacaauuuauuuuuguguuuuaaaaauagacauggcaacagcuguaagcuaagcuacagaaaaugauaaagaaauuuuauuuccaaauaaauuugcauuguauaaaugcaguacauuuucuuuaauuccauaagguuuugauacugcuaauuugagaaaaauauugauguuuccuuaaauaagucuaauuuguauugaaauucauccccucacuugaaauggaaugaucuugaaaacaauaaaaaugaauguuaauuugcuaugucauugauaaaagcaauuccuuuuauauccuuguccuuauccauuagacuucauuuuacagaaaagguagcuaucaggcaggucugaccuuuuugccaccuaaggacauuagcuauuagagcucaagcucccuagccggauggccuggguccauaucuuaggcccaccacuugccaacuggguguccuugagcccuuguuuaaccucucugagcuucaguuuucucguguguaaaacaaggauaauacaaguaucgacuccauagaguugcuaagaggaugaaauacgaaaaucuacauaaagaucuuaguucagugccuggccauaguaaucuaauuuaaaaaaaaaaaguaaggucucuuuuaacuugcuuucaauuuuuaugugcagauagaucauggaccugaaauuuuagguccuaaagaggcccaagcauccugguuuaagaacccauguuggaaaaauuagcugggugcaguggcgcaugccuguagucccagcuacuugggaggcugagacaggagaaucgcuugaacccaggaggcggagguugcagugagccaagauugcgccacugcacuccagccuggaugacagagcgagacucugucucaaaaaaaaaagaacccauguuggauacagauacuugacuuuuaaaugcagacucaguaucauuuacuuagcguucccuaugauaaaugagauguuuagggaaaauguuggguuuuuuuagaccacuggaaauugacuucagcauguguauuagagaauguaacuaccccauucaccuuguccuguccaguacuuucacuaaaagcaagguauugugaccaauaauaaaaucauagcuaaaauaaucacuaacaugucauuagugcuuaauauguaccagaaagugcccuguguguuuucauguauuaucucauuuaauccucacaacuaaccaaugagguaaguucucuuacuauccccauuuuuagaugagaaaacugugguauaaagagccaggaaagugcuaagucaagauauaaauauaguauguaacaauauacuauauuuacuauauguauuauaacauauacuauaauaauauauuuuuguuauaauauauaguauauuauauuauauguuauaauaauauaauauagauauauaaauauaaauauauauuauuguuauauaauauauauuaugguaauuaguaauaauaauaauaacacagcaucauuauucaaucccugugaccugccaaaugcagcucuagaugccuucccagugacaucucuuguguugacaacaaucuuuuacuauucuuauuuaauggaugaggaaacugagaacuuaaaugaguuacuuaagaugagcuauagcucugacugguuccaaagccagccacuccagaauuacucuucuacagagggcagggaaaacagcucauuaggucccugaagugcucuacccaggucacagaauguuggagaggaauaggacuucagaaugaucagauccaagcccucacuuuacagauguggaaagggaggcccagagaaaagagacuugcauaaggcagugggagagccagaacuaaaaccugggucucccaguugacaugauguagccaucucauguugagucagcuaucucaggcacugugaaagcaggaagggaaagcugacagcuucagagugaugacagcagacuguccucccucucucugcucccugcugacccugggacugcugcauaugcuuccuggcccacucagaguagcagcaacaugacuugagaagaggcucuucaggagagaacccacaaugaagacaggaagcacccaugcccuuacaugaucuaccuagggcccauuuccaauggaaucccccugaaauagaauuaaagaucaauggagauggaggguugccucagacacaugugggucucuuuuguagacauacaacacaaccuaaaucuuugagaacaugaucugacucaacaaauuaccugcauuuuuucugauuaaauguacauccaucuuaguuuguauacuggauaaaaauaaaccaacucguacagaaaguuuuuuaaaaauagaguuuugggguguuuaauuaaaaaugcuuucaguauuauguaauccuugaaauacaacaguuguuuacucugcuuugauuucuaagcuuuccuuugaugacagauauuaauauuuaucauuuuucugauguuggacuaaugagaaucuuaaguguuuaugagaagccauuuaaauauuacaguacugcagauauguuuguuuucugauuuauauuccugucuuuaacaucaaccaggauuuauuuuuuugugcugaauccuggguuguuguucaucaacauuuucaguaaacuuuaaauagccagaacugaugauuucuacauuuauuugauggucaaagugaauaugaaacuucaccaaauaacauaguacuaugggaaagguuuaguuaugauuuauaaaguaaaaacuggaaugcauguauaacugcuagccaggaauagaguaacauuccagguuuaaugacacugaucucaggucauacguauugagugcugaguauguaucaggcacuguguagaacauaauugaaaucaaugauuucacuugauucuuacaacagcucuaagagcuagguaguauuaucaucuccauuuuacaggaaagcgaagcucagagagguugagcacuucacucaagaugacacagcaaaugagaggcaaagccagaagugaguccucagggucagauaaugggcucuuauuuauaauuccucucucaagggucccucugugacuccccaguauuugaaaaaucuuauucucuacaaaguauaaauaacccaucugcacagagcaacagucuucagacaacccagacuuucagaucuugauggcuaugaugagucacaccucauuuuguuuaucauaggccaugcauuguucuaugcauggagacagcaauaaacagcaccaacaauugucccugcccucauagugcuaucuuucuagagagggaagauagauaauauuaacacaauaaacaaagcauuaucaccauuauggggaggaaacgggaggcuaugcaaauucagagaaauaguaaaaggggaugaagucugcaguuucuguagauuucacuugcauauacuccccaugcagccaagacucagcuaaccagagaaaugacuuacaaucaguaacagaagauggcccagaaguagugugguacagugcaaaaucuaacacugaauucucaguuagggaccugacauaaaucacucacccugcauaaggaccaggugcaggggagacagccaucagcaaaauagccacuaccgcugcccuucauagagcuuacaguccaaagggaagagaagcauugauuuaaaaucaaagguuaaauaaaagcuguaaaaaguauaagaaggaagcaaaagacacaggagcuaaccuauaggagacuaagaaaggucaacauucugccaauugcacugucugugacccacaccaagucauuuuuccucuuuacagccaguuuuucaaauaugcaaauaaaggagaguagacuagaugaauccaaccagcuucuuucaagcucuuuuuaaaaaucucuugaagccaugauucuaacauauaaaaauuauguaucuccucuucuuuccaccaauuaaaagaucccaaacugucagucccuuucauuguauucaucugccucacuacugcuagggcuuuguucuugauuuucacugccauuuggcagagaagucaaaucaggagggauauggaugugauaccgcauuagggggcagaaguggguaucgcagaugcucugaucagaaccuagugaaggaaaugagaaggaauuggguuauacaaauggaaccuaggguccagagaguguauuaacagguaacaaauuagccuguggagauaguaggcauuagggaagcaucagccaggacuguaacucauguucuggccaaagggaggggaaaaaaaaagucuagaaguaguggagaagcagaugaguggaagagaggucuagacagcaaacagcauggauccaaccacaauacugagauccagggacaggagcauuacccaugggaaaaaaauccaaauuccauacuuugacuucaaggcccuguauggccugggcccuaucuauacagccaauuucaucugaugucagucucccuuucccucucuaugguucagccacaggggccuucuuuucucccuuugaugguguuaagcucuuucccaccuuaaggccuugguauaggcuauuccuucugccugggaccccauucuauuaauaccagcucuucauauggccagcucccucucauccuuuacuuaggucucugcuuaauucucagcucuuucugucuggccauuuuaucucaauagguuacucaucccucuuucuaucacaguaucuuauaaucuuccuucuuguacuugacauauuauuauuacagguguuugccuauguguuaucuguccccuucacuagacuccaugagggcagugcugauauuuuauauagaucaucccauuuaauucauaacaaucuacgaaguggguacuauuauguccauuuuacaaagagaaauaaaacugcaaagaaaaacaacuggccauauauauauauauauauauauacacaaauucuaaacaauacuacucauuacauuaaaacagaauggcaacuuaguagaagccacaaaaaucugaaaucuuuuuauuucaaguguagcccauggaccagcaacauauauaucaccuggcagcuuguuggaaaugcaaacacuucuggccucaccagggcccuugcauauaguuccagcaguccucaacccacaggaguuggacccagcuguuccaucugcaacaggaagccaaacacagcuaacaccucuaggccagggaaaccuuggccuguugccuuguggaaguucaagaggcuagaggaagccuuaguuuagaggaagcuuuaucccugcucagaggagccaagagagggccucagcuguagauuuuucugaagcuucuuggccuuguuuuuauccaccaggcuggcagaacccagcaaaugggauuucaaacuacaguggcuaccuguuuugcuguaucccuagugucacaucccucuucugaagguaucagcagcucucguuaaccagggccuuucuguguguacagcccugcaagcuuugcacagcacaacuccagcaggcaccagucacauauacucugguaugaaugguggccucugaugcuaagaauguggcagcccuggcccacuuccucugggugaaucucuccucucccagggugggcauuugcuccacaccuggccacucacaguaccccuccaacuggcuauagaaacaauuccaagugguaggcauauggcccaagcuagaacuccuucaaucugcuguaaauuuugagguauuaugggcaaauagauauauuucagcccauacaauugagucucucuaaacuugauggaaaaaaucugggaucuuuaagguaacauguuauaucugauuauuaagaugggaauuuaagguaccuugccuucuaauggaaauuuauguagccaauuacagugcccccuucuuuacauaauuuuaacccauugggauugcuuucuaaccagugguucuuggcccuggcuacaaguuagaaucacuagagcaugucucguccagaucaauuaaauugggaaagguugguggcacaggccuugguaccucaauuucagcugcgcuagacucugacuacucaucuauguaaggcgucccaaaguggcauauggugugcuacauagucuaugcuuccaggcaggccaacaaagugguagacuacauccagugaaaaucagaccugccacuuucugaugauguaguaacugacaggcagagacuaauuuuacuuacacaaguggcuguaaaacaaaauauuccccucucucuccaccccaccauuuuuuguuguucuaccucucccacacucucugcauuuguuuuaccucccucuugccucuccugcucucccuuggauuucuugccagggucauuccuagaagagauugaacuggaaucgcuagugcuccaggacugaaacaaucuuacucuaagcagguuccaacccuucccuccaccuguccucagggcuccaaacgcauagguaaacuugugcuucugggcacagcuuaaacaucuacugacaaaaccaagcagguaccguccuucaguuaauguggaguccaaaggcagcagugaguuuuguguuuugcuuuguuuuuucaaaacuaagaugugggaagaagacuucucagaaaauaaaaaucuuguucuuaccacauuccacagacuucagugauuaaaugacuguagauuguaugcuccuccagccuggucuaacuaaaauauucaugcauuaaaccuugugagggaguacugauacuucaacauuaucuaugaugguuucuaacuccaguagcugugagucugagaaacugcaaaauauacugaauuuuaauaggauucugauuguuaagaaaaagagguaaauccauaacaaagaacacuaauaaacacuuaaaaagacucagcaagagucuuuaaguuacagaauccugaaaauguguaucuuuugugaacuucucaagcaguuucucaauuuucucuucuauucccacuuauucaucauuaaaagaaaacacuggcauacaaacaaaauaccccuaaaauaagugauuuuuaacugcaguuaacacucuggcaaaaacacucuuuuucccacccuuucucuuuuucucuguauggagugaacagaccagaaaaguaaggccacuacauugugaaauaaccuccuggugggcagaaagguucaggaaaugcugaaaaaugaaauuacggugcuggguaauauauauucaaaccaagaauguuccuggaccguugauauaaggguuuaaauauaaauauaaauacucaaauauaacuguaugcauuuucuaugagucagaaaaacaacuuuccaaaggaaagggucugaaaggggaucagaauaugcuaccccaaaauaugccacuuuggcauaaggguuauuugaguugaaggcaauuaagaacagcagauucagaaaaaacaacaacaaaaaaaaaaacaccucugcccuccuccaucuagcuaaaagcagggcacagauuuuccuuuguaaaggugacauauuuucuauaaauaaagguuuuccccuuucccuaccagagagacuucuuaccugcauaaacaaaccuuacuaaacaaccuucauuuaccauacauuuuccuagucauuuuuucacaguuuaucccccuaccccagaagcccaaauccccuuguccuuuuguaaccacccaacagguucauuuugccugcugcccagaugguuuauccagagagaggaauugcaacagagaaagaauuuaauucaugcagagccggcugaacaggagaccagaguuuuauuauuacugagaucagucucccuggaacauuucagagacugggauuuuuuaaggauaauuugguggguagcgggccaggcaguggggagugcugaucggucgaauuggagaugaaaucacagggagucaaagcuguccuccugugcugagucaguuccugcauggaggcacaagaccaaaugagccaguuuaucaaccuggguggugcuaucugauccaucuagugcaagguuggaaaaauaucuccagcaccaaccuuagguuuugauguuaucccuaggagcaacuggggagguuuagaaucuuguggccucuaguugcaugacuccuaaaccauaauuucuaaacuuguggcuaauuuguuaguccuaggggguuugggaaaggguuguuaucaucuuuguuccaaaguuacacuauaaacuaagauccucccaaaguuagucuggccuacgcacaggaaugaacgaggacagcuuggagguuagaggcaaguuagaugcgguuaggucagaucucuuucaccgucauaauuuuugcaaaggagguuucacuuugucuaguuucuucuccacauaauauauaagcccccagaccuaaccaccucuuuagggucuucacuucuuuucuaugaaggccucuguaugcauauguaauaaaugauuucuccucuuaaucugucuuuugucaguuuacuuuucagugccccaggagcagaaccuaagaaaguagagaaaggauuguuuuucuuuuuuccucccucacaaucaccacauauauggauuaucaagaaaauuaaagguauguaaucaaauuagcuuaauuauucuucugcuuugacagaggauggggguaggaagaaaacuuuauaauaggcagccuuucuagaagugguucauuucaaugguucauuucaagcuacucaauuagaauguaagaauauuaccaguaaaaaugagugguauuuuaucugaacaacuguuuaaacccuuucaauaacacugccauagaucaugaaagcaugucacugaguuucuuuggaacacaguuuuaaugggauuauagccccccacuccacccccagcuaugaggaaugaggcaaacuaaguacaggacgagaaacacaaccugaaauucaauauaaggaaaacccuuagacaagcacagcaagagauacaaggaggguaggggagaaagagugucccugguaguuaaucucaaagauaacuagugcaaaauuuauaguuaguucaucaaauuccaugacagcuuugugaugacgcuuuucuuucauucccaaagccuucaaaaugcuacuuucuagauauuucauuccccacucagaccuuuuaccuauuggauuauaccugauucauuccacgaugcuguguuauuagaaucagugguuuucaauguuaaaugcacuuuagaaucagcugcgaaucauuccacaaugcuguguuauuagaaucagugguuuucaaucuuagaugcacuuuagaaucagcugggaaauguaaaaaauaaacaaacaaaagaaaucacacaaacaaaaaaaacaccugcuccccuccccacucuuucgguuaucuggaugggaccagccccaggugauucuaacuuacagccaagccugagagccacuaguuggaaagcaauccaaacaaauuaaaauuacauaaugaaggaauaaacuuacauuaggaggccagguaccucgaauucccauccuaauaaucagauauaauguguuaauuuaaggaucccagauuuuguccaucaaauuuagaaagacucaauugcaugggaugaaauauaucuauuugcccaugaugggguucaggacauacuacccugaaauauuguaagcugaaugaauuugagaagacagcagaagccagaaggucagaggucacucucugaccuuccuucugcccucucugaagcaggucauaaaaccuaggaagaauuaucuggccuucuccugaagcaggucuaagacccuccugugaaagguuucucacuucccauaccuggaaugaaagaacauccuuaucucugaaaacaaaggguuacagagaaucugaacaaacaggucuugcuauguuuccucccauuguuagcucauguuuucuuauucaaucauacuucuacacaacuauguacuucuucaucaaaucuagcauaaaaaauacacagguuuaccaguuuugggggucuucauuccauuaugaagaauccugugucacauaaaacuuacguuaaauaaaucugugugcuuuucucucguuaaucugucuuuuguuacaggggagucaaccaagaaccugagggugaggaaaagauacuucuccuccccgaccccauaauacgccaacuuuuacagaggauugaagaaauuccaaacaucauaucauagagguaagcaaaaacaguagaauuaaagguuaucuaaguccucuuaguauucaaaauaugauaaacaaggaaacagagcaggaugcaucaacuuguguuuuuuauugacaaugauaagaauaaaaucauuagcuaccauuuauggaguaccaguuacuguguuaagcauuucaauggguuaccucacugaaaacuaaaaacaucccucugcaauagaaauuaucgcccccauuucacaaaucaggaaauugaggcucagagagauuuggacacuuuccccagagucacacacauagaaaguagcagaaccaagauuaaaguccaggucuuuugcucuaucgaguccauucucuuaacuacaucaucugucaccuagaccacugaagaguauccuaaguacuugcuacucaaaggacgauccauggaccagcagcaucagucuguuagaaauacugacucucugauccuuuccaggucuuuaauuuaaucagaaucugcauuuuaagaucagcaggagacuuguaugcacauuaaaauuaaagaagcacaaacauacaugcuuaucccacaucaacuauuaccucagauaaauucauuauccauaaugcauccauacuuuuuaaaaccugauuuacuugacaaauaaaaauuguauauguuuaugguauacaacaugauguuuugaaauauguaucccauguggaauggcuacaucaagcuaauuaauaugcacuaccucaaauacguauuuauuuguggugagaaugucagagguguuugaaccagagcaacuccaucuucaauaggggcugaguaaaauaaggcugagaucuacuaggcugcauucccaggagguuaaggcauucuuagucacaagauaagauagaagguuggcacaagauauggguaauaaagaccuugcugauaaaacagguugcaguagagaaguuggcuaaaaccccccaaaaccaaaauggccacaagagugaccucuggucguccucacugcuauacucccuccagcgccaugacaguuuaaaaaugccauggcaaugucagaaaguuacccuauauggucuaaaaagaggagucacgaauaauccaugccuuguuuagcauaucaucaagaaauaaccauaaaaaugagaaaccagccacccucaggacugcuccgucuauggaguagccauccuuuuauuccuuuacuuucuuaauaaacuugcuuucacuuuacucuguggacuugcccugaauucuuucuugcauaagacccaagaacccucucuuggggucuggaucaagaccccuuucugggaacaagaacacuuaaagucuacacucuaaguaaucuucaauaauacaauacauagcuauacauccauacuuuuaugaaaacaaauccaacaauuucauuuccccauuuaaggccauuaaacaauuucccaaaugcccucggaauaaggucgaaaugcagguaaccggacucugcauaguauuacucaggcucaccauucucagcaaacuaacacaggaacagaaaagcaaacaccacacguucucacucauaagugggaguugaacaaugagaacgcauggacacagggaggggaacaucacacaccggggccuguugugggguagagggggaaggggagggagagcauuaggacaaauaccuaaugcaugcagggcuuaaaaccuagaugacagauugacaggugcagcaaaccaccacggcacauguauaccuauuaacaaaccuguacauucuguacauguaucccagaacuuaaaguaaaauuuuaaaaaaauuuaaaaaaagaaaaacauaucuauuacucaggcucaccucugcagccuuauucucuccaccuccuccagccauugauuuucauacccuaagcacacagaccuucuuucugcucaucaaaucccaacauccccucccucccucccuccuguccuccauuguacuagguucuucccugccgagaauauacccucacucaccccaucagugccucccuaccagccccauuuacugcucucaccagagcagaugcagugccuggaacagagcuaggagcaagauaaaugugcugaauaaaaauauguuuaggauacugagggccuccgcuguuuccuuuguccuucuccucugcuguugcugugauccucauuccuguugcuccuucccuguucccugcaucacuucuuuucaguaacucaccuccuuaucguaaccucauggcuauugaaguugucagcuuuagaaagaagcacugccacauccccacggucauugccccaggauuacucaccagcuggaugacaacugccucacucuaacccugagccuccugggauaggaccaauccuuucuagagauggacagaaggccccacugacagaaacaggcugcuuuuaaaucaaggauuuaauauauagguggaaccauagaucaggggccucucagcaggcaguaccgagccaaaagcuucacugucucucugcccacacaagagagugucacugugcugacaagacagguuaucaagaguugugaggaacuucauauuuuaaaugugaugaccaagugugcuacucuaagaaaacaaguggcaaacaaauccuuuuauaauauaaauaccugcuuaaaguuuuaaaucuugaggaaaugugaauuuucauauaucaggcuuacaauaacaaaaauaagagcuauuauauuuaucuauugacugcaagcuguuaagagccugacaacaugcucaaagcuuuaaacacacuuucuucuucaucaucacugugagguagaaaugcuuauuaucccuauuuuaagagagaaaaccaagggcuaaguaaccugucuaaaaggcacagcugggaauuaaaucauggguccccagacaaccccucuacugcuucucugcuaugucuuacuauauagaucacuuucucaucugagaagucacagauauggacauucccaaagagacaaccccuuggagaaugaucucaaaggcugagauuuuucucugcaauguacauguugaaagcaaaguaaccuccuacaucuuauauuucaaagcugcacuucugcauuaaaagaguaaacagauucaaugaagagaugugggaacagggugcuuaugaaugcaaugccacaaguacuuuuucagugucuacugguggucaggcacugugguggaagcugaaugaucagacuaucaguugggagagcgugggggugggggcaugggggugaugaggagaacuucucaaauagacuguuucaggaauguuuagccaauaauucauaaaacuguuacuuuauuaccuaacuauauggaaaucaucuuucagaagagaccagaguuaccugccuuauuaucugugaauacauaauugaaagggccaauaugucuuccaaaaugaaagucacaacuugauagauuucugagaguucauauuagagggucagauuuuaacaugugaaugcaaacauagugucagaauuuguucucaagugucugaaagaacaaaagagaaaagaguaaugggagccaaaaccagacuaacuuccaaaauagaaacagagcauguugaaguugcauaaacacacaaauaaagauggggacacaaaaacauuuccuaaagcauucuaucaaaggcugcaggaaaaaggccaagacaaggauaccaaauagaaaagcauaagccuaaaaagguuauccacacuacugugaggacuccagaaaccugccuucuugcagaaacgggauacuuuugacaugagggcaugagaugaagauugcagacuacuucguaacacacucuccucauuuauaaaauaagaguuagauuagauuauuuauaagguccuuccagucugaaugcauuaaguccuuaucaucuaugugguccuugcaccuuaagagagaugaccauauaaagaagcucaaaaaacauuuguugaauucaugaaguauuacaaccuuaccaauaauaaauaagauaauuuauaacaauugguccuggucuguggccuugaaagagcaaauuagaggagaaaccauuaucuaaagagcuacacaucugguguuccugcuagcugacugcugguggaaugaaaauaacccuggacuugaaaauaagaugcuugguucuagucuaaucucugacacaaaccaacugugugaccuugggcaaacugcuuuaccaccugggccaguuuccuaaucucuaaaauaaagguauucuaaaacuauauacauauauauauggaaucuuuauuauaggccaagaaguguuccaagaucuuugcauuagaauuaaaugaucucaaagguuuuugcagcucaaauguuuaguaucuaaguacagaggcagcaugguauaauuaaaagauuccaaauucuguagccagaaagguuggacuccuccucagcucuguaagguaaggucuuucucuaagcagagacuguuaagcagaagggcuuacagucucaguccuuuuauucaccaguguuuuaacuugaacaaguuacuuaacuuuccuagccuuaguuuucuaaucuguaaaguugauauaaaaaugguucucacucucauauagcuuuuaagaggauuaaauuauaacacauauauuuuauugaauauauauuauauugcuagcuguguaaucaugggcuaucuucucaaguuuuuucucauauacaaaugggaaauguaguauuaaaaagagaucaugugaacagguucuaaauggucaaguguuagugguuuuggaagcauguacguuaauacuuggaacaccguauacaacaaucccauaucuaacacuuagaacagcauaugcaaucaauaacaacacacacacacacacacacacacacacacacacacacacacacacacacacacacaaacccuagacuucuuucuuuacuaaauauuucuaguccagguugcagcagguggacacaggccggcagccaugaacgcagguccacaugggaguuguaguuccgagucaagcggcugcucuacagaacggcuagaagcgagacuucgucucccaggagacaucucgccgugcaaaauggcacgccacgagguggaguaccugcccgacgagaaacaagaggcgggacugcaacucccagaagccuccgcggccaaggccucaggccgcaggcugaagccaaggagggagaguucagguagauccggcuuaacaucaggugcgaguagggaccacccuugguagucugggcccggcccaggucagaaccuuacuaaaacaaccacugugaguauuuucuauuggucccagcacauuucugagagaccagaauaauaauagcaguaaaucugcaagugguaaacuuucacaagcauaaccucaauuuagauuucggcuucaggcaacauccuuuggccacuugaccugggagcauugagcuccuuguuucccagauaagcgcugugaguggcuguuccaagguaacacagcgagggcagaaugugagccuacagagaaaucugcagaugcaucucaaguuccacuaaccugccuccuuaccccccaccaccaccaacuuggauauaccuuuaaaauuccccccuuugacgcuaaaaauaaaaacaacaaccauaaaauaaguguaagaaaguccgaccaaguaccgaugaguucucccacaacaauaaauucgaugccucuuugccuguuuuugaaguaguaauguaaaauuaucucccaaaaugcugccuucucuauacuccgguuugcuccuguccugggcacguguucagcaaccccuuaggggaauccagagcugcguguuuaacacagaccuguugggacggauuuucgcuacuugucuaugaaacugacgaaccaucccaaaacggcgggugccgacuacacccccagagccaagagcuguggcguccccggacccgcuggcguggccccgugccucaguuuccccaauguauaaacacgguggaggaggaacggguuagggcuagggucggugcuugggaauuggggggcccgaguccccacccugagacccucguggggcggaagaguacucgggacagaagcccaccgccccgugagcggcgccggccccacugggcuccggggugaugaccugacgcgcguggaaacccagacccgcgccccagaaacaguauuccacuugggcuugccuccccgccccuaccuuccaggauguugacagcugggaaugaaaggcagagggagggagcgcggggccggagcgccgccugggagugugcccacuggguggccgccugaggg

SEQ ID NO: 21508 - RNA, 169400 nt, Homo sapiens
uuuaaaauaaauauauuuuauucuuugccaggagacuccauggaaaaagguaaacaguauaugaacauagaaagcauuguuaaacaaacaaucucaauguacaaacagagccagugaaaguacaucacagacuugcuaauauaucaaaaaaaaaaaauuccacuagugcuuaaaugagaacuaagaaacugacacuuguaucuguuaaccacucuaccacagcuuucacucugcuucauagugauugaacaaggucaaaggaggcagauucuaugccuguuucuuugggaguuguuaauauuaauuagccccuuggcaucaagaaggcuggaaaaaaaaaucccaauaucaggcaugaaucaggaaggacacuagaguuacaugguccaggugguagaccagccugcuaauuaucccaugaaauuucccuaauggcuugugaacaaguaaacaaaaacuuaacacugaaaaguguuucugccuuggaggcuaucauuacuguaaaaaaauuuuuuuuaacuaacuguguaguuaugucauuaaacaaguaauaaaccacuuuuaauuuaaagugacauuaacaauugaacaaaugacauuugauuaacugaacuggcaguuacacugauacagaauucucuucugcuagugcagggaauuuguauacuuuuacugggcaacaugaaauaaaagaugcaguuugagagcaucagaaagagcaaagacaagcuuccauacuaacuaaaguagaauaucuucagccuuaucuugucauacuguacaauaguccugucaauaguccuguuuccuuaccuugaugucuugacuauuccaugaaagcaagacaguuaucuuuuugaaccuagguagacguguacaguagucuauuucauaaccuuggugucaugguuauuuugaguaugcaagacaaaaggaaagcaccaaacauacaguauagaaagaacagagccauacuucuguauguacaaagucuucagaaacuuaaccagggguaaaucauuuugacugggucuuugccaugcaaucuugaguguucaaagaggaaaauagaagcuuuuaacuaguuucugguugcaugaaauggcugauuuuuuaaaauuggaaaaguuuguauuucuagguaaguuacacagugaggaguauauauauugauacauaugaaaacuucuugguccuucuugaguuuuaauaucuuuucaguccaaaaacuaagcagcaguaaaaauguuuuuucuugcauuuuaaauccuggaacugaagguacuggggaauguuugaaguagcuagaaaaugucuuauugcacgaguggugacugacugaccccacuguuuuccacugagcugggugagaugcuaggacugugcucugcuguguucccacuugaacuuggggucaaggguucauguccuucagaauucuccagcauuucuugaaugagagguggcauugauccaggaauuuccauuuucaagguaauuacacgcucugcaccuuuucaaaagagauaauggaaauaugguuaagauaaggaguuaagcuaugacagauaaccagggaccaauuuucauauauuuuaacagagguguuuccuaagauucuugcuuaggaauuaugaaauguagauaucagguggcuuuuuguugaaaaagaucuaucgauuacuaucacacucauaaauacaaagaaagauaaauguauuuggaaugggaacugcauccaccaaaaaucauguguuaguuuauugcaaaguuaguuagauuggguucucaaccagcucagacucauaguauguugauagagagggucuuuuuaugaucugcuagaacuucauucgucuuuuaugcaagcaauaacugauacaauugcuccuuuugauaacagaaaauuaugcaaacaaugccucccagaggcuauccuuauuuuacaccauuaaaacauuuuuacuuuguggaaaagcagcugagauauggugacguuuaaauaugaugucuuaguuucaggaaauaacaauuuacaaagagaaguuccugaugaaagaaguguaucuugaaaaagacagguugauggcaguuacccacaaacagaggaguucacgaugugcagugacuauugacaacuagauuuagcagcacucuguccaguacaauacccacuagguagcuaaauuuaaauuuguuaaauaaaaugagaaaaacagugccucaguugcauaagccacacuucaagugcucgagaaccucuugugucugguggcuacugaacuggacaguacagauuauuucuguaauugcaguaaauucuauuagauaucacuagucuagucaucuauacagaaugauaguauuauguuaaacagccucauuuuuaaaaaucaaagauaccguauucacaaccacacugguaucugcuguuuacuucuacucuuaauuccaugcaaggaugaauucagaaugcucaucuaggagaccucuuagaaggagcucgaguuaagacugcuugucaaacaaguucccugugcuuuuaagcacuuucugaaauacagaguuuauuccuuggcuagcaaacaucuucagagacagaguaaguagucugauggggaaaggagaaugacaauagcccauuugguaccagggauagcugcugaguugucucucuacauagaaaaaccuuacuguuaaacacucaacugugauauggaucuaggcaccucuauuaauugcuugaguugcuacauaaacagaaaaucacuaggcaaagaauauaccucuuaggcaagaauuccuuugcuuagaagugugcagaagaaaaucugccuauauacaaaagagcaauggcuaaagugauugagagaaacuuaacaaagguuuagauauucaagaaaaacuggagucaagguaacauaaaccagagauguguagaaagcuggaauuaaauguaugaaccuagagaauuagccuguuuuaguacauucucuugaaaacaauguuuuucuaaucagucaugaauuuuaaagcucucaaucguuaagauaauugaauaggguaagauuugagguguuuuuuuuuuuuuuuuagaggggggagggauaguauuuccuuuugauuucaaugagaaaugaguuccaagacuuuaaaagcagccauuaaacauccugaauugaauaaagcaacacaaccugguaaggcccucaaguccacugugugacuacaguacugagagcacgaagacauaccuuuagcacugaugcuacggagaucugugauuuucauuaagaucuuuggaaacaugugaggcuugcugggucgucuuuuucugauauaaauuuuuagugcuuccagcaaugguucuuguagcuuaucuacuuuugucgguuccucaagguccuggcggucuggauaccaggaauaaaguauuaaacaaaaucaggauuuaugcccuuuuccccucuuccuuguuuccuuauuccuacuguuaugaguucauuaauuugguaauucaauuacauacacaaauuugcagacuuaugcaguugcuuuaagcagugauacuugaaaaacaaaaaaaaacugcccccccuugguaguauaaacauuuugaugccugguugcuuuugucccagggaaagaauuaccuccuuugaccagaaggugucacuaccaaacugaauuaaaacaaaucuugagcaggaugguuauuuuagcauaaaauaaaucugcuccuuaauuaaaaccauuacuuuuuaaccacuuacgauucagccuccuauaggccaguaggggucacuacaaagaagaaagcuaaauuuuaucccaguccugcaaggguuggugggagggcccagccaaauacuuguaugccuacccacuagauaacaaacagcacauacaagucccuugucaucauucaaauguccccagacaauucauuuuauaauagugugauccugccuuuaagaaaaaaaaucuguggcaauuggaguaauagcuuuuugggauuucuuucugagcagaaggaucccaaauaccauuaguuaauuuguaacaacauggaaaaauacaaugaaaccaggcauguaugccuggcuuuauucacauguuuucccauguaaaacaacuccaaaagggaaaugaggaauuuuucacaaauuacaaguauaaacuguucuucauggaauuucaugaggcuuuucuacauaguugguaccuccacagauuaagcagauggcacugagaaggccuguuucugugucauccauuuccaaaggcaggagcugguuggcaaaggugaacacaaggucagucagaggaccaaauccagcauugugcaucugaguucgauuuaggguaaggccgucugagaaagucauggugucuuguucugggguauaccuggugcaaauucuaagaaucuggaaggaaaaaaaaauugauggauguucuaagccauccuguccugaaaucaucaaucagauguaagcaggaaauaacaugaagauuuccaaggagcucuuggggcagucugucccccuuucacauguugaaugucuucuuuagcucuuucauuaagagacuacagaagucaaaacccaggggcuaaaguuuuuuaggaaacacuaaacaggacauaagaaauuuugagaaauaucuuuuuaaaaguaauucauuacuugacucaaauaaacauuuacugagugccuaauuaugucccaggcacugugccaggugcuggagauaaaaaaaaaaaaagaugaauaagauucuauuuuuuaagagcuuacagucugcaauaaaugacaauuuauuaaaugcauaguauauaucaaguuuuguacauacccuacauucaaucuuucaaacagcuugguaaagugaauauuauucuuauuuuacaaaugaaggacuuaaggcucagaaagguuaggugaugugcccaaugucacauaguuaacauguaacugaaucugacucaaacccaaguuaggcucucucucccaugaugccucugaucacacgguuacacaggcagcuguaauacaagggacaugagugaaaccagcaagguacuagggaguucagaaaaaggaaagcucagaaauagccaggaggaaaucaagggcagauccauaaagagguagcauuucaaccgaacccuaaaguguaggcaggauuucuacaggcaaaaagccugagucacucugccagagucucccagucccacccaguguaugcuugacacauaacccuguuggcccccuggggcgcuagcuacuaaggagacucuugcucacugcccugugccucuaggccucacucagagcaaaacaaacuaaaaaugccuugcuucuguagauacucaauccugguucauguuuccacugcccuauuaagccuaaaugcugguaaggagcuccgugcauugcagagcacuuccccacccagaaccacauuucugcaccgacaauaaagggucucugcugaccagguuuccauacuugacuuuucucucugaaaaaguuucagagcugcuugaagcacagagagaaguaaaucccaccuggacaaaagugaauaacucaggagguugaagaaguugaaaguuuuucccagauaauggcauucaauuugacuggguauaguccugugaauguccaccucagugucaaccuacaggagggcagaugugaucagaaaggccugcauuauuccuguuacacagccaugugcagagaggaguggccucugaggaagacacaggaccucuaccuaggaggaguaguaaagcccucuccauccugcccauauucccaucaggucuccuaaaagaaaaacuucugucaaaucucucaucuugucagggaaacacuggggguuugggaccaggacacuucccauggggaagacaguccuaucugacuggugguggauccacaagagccucaaacccacuggaccacaugaaccaugaugggacaguuguacugcaauggucacaugcuuuuggguucucuaaaucuccaagaaggcagugaccuaggagccagccuucucccuacacaaaggacuccagcguggauaaggaggaaggcaccaggacauccuauagagugagggugcagcagcgccucuguuguauauauuuuuaaaagucugacuucagugucuuauugguuaaaacuccgagaggaaaacugaaugaguaagcccucuucaucccuaacauacaguaauagcuaauguuuuauugaucaccuaccagguaccauacuaaacacuaguauauuauuucuccuaucaacccaugaauuguuacuauuagcuggggaaacaaaucugaauagcuuaugcuaggucacauaagcuaguagaaugauuugauuucagcuuuuucuagaacccaugguuuuaaccauugcuccacagcugccucauuuucucuccacgccaauagucaaaccuagacaccucucuaagguuagauaaucuuuagcccaguacugauuucgauaucggccuuacugggcacuuuugugcagcacauaacugcauaacuauucacguuggccugccugcuguagaggggugcagagcuuguggccuggaaacagaaacuucguuuuauauugggaggggugguagagagauaucuaaaucaggacauguccucaaacuucuuaauguuccuacuauaugaucaaguggcauagugaauuagcaauugaucauuaaugugaguaguucucaaaacacuaccaugaucucucuucauuugaugggucguuauuuucaccucccagauacuugcccaggggccuuucugagcuagcccagccauuuccacugguuucccaacugguugaccuguuucacuucaucuugguaacugaugggguaugaagccauucccaaugucacagcaguaagaaaacccagaggucauugggcauaaagccucacauuuccccugaaagugggaaguaaaguguggugcccaaggucacacaagcaauggugcuagagccuagaauacaggccuuccaauccccagccugauguuccuucaacuaccuggagaaacauuaggaaauacugucugugcagggaguuaucaagugacagucaaaguuagcacuuugggagggcaaggcggauagaucaucugcagucaggaacucgagaccagccuggcccacacggugaaaucugucccuaccaaaaaguacaaaaauuagccaggccuggugaagcgcaccuguagucccaucugcugggcaggcugagguuggagaaucucuugaacugggagggggagguugcagugagcugggaucacgccacugcacuucagccugggugacagagugagacccugucucaacaaccaccaccacaacaacaaaguuaguaugcucaauauuuaugggccccaaauccugggauacguuucuagucuggaaucaaauggguacuaaauaaaucuuugcagcuuuaacaugccgccaagaaaugaaugcaugagaucuguccccugcaaaaaaugaaagaauccagagauuugucggaaaggaacaaaagaccaggauuuaggacauugcaaauugccaauaacucacuuagaaauccauauccaaacugcagcccucaaauguuucuaacuauucuauucgaaaagguuuucuuccucaaaaguuagaauguauuuggauucugaugagucauuuaaacuauguucuguugccucucuuccuagaaaguucaaagccgaaaccaaguacaacugguacauccagagagggaacgcacauggccugagaaggaagacugcucaaugucuucuuuuaucugaggagccucccuucccugccccggccccagccugaaacaggauggcccccaugugaaacaggcauccuucucacugcuuccggcugguucugucucuggagagaacccaagucguuucauuuugucacacuaaaaucaaaugccaguggcaaccaccaaguacuucuccaggauuaaaacacucuuuguuugaaaggaaggcaucuuaucuggaaagaccggcaugcaggccccacgagauggguaaaaauagccuaggccaggcugucucaccaaccaaagcagggcccuguuggacaacacaaagcuccaguugauggucaaaguugauccuccucagggcaaaaagagccuucucuucuugccaucagcaaagacaacugugcaucucucuauugcuuuugaugggaguguguguucaguguguguccugggggaggcccacuuguuaauggaacccuggaagaaucugaugaugugggaccccagaggcagagccagggacuuguccaccaagcugccaucaccucucuuacggugagggccucugaagugauccuucauuucuauuccugcucgaguacuaugcggucaauccacagcagccagagcauguuguccaaaauguucaucagaggagaaaacuccucaaauggcuucuagucaccuucagaauaaaauccaaacuucuuucuguggccucaguggccucucccuaccuugccaacuuuaacuacuccuccuuuccuuugcucaugaacuucuggccaucuuggucuucuuugugaagcuucgaugacucacugcugaggcaaaguguuugcacuugcuuuucccucuggcuucagugcuuuucccugaucuucacauggcucuuuucucagaguucagcuuaaaugucaccuccucuaaagccucagugaaaaugcuuccuaaaacccauuauuuucuaucccaccacccuuuugguuuuuggaauaagaaauaacauuguuuuaaaacugagguauaacguguggugguuuaaaaauaugugugcaaauucuuugauccuacucccuuuaagggguggagcuuaauuccucuccccuugaguguggccuggacuuaaugauuugcuuuuaacaaauagaauauggugaaagugauggugugugacuucugaaacuaggucacaaaaagcauugucacuuccuucuugcuugcugucucuugaaucucuugcucuggggaagcuagcugacauuucaagaggacaguuaaccagccccacggacagguccacagaggaagaaacugaguccucccaucaauaaccagcacuaaauuccuagacaaaugugaugagcgauuguggaggcggagagcuuccagccucuggaauucuuuagaugacugcagcucuggccggggucuugauugcuauuucaugacagauaccgagccagaaccacccaaugaagucaguaccagauuccugacccacugugacuacgggagauaauaaugcuuauguuuuaagcugcuaaguuuugugguauuuuguuacacugcaauagauaaugaauauagcacacaugccuggagcugcacacaaaucucgaguacagcuuaaggcauucucccuaaccauguaucugugcaacuacuaccuagaucaagauaugaauauuuccagcaccuaccggcuccuuugacuucuccuaaucaaaccucuuccucagaaguaaccauuauuugaccuauauuccuacaaguuaguuuugcaaguucuugaacuucagaucaauggaaucauacagaauauucucuuuuguguccgcuuuuauucacucaauauucucugugugauucacccauaugaguguacacagcaauaguucauucuuuuucacugcuguguaguauuucacaaugcaaaccaccacccuguuuucuuuucuucauagcaguugucaccaucugaguuuccuggccuaucucccuucuagaauaugagcucugagaaugagaccgcucuuuaccugucuugcucucuguugugucuuuaauaucuagaacaauguccuccauacagcaggugguuaaugaauauuuauugaaugaauaaacugaauuccuucaucagacucucuucuaucuuguaaaccucagagggaggcaucaagggguugcccaguuuucaggcaaaggagaaagcucagguugcucaaccaucuuggucacucuacacugauuguguuuggcaacaugugggcagauccugaucugauucgacaauuuauccccauaugccugugggaauguuuagguagugauacuaguaacaauguuuaaguggugauacuaauaacaaagacacacgcagcgcauauagugccuguugugaugagcucaugggaacaaaauguuuuccccaaugggaccuguagccagccugccuuaaccgaggagaaaauacagauguuagaagcagcaggaguuccuuguuaccguuacugucucuguuuugcagaccaguacucuagcagccauuguuuugcaauguuaagagaaauagauggaauuauuuuaauaaucuauuuuaacuuaagauauccaaauuauuuuuguuucaacauguaaucaauacaaaaaaaucauuaaggagauauuauacauguuuaaauacuaagucuuuaaaagacuguuuauuuugcaauacacacuucacaccaggcacauuucaaggugcucaugagccacagcugccucgcagcugcugaacuagacagcacagccccaggugcuauugccuagcagcucagacaccacacuucauaaaggcagccuaggcuuacucaagacugaugauuacagcuuauuuaaaggaacacuuacuaugugccaggaacuaauuaacucaauucuuuauuccagcaaccugaauggggaggagcuacuauucuacuuauucaauuggugaggaaacugaggcuuagagaggucaguuagcuucccuaaguucacucagcuccuaaauggcagagcugggauuugaauccagggaguuggacugcaaagcccacccucuuaaccgcuacacuggcuaccccacagcaauuccuggugccucaugggguaaucgugccacaucuacagguggguaagcugaggcuaggagagacccagggccuccucgugauggcacagacgcccaggcgcaacgcugaagccugagcucaggcugugggucuuuaagcccagagcucgcuccccaccagccugggcucuugucucuacugaguccccaggaaggggagagggagggacagguucacaugggaacggcccuccauggcuauacagcugcacagucuccagggcgucaaggagccacaaaucacauuuugaagucacacaggccgucacuuuugcgucaccagaaggagggugcugcugugacuggcaugggaauauuuuccuugggggcaguaagggcaguggguggcaggacucaggaagccgugugucuuguagggaaagacauuaaaucuugaagccuuaacaggcgugauauuccaaaagcagcauauaugcugggauuugaauuuugacuuuuaauucauuugcucauucauccauucacaaauauucacuaaaucccccuuucgagccuggaacccugccacggcgaccaacccuaagaugguuccuacucucacugagacaacagacugggggagaagcuuuugggaaaugcaccugucauuacgcuaugccuuaagagcuugggacagaccugcagugugagggaggaaucggguggcuggucggagaaggcuuuucugaagagauggcauuucagcugagaugaggaauaggccaggaagaacaugaggagaagaggguggguaaccuagacagacggaaugggauguaaaaaggcucugagucaggaaagagcuugacugaggcucgaggcagugccacgaggugauauagcagagagaggcgcccuugugaguugggccagaugggcggcuagaauuuccagucaagcucuucaaccccgccuggccugcccccaguuuuacaacaguauuuaccuccuucacccauccugcccacccaguccuggcuccacacugacccugcuccccuucagcuugcccaaccuguugaaugugggcucugaaggcagcuugccuggguucaacaucuggcuccacuguuuacuagcugcgcgaccuggggaaagucacuuccccucucugagcuuccuccuguguugacaaauacaaucagucccgcuucugaaguuccagcuuugagaaacauaggcaguggcucuuuuacaagggcaaccccggcagaggcaagauggcaugagccccuguccaggaaggaaggacccucucgcugcuucugcugaguggccugguugcaccacccacgcaucacuguggcauaccagcuuuccccaucauuugcccacggggcugauaugaaaacccugucuucagaaucacaagugaaucauuaucccuugcuguguucccacaugguuuaauuucauuguaaaaaauacagcacuuaaugaauucuccaccacagucuuuaaacaaacccuggcaaagcaagucauuuucucauccgaaaauuuguucaagguuuucuauuuugcaaaagcaauuuugcccuccuuuauccagaggcuggaaacucuuccagggagcucuaugggucuuugccuuccccuugggccucagcugccucaccugcaaaauguggacaauaacaggaccccugagggcauagugcgacuuaacaauaauaccgaacauaacugaggccuguagggugccacacacuguuccaagcucuacgugcuacuucauuucaugcuuucuagagccugaaaggaagcuucuauugccaucuucauuguaaauacgaggcaacugaggcucagagagggaaguaacuuucccaaggucacacagcuaguaagcagcagagccagauuuugaacccaggcaagcuaguuucagagcccacauucaacagcuggggcaagcugaaggaaagcaggaucuauguggagccaggauugcgugcaguggggugggggcggagggugaggggaggagauaaauacuguggcaaaaguaggggcaggccaggcgggguuggaguugacuguagaguccaacagggcagggacccuccacucugccaucucacauccacgagguaagugcucaguaaauacaugugagaaucaugacuucaaccaauauugacgcagugcuacaugacaagacagagcaaacguuuaaaccaaaagucagaccgugguacaccucugcucaaaacccagugacucuauaggauaccaagaaggagaaucugugcacgaucacaggccccacuccaggaucuaaggucucgcccccgcuggcucacucccuuccaggcacacucacuuccuccaaccugccggggcuuccucugccccagggccuuugaacuccacucucucuaggcuccccacgacucacacaccccucccaucagugucuuuucuugggccuggcucuuucugggaaacacugggaaauuguuucuucauucagguuucuucaaaugccaccugugucugagcuacagaaacaagccccagcccuccuuuguugugcuccaucccugauucugcuucuguucuccucuguugcauguaagacgcugucuaauccacguaucugcuugcuuacugucuguguccccccaccaggagaaggucggcuccaugagggcugggguuuuagcuugguucccucugcugccuccucagagccuagaauagugcgcggcacacaguaggucaucaacagauauuugcggaaggaagaagagaaggaugggagggagggaagagggguggagggagagaagaggcagagaaaccgaagucugaccaccucaagguuuguuuuuacgauuuuuauuuuaaguugagagagacuugauccuaauuacgugcagaggagaagaggcaggugagagagaguggaagaaaaggcauaaaggagauugaacgagaaggaaacaugggggcagagccaggugaaggggucacuccugcuccggggcucccucacuugccugaacacagcccuaggaugcuaccaacucuugagugaagaaagaaacauaaaaaacccaucugcagugguuaugaagaggcugccugucuuaauagagacauuuuuggcuacuuggcuccugugggaaaacaugaaacucaaaguguggccucagaaucuucuggacccaaccucgugaaggaagcccggcugugggcugcccacuaaaugguccccaccgagcaaaggcuaggaugggaaauuccccuggaaggugagcaagggcaggacaggugaggccuuccauccccaucugccuguauuaugagggcucucaccucaugauucugaaucaacccuuccuggagagccucggcugcgugucccgcagcugaccgcaucuuccugugaaagugccagcccuggcaggcgugcaguuggaagcauuaccuugucuuguugagagaccacacacaacacgagacacguggcucugaacaggcgguacucaaucagggcuggugacccuugagacagccuggguuuccuuucuagggucugagaauaaccucagccugggucugucugucuguccauccgccugguuacucugucccacucuauccauauaucaaugacuuagauaagaagauucuucuaaacagcucugccaguuaauauucucauucaaaauaugcucuuugaacuugcguacuuucaggaucuugugauuaauugccuuugcuacaaauucuuggaaacaagcucuugccuagggccaaauggguauuccuucgaacuuugucugguaugauuggaggucuuugcccuuuaacuaucgggacauuuuccucccuggccuauugcaccccaacccagacuccucacccccauggcccaggaaggagugguugaaaguuuccugauucccaccacagggcugaaauugcccacguuaacccagcuuuggccuugucaucaacaucauuggcuaaguaccuacuacgugcuagguauuacagcuguuaauguauuuaaucccauuuaaguaauuaccuuauuuaaugccuuguugauuugcauuucuauuuuguacauagguaaacagaggcuuagagaaguuaaauaacuucaccaaggucacaaaaauugguuucuguucuacugacucuaccaaggggcuaauggcuaaugcuuggauccauggggcuggaagagugcugcaggauucaguguaagcugagaugugggaagagaggugcuggaggcaggaaggggauuucuaaauugaggaaggggauuuaaaucuuguggagacugcacccugaucacuaaguguguggcugugcagaaauaagacacuuucccggaggaucucaaagcauaccucucacuccauauguuggggcugaguaucacaaacugucaucaucuggcaacuagacaaaagaaggauuaagaaacaagcagaaggucaaggucagagccugaggccugggaaggcuccaggcccugcuggguggcugcgugaugcagggcugucagaaugacacagcauugcuugcuguggacuugauuugcugugagucaccucacagaccacucagacacuguggugguaacuccagucucugcuaauaucuuggaaguguuaugagguuuaggggaaauucuacugaguguuacauuuuaaguucuugucaggaaagcauuaaaaggcccaguaauuuucauucauuauucuaauagcucauuguuaacaucauuauugauucgcccacauugucucuguuacucucugguggucuagcucacuguggcccacaacucucucaucucugcuaucccuaagggcuccuguuuaugcuucauauccucuuuuacauccuguuaggccuggagguagcccaguaccacucuggccguauaccccacuccaccccgaucuugcaccacccccaucugugaccuugggaagaucccugcccuccugucuuaguucaggcuacuguaacagagaccuggccccuuaaacaacaacauuugcuucuccuaggucuagaggcuggaagucugaggucagggagcuggcauggcuggguucuuggugagggcucucaucuuaggucacagcugccuuccugcuauauccucacaagaaagagaaagggagcucugguggcuucaucuccucauaagggcacugauuccaucuuggggcuccacccuguaaccucaccuaaaccuaaucgcccccgcccaaagaccccaccuccuaauaccaucacauugggaauuaaggcuucaacauauacauuuugggaggaugcaaauauucagucauagcacgucugugggccucaguuuccucaccuguaaaaaggggaucccugaugccccuucgcucccugcccugcucacgcuacugcuucuagagccuuaaagaggguaagggggucagcacacuuugucuuccacaggcuggaaguccacccucucuuucccuggugggggcuucaggcugggacuguuuccuuggaugggagcagcucccauuagacguauguacgcagggaggcccauggagaaagugggaugggggacuggccuccagggaugcaucagaacauagggaaaguaaaaucagcuuuugaagugcuauaaaaacauugcuuuuuuauuaggucucucauagcuuuggguauaaaccauucugcaaagcaaauacaguuacuauaauuaagcacacgaacgcacucccacuuaggaggagagagguccccgugugugguggucgcacaggaagcuugaauguuuauguguccuguuugcuaaacagaccugaggaagaguggcaaugauuacucaguaacuuacaggugccagggguccugagagcauaugugaugauuuuguuucuuguaaaaucagggggucugggguaaacuuagaaacagaccagcauucaccuguagaguuugccaaccucagcccauuugagccucgcagaccucagugagccugagggaugggaauucagcccauuucacagauaaggagccagaggcuaggugaguccaccuacuaagucaggugagugcuagagucgaaacucaaaaccuccucuggagaucuucaaugucucuugguccccucccuccccuccacggugcccucucucccuccccagacccauugagagcucaaaaaggcacauaccaggauguccaggcaggcggccuucagcaggguaauuuggucugcgauggucaagccagugaaaccaggcagacguuuagcaaacuccacgaucuuaauaaugcacuugguggccaguucacugaauuugucccagaggcccagguccagucggacucgauggucagcacuggaauucuaggagagagagaaaaugucaucagauacaguuuccgggaagcucuauaggaggggagaaauucaauguguuuccaauuagagggggugacaugucagccuugagcaggcagguuguuggugggacagcuacauuuuuuuuagccuggauucauccuuuuuuugugugugugagacggagucucgcucugucacccaggcuggagugcaguagcacgaucucagcucacugcaaccuccaccucccggguucaaacgauucuccugccucagcuucccaaguagcugggauuacaggcgugugccaccaugcccagcuaaccuuuuguauuuuuagcagagccaggguuucaccguguuagccaggauggucucgaucuccugaccucaugauucacccgccucggccucccaaagugcugggauuacaggcgugagccacuguguccggucggauucauccuuuuaaaacacuuaaaaucuuaugccuguaccacuggauaaucaaguaacagaggagaggaaguaucucuguaugcaguuauccagcuaacaaacaagaaaggaaugaggagucaccauuuucuaacucugaugaaugaauggcucuaagcauugaccaucaguacuuguuaaucucuuaaaaacacgccaccugucaugcugauguccugauggaaaaacacaccaccacccaugaaauauucuggccagaaaucaaacuugaaucugacugagacucuagauaaccucaggaaauccagggacacgguaaacuacacaaaguggguacagcuaucaacauccagaaugccagaaaauccacaaaaccaaugaacugguuucuucaauaagaacauugcaagagagaaaaacaaguggagagagaaaucuauagauugaaagcaacucaacccaaaugcucauuaacugauggguggauaaauaaauugugauuacaacuuugcaaugaaaaugcuagguagcguuaauaaggaaggaaacuguaauacaugcuacaacauggauaaaccuuggaagcaugcuaaaccaaagaaggcagacauaaaacgcccauacucaaaacgauuccauuuauaugacguucuggaaaaggcaaaacuauagugauugagaacaguucagugguuuuccaggagcgggaaggcagguggggacugaccacaggugcacaaggaaacucucuggagcaauggaaauauucuacaucuugacuggagucagguuaugugacuguauacuuuuaucacacucaucaaacuauaccuuuaaaaaagauaaaaauuacauuauguaaaauauacugcaauaaaccugacuuaagauacugagaaaacugacaaccaauugcaugguguaaaccuuaucuaaauuuuaauucaaaaaauaaacuguaaagagguggugauauauaugagaaaaccagaaauaugagcuauuagguguuagagaucauuuuauuuuaggaugguaauaauggcacugaugcuuuacuuucguuugcaggagcuucuuucauuuagaauacauauuaagauauuuacagauaaaaugaugagauauuuguaauuuacuauccaacaaaaggcugacguuugguucucugacaaauguaaacagcucaggagagguacuguguuucucaaacugauaucuuuaguuccccaccucaguuaaaaucagucuacaggaagugaauaaaacuagcucuugcuuugaacgucugcauggaaagccagaaagaagaguuugcacgaggugccacagacacuguaaaaacgaagguggucaacuuugccuuccacgacguuccuuguggagaguagacaugcauccuccagauuuauuuuauuccuuccucaaggaccuuggugguauacaguacacuugagggaacaugagaucaagauguguggccauuugggccguaauuaaauuuaauaggcaguuuauccgguucguaggaagaugacacggaagagagggacggagagucaagcuuauggagggaaaucauuuuacaauagaguauccaucuggaaaaaaagacauugccccgacccagcaagugugaacgaaaccuucaucaacauugcaugagguaacuuuaucacgcgccagggcugagagagaggagccugucguaccuucuauuaaaaauaaugcacagccgucuuaacggcauguaaaucuaacucacuauuaugcaaacugaagggaagaggcaguuaauaaaacacaaaauaaccugguguuuuauuauacuggcugcuggauucauaggcaugaggcuucaaauggcuuauauauuaucuuccagcugcggcaaauggagagcccuggccugcuuggguugguaaugaaggcggcuguggggagcaccagcgaagcguggauuuucagcagcauuucugagugugcagggaggaaaaccaacagagaaggagaagcagaaagugggguggugaggagugacccuugcugugaguaugaggcaggcugaugaggaaaacagccaagccagaagggcaaggggcucuccuccaucugcugccgacugagagucuggccagggcuuccagaggagguccccucuucggcaggggcuacaggagcugcagcgccuccccaggaugccgcgugguggcccauauauggagggucgcgcccauggccccccagggccaucuuaagcagcagaaaagcccaacccuacuaugaaauccaauuaaauggcaaguuuugccacgcaaauggaucccuuucuucugcugguuugguucucugcugcaacgggcugccuuccuggacuggcaggacuuucagaacaagacccauaaaggaaaguggaaucaccagcaucuuuaaaucccacuggaggcagcuccuggguauuacagugguuuguucaagcguucuggcuuuuuuuucaaaguuaagaaggaaauguaaauuuucauuaaagaaauaaagaauuaaaauucuguggcaauguuggguauauccauggaagugccuccuucuuccuuaggccugaaauccuuccaccauccuggagacugauguccuuucaaguucaauuugcagaccaucccugucacccacauucaauuccugcauuuuguauguuuuugcauguaaccaccccuuuuucuagggcuugccucgugccaggcacuguucuacaugcuuaacgaucaccgacucucuuuacuuuucacagcgcccccaugcgguaggcaccauuaugguccccauuuggcugaugaggaagcgaaggcccacagaagugcaaucauuugugcaagaucccgcgggcgaaccggagggugugggauucacccacacaguuggguugggguguuuaggcuucccaccagugcaccacgucacccccucccuacugguuccucacauauuucuacuuucugguuagaacuuccugacuccuaaagccugugguugcaucugugaucucccuccuuauuggaaucucuggaugcuuccaucagguggcuacaagagcuccagcacagcuaugaagagaauguuaugugccggccaacaucucuuuguggucaauacacacauuaucuaggcacuaugagagcauggcuucgggaacgucugcccccaacagaagagaagagaggagaaggcccccaacacgccugcagcauuuuccuuaggaccagaugccuccaacagguggggagaaggcagcuuggcagccacccuguagcucuggguagacaggagggcgugaucuuaaaggcauggugcagccuguggcuagagagggcuucgagcaaagggcaaugggagagggcagguagggagggucucuagaaucuuucgaguauuuccuagcagccuggcuaaaaagcaagagugaugccgcaggauuccccuggaggucacguuucaggcgugcuccuggaccaccaucgucuaagauuccugagcugggacaugaccuuggaaaggaccaucuauccaucugcagccccuucacuccugggguucagagaucuggggccuuggucgagugcagggguggggugguggguauaguccaaggcccuagaggauguccaagaaaugcuagaauucuggaguggucccagcugcuggaaggggccacgaaugccuucuggagcugcagggcauaucugagaaagaucaaaagcccugcccugugucccugccgaagccuuccagccagacacagcagcuaggcaccaccuucuucgaacugcuuuuucucaugacuagaaacuucccuuggcucccuagggcuaauguucacacaccuuaucccagcacccaaagccccuaggaagcuagcccugaccuaccuccucaaacuuagcucugccucccucccacccagccccaucccugugaaacccugugccguguucaugcuauugcuuuugcugggaacgucuuucccuuauuccaucacugaggaagaauguggguacuuagcacagugccuacagaacauuuuucuucaaaagaucaggacuuaugugugcugccagagguuucuaaauacucacaacacuugugacaaaauuugaucuccagcuagacuuugcagagagcggcaagcauggaaagguaacauccaugcacuccaguucugcacucacuagguguuacuguuuguuacggguuaaacuguguuccucaaaaagauguguugaaauccuagcccgaguaugucagaaugugacgcuauuugaaaauagugucuuuauagggguaaucaaguuaaaaugagguaauuagggugggcccuaauccaguaugacuuggugcccuuauaaaaaaaaauguggaaaucuggacagagguugacaugcauagagagaagacgaugugaagaaacacagggagaagaugaccaugagaagacggaggauuggugucaugcaacuacaagcacugccuuccacgccagaagcuacaagaggcaagaaagggcucucucccagagcugucagagacagcguggccaugcacacaccuugauuuuggacuucuagcuuccagaaaugcgaucaaauaauguugucucaagccacccaguuuguauuauuuuguuccagcagcccuaggaaacuaacacaguagguaugcagucauuguuuguugcaacaugaaagaauggucuaggucagggguccccaagcccugggucguggauggguacuggucgguguccugcuaggaacugggccgcacggcaggaggugaguggccaggagcgagcguuaucgccagaacuccaccuccuucagaucagcggcggcauuacauucucauaggaacaugaacccuacugcaaagugcgcaugcgagggaucuaaguuguccuucaugaguuucauccugaaacuauccccaagcccagcaucuauggaaaaauucucuuccaugaaacuggucccuggugccaagaagguuggggaccgcugcugggugauacuggcagcacagguguguuuacuagcaagaaacugaggcucacuaaguuaacaacuggcucaaagucagacagcugugaggugacaguggggacuggaacucggguuucguggcccccacugaccuucuaucccuccugaugcaucucuccuggcagcccgagcuccccgaguuccagguucugcuccucugguugauggcaaauguuaguuuccaaaaagcgcaccgaguccacccaugacaagugcucaaaacagccuuccuuuucuaugguaugucuccuggaaagucuuucgugguuaauaauucuguuuguggucauuuuucugagcagguuaagggcuucuuaaaucuucauaguucauauucacaagccccucggaggacagcuuaccucccgccaggccccaccuggugaugagcggcccgcacacggcagagcagugggaggccgggagcagaggcggcccggagcagacagcacgagcugggggugggggcuacaccaccuggaaaucugucccacugucacacccacgcuaguuuacagaaccugggcauguggcucgaaaaaaugacaagacauuuaugaugggguggagaggaggagagcugcacauucggcacgacuccucugugccggaaacugugcaaggcgcuccauauauuuuucucauggaacccuccaggcaggagguggauguuuuuaaaacucccauuauacagaugaaggagcugaggugcaaaugaugauguaacuuuccaaagucacaugacuccuaaguagcagggauaagaguugagcuugaauuuaugaggcccuaaagcccaaaugauacucacuaggguucacccuaaggaagcggagaacacguccucagagcgaggauguuaccucugguucaguccugauucuauuuuggaaagcucaucuauaaauagcuucucuccugcuuuccaccuuuccacagggaauccacccucucuccuuuuauggcggcggagggucauuggguagaaaccuucccagggauacuagcucugaagauugugggugagugcccugcccuggccugaggugggggugguggggauauguuucugccucuuccagccauuccugcggucuccggggacccaaccauuugucccaaauccacccuaauuagggaagaaaaaggaacuacucuuucaaagaucuguagaugcgcaguuggcugccuuucuuauuccucucugcccacuaauuccaaaggcaucugacagggaugccacucuggugaagaugacaggaaguuuccugccguggaagcaacugccugucuaaaaaaagcucuuuuuaaaaaugcucaacuccgaacuaagagcuugcagagaauguguuauggcugcuguuauuuauuuauaccaccgacuuccagaaaggauuuuaaguggcucacaauaaaaacacagcuagaucuggggagagauaguacaaaugaagagcacggucagcugcgagacuggcucagagcgcccuccaccccgcggugggcagcaggccuccggaaggaugcccaguagugaagggccacgcucuagagauaaaaucguguuucuguuuuucugccugacugggagguacaagaagucuccacaauguguuuaggagggugggccccaguugaggacugggggugacucacccccauauugggguggauaggaaagggcccuggaggccugcagggaagccucucucucuuaggccagaagccgaggcugagacuagaauuggaaugcacgauaguuuaugugggaggagaucccaggaagcacuggaagaacagagugggcagggaaggaaggcggccagcggagaucaucacugugggcagucagagcucgaucuaguugggaaacucugggacgugguuuagaggauaccuaagaguauccugcccaacgaauaaggaagcuggggggguuuaucucuccacguucugcucaucaguggugagggaccgcucgcaggaguggcaaugccucacaugugagccauccuguaggaaucccggucacaccagggcgcauguuccaggagcggcaaaugcuguacguuguguuuguccugcccuccuccagguuagagugggagcuguuucaccugauuacuaggugagucagggucuggggauugacuuggcuaugcuaagauaccaccuggaggaggcggagggggacccugauguagcaguuacuggcccuagguauugccauauaaagucgcucaccucaugaccuggaucaaaagucuccucuuucaggaagaccuccccacucucaucucuuuuccucugacuuucuuggagcuacaagauugauuuauuccugggucacagcucucuccuccuagcuagaugccgccaauggccccagcuuccauucucccuuuuuggcaacccucucaagggauucuguguauaguauacugguuaaaagagcugcccuggagucagacuguuuagguucaagucucaccucugaccacuuguugacuaagagacaaggggaaaguuaucgagccuuucuguaccuggcuuuugcaucuguaauaugagggcaacgaaacccaaaucacagaguccucauaaggaauaaaagaauuaguauacuuauaguacuuagcauggucccuaguacauaguaaaugcucaauaaauaugagauguaauaaugauuacaaugauaauaauaaagauuuuugaccacaaccaucaauuacuguucauuauuuacagacuccucaaguggcacucaagacuccgccaggcuuuucccauucucacuucccacuugcucucaacucaacacaguccaccauugcacagcaccuguuuucucucaucuucucuuuucgccccuucccacugugccagccugaguucccucauuucuuaggucaagacgcccucaccuugauacacagcucaauacagggccugaaaugccacugaaugguuggcaauuaguaaguauuucuaaaagaaauaaauggcauacuuucagguauugguuauucaucauguuacuuuucuguauugucagaugcacccagcaugggggccaggucucuggagggucaguuaguauccaguagaagguacgugucuggaugauguuucugccacuccacugcuggguagauauuuuuggguuccaucacagcagcuuuucauaaauugucucauuucauccucccaacuauuucacauuauucccauuuagagaugggaaaacugaggcugagagacguuagguaauuuguucaccgucauggggcugaugguggcugaguaggacuugaaguacauucgugugguuccaggccucuguucuggauacauggggucacauuccacuuucucucccaggugaaaaugaaagcucccuuacaguguccagucuuguccuggccugugucccugcucugggaugggacaguguuccccaaacucagugaagacugguugagguuaagccgagacucucccucggccuggcagacaugccaguguuucuccuggcugacaccaaugggcgagguggaccccagagugccacccuggguguugcuucucaaagcccggcucauuugcucuucagagucuggucugcagaccagcagcauaagcagccuggcagcuuguuagaaaugccccuaggccaugccugcugcaccagaaccugcacuguaacgaguucaccaggugcuucagaugcacgcugaguuuugaaaaguacugcucaagguucuaccucugcuuccaggugagccaaagucucugagcucagccaggagacuugucuguuuaaggugggugccagcccuucagaagcuggugccacccaacuguguagucucauuuucaucugagaagccaccuagguuugugcuggccccagauuccaugggcgccccucugggccugcuccuggucaccauuauuguguuacagauaccaccaacauccuagcgcacuacaccccaugcucaccaagaacugcuccaaagccccgccgcucacuguuuuuuuuuuuucuuucugguaucacuauuuugucuuuugaucuucaggaccucccaugcuaucauuuuucuagaacaccauucaccaagccagcaagugcuacaauauuuggauuuuguuuuuaaaguauguuuaccauagcauuguaggugagcaaccuaagcuuuuuaaagaggccagaacaacauucuaguuguauuaauucaucaaauaucuacugagugucuauuacaugccacaaguuagaaauauacaucagugaacauaauacaugcaaaaaccacuuggaaaaauuaaagcaccucaugaccccuccacuggcacaaccuagaccagccaacauacaccuccuaccuuuuuaucucacuucucuuuuuccugccucucuuuauuuccaaucucagugaaaggccauuccuaguggaacgcugggaagcagagggggaacauucacucaacugggcauggggcaugccuaccccaaacuuuucuaggcccuggcuuggggguuuuguacauguccucucacagaaggcaaaccuuggcccaggggauggccucuuuaucuugguuggauuucacagauggauugggguuuuuaaaagaucaggccccgucccccugggucccuccguacagagguccgucaugacccauguaacgcuucacuggcuuuacuuguuuccuucaccagaucaaagucucugagagcagcacugaauaguucauguugccagggcuuagaacacagccugucguauagcaaauacucaguuaaugcaucuagagugaaugcaugugugcaugacugcagugaggcggcacucagccuacucacugauugcccacgcccaaaggcuaccucacagaaagaaguggcuacuacauagccccagcuggcuagcaugcaagccccugccaggcccagugcaaagugugugugugugugugugugugugugugugugugugugucugcacacaugcacguacaagguuuccacacucccagcagccuggggcaggaguaucucuuaccgugguguauuuacccagcuggcagagugaagggaaaguuuccuggugagcuuuucggaucuucucugugagaucguccaacucagcugucauuucauagcucucugugcauucuugcuucgaagucuccuucuuuuucuuguuccugucauuccugacagcuggaaacgagagagaaggcacaucaggggucgcugaaggcugggccugugcuccugagcugggagguuccaccucccaaggcugccuuaagcucauuugauauuugggacagaaacagugggaagaggugguaauaacacaccucccuggaaaagggauuuggcagccgcgggaccccggcagagagcuagguuugucuuucuguauaugcaugugcccgucaguuguuuggagagcuugggcucacccaggaggcucagagucuuggcuuguugugagagaacuuuuucuguggacuggaucucuugaagagagaaggauuuuuccaagagcuuuacccucaaaugggaugcccugagugacauuguaagggaagggucaggucucugaacaaagccccguuacuucauaauuaguauuuccuagcuacacauuuuggugucuuugcuuuuuaguuuucugaauuaagugacaggcacuuuugaagaaacucaucugagaggagauaaggaugaugguuuuugucccuucguguuuuucugcuuucuaaacuuucuguaugaaccauauuaucuguuuuggaauauaaaauuacuuaaaaauaauaauugauacaguaugaaaucuucagccuggaaaaccauucauucccuuauucgcugguagccacuugacuccacguugugucuggaacacuggacccacagcagguguguguccuuucccucugcaugcuccgagccaagcacggugccaggcacaaagucagggcccaggacacagugcuauggaagcccgugcuuccuccugcagcacagaccucugggaugacuucaaauccgaguguaacucaaagcucuagccccuggcuaggaucucgcgaggaaagaaacugaaacccagggaggcagacaggcgaaacagaccaugccacccccuccagggaguccauguucucuggggcccagcgggugccaggcuggaugcugccuggcugugcaugccaccacugugaccugggaaucugcacugcaaaaugacccagggcauaaucugaucugcccuaagaggaucuggccugaguugccucccuaagagcacacgggugauuugagaacuggcaguucccuggguccacaccaugagaauacccauauuugggguaggagcugagggcagaguaagacaauagcaggaggagagaggaaguggugaaaggaaagagcaaggggugagaagggggaagaaaggaaaaaagggaggugaguccuacuacaaagucagugucuguacgagccacuccuaccuaaccaggagggagggcagcuggggagaccaggaacauuuuuuugagucccuugaacaugguaucacgguaucucacuugauccuuuuaucagguaggcaaguuuaaacccauuuuacagaugaagaaacugagucuuggagaagcuaagaaauaugcucaaguucacgugguugagaaguuccuuccucacuuggacucacuuacuuauuccuaaggaaaccaacaggucugaagagaacacccuucuagacaguuuccuucccccaggacucugaaaugacacugcucauuggcucagaaaauuucuagaucacuggugaaaugagugggaagugcagccucagcuguauucuuucccagugcagacuggccccucgagaccucugugacccgaucccucccagccggcgcaggacgcugggugagaguggguaucaugguucaaagcagagagaaugcaaagaagccggcgggcaaaggagacacaaugagggggaaaggggucaugcaggguggcagaggcggcaugguggcucuccgugaggauggagucugggcugcugaggggagggaaugccugaaggcuugugugugagugcgcaggaucucaggugaucagaccccccucuuuuccucggccucugccaauggccuuccuuagcuagugaaaaagucaaaucuaagcagggaggguccuucugaaacagagccccgaggaagaguacucggcaguuuuucucaaaguuauacgcagagguaccaugugacgcagcaauuccucuccuagguguacacccaagagaacugaaaauaugugucuaugcaaaacuuguccaugaauguucaugacagugugacucacggcaguugaaaaguggaaagaacccaaauguucaucacccgaugacggggaaguggaaucuaggacguccuuaugguggaauauuauuugucauagaaaggaaugaauuauggaugcauacuacaacacagaugaagcuuucacacauacgccuuaaagaagccagucgcaaaaggccacacauugugugauucuaaauuauauggauguccagaacaggccaauccaaagacaaaaaguagacucguggcugucagguacgggggcaaguugguggggagggaggaucgggagugcuaacggguucaggguuuuguuuuuuaggagaugaaaauguucuggacuuacuggugaaggcugcacaacuuaguggauccacuacgcaccgcugaaugguacaguuuaaaaugaugaauguuaugcuacgugaauuauaucacaaaacaacaccaacaaaaaacccagagcccugugggaggugacacaucgcuaaauaccaggaacuguuugagucgauucugaagcugagaugacaccuacagcuacauuaaaacacagcagcagccucacuacccuuuagugauuguguggcaagggccacugggcaucagcaggugaagaauccuagcucgcgaaauccccacaguaagccaggugaggugggccuuaugaccccauuucuacacucaaggaacuugaggcccaacaauaccauguuugaaaauagucaacccaaugugcagaaagagaaaccacaaaacaaacuaacaacccacagaaggaguccccauaaucccauccacagggaagucugcaggaccugugucugcuccuaagcauucugcuucacuguccccauccaccaccaggggccuggaaaacucagacgagcaaacccagcucuagaggguuaccaggagagaggagacacugugagcugucaccaugaaguaacugaaccaagcaagaaagggaggggugagguccugugggaaggggcccugggugagcugcagcugggcaccaaguugggcaucucuguuggguugugcagugaucacacacgccguuugcaaaaucacaacugugaagccagagcaccauuuucugugcuuugggcccaauuuggagcagccuuugcagcucacucgaaggggagcaguguguaaccucaggcuacuuuccacacuccuuuuguccccuacgugaagucccaccaccacugucuaugugaauaaaggacuccugggauuaucacaaauucuuccacacccacaaaaugcagggacaaccccucuggugaugaugccccaauuacauacagcuucauaaguugacggacaaauuuucuaaacacguggcuucagcagcugcuucccucaaugguuuuaaacucuagaagaacgcagacgcaguguuugagaagggcugccaagaaccaccagaaucauggaggugacacagugcacaagaagccacgggggccuagggaugguagcuuuguccaaguucuugggacuauuggucccuuugaggccucguggucaguggcuccuggggcagugcagggacucguuccccuggaggccagcagugggaggcaagggcgauacaaguacugcaggggaagucaggagaucuggaacuagugcuagcuccaccacuuaccaccuggggucaacuccagaggagacagcuccuuucagagccucccccgagauggcaguagcaccugcauggagacacacagauggugggcuuggugggaaggagguagacuacuguaaaggccuauguggguuaguuaugcaggaagaauguaaggcccuuccgugggggaaauggaugaccuaaacaccaaggacuuguggggauuacuguggggccuguggcugucaguggcagaggagacugauaugaaaaauggugcuuggagaagccaucgcaguggcaccaaaugaguggguggauucauuuguuccuucauuguuuuguucauucauucauucaaugaauauuuauugaguaucuacuaugugccaucgcaaaacaggaugguuguugcuaccauggagcaaaaacuuaugguagcagacagacauucaucauacaauaaaacagugacaguaauaauaauaauaauagaauauuggcaucacuauuauuacauguacugcaauuaauauacgagaguauuauuuaccacaauacugaaaguguucauuacaacuaucauaaagccuucuauucaugguaggccauucaauccuuacaacaaccuaauagaguagauaucacuauuauacccauuuugcagaugagaaaguggaggcacaggaaggugaguacccugccugaggccaugcauccugugagugauacagucaggaucagaacuuaggaaacccacugugcuccgcugcgucugagucuaccccauguacacacaguccacagcguagugaguacaaugaaggaugcuacagggagcugugccuguguauuacuggguguggcagggggauccuacugguccuagauuaggaagcuaacgcuggggaauugggaggguaaauugagggaugcuaugggaugguggguggggagaugacucucuucucugggagcguggggugugcaucugaugcucagcuccaaggcugccugggauguuugaugguggaccucuucuuucacucugauugcgacugacugguauaugcacucauauaccuaugccagaccugggaguuugacaagcugcuuucagguacggugcaccucugggagggaauggagaggcaaagagaggagcaaacacugucaagccugcaucaaagcccuccccuccaagucugugaauaucugaaaggcaagggccacauguuacuugucucuauguccccagggcuuaauacaagauccgacccacagaugggggccucaaaacuguuuugcaaaugauaagguagacauauaacuaaaugugguguucuguccacugucagggccuauauguggcaauacagaguucaccugagccucuuucuuccagaacuuaaaggucucacuaucauguuggggucugcgggggaaucacuaacugcucuccaccccuacaguaguagccagaagguugaugaagcagguggggcauucagggggucacagaugugauuuauacaccugauagaacccggccugauguuugcaaagcgcuucuuggaugaaaggugcuccauaaaauaucaaguauucuccuugugaggggcuaagugcuacaaaucagauuugguggcauaaaaguaacauauuuaugauccacuaucauauugcaaaugaaaugaauguaauaaaagugucacuuauacaaauaccucugauguacggaucucgaccuaugaauaugaaaacagacacccaagcacuuuuauuugaaugucuaaucauggaaauaaaugaagucauguucauuuuaaugugugcacuugugcauguaucuggaauauugauuuucaggcacacaauaaaaauuuaaugcaggaaacaugcaaaagauguagauucacuuggauucaggaagagaugaaaacaaugcuucacuaaaaauccuuucacaucaaaaaaaaaaaaaaaaaggaaaauacaauugaugguauuuuuguccauaaaguucucuauauucagcuuagcaaaggaagcaugauggucuauuuauucuugcuugaaaauuaaagucuggaauuuguucaucuugacucuucagcuccuugcuaacugcaagaauaaugaguuacaguuggugauuagaacuaugggguugucaugaguuggggaugaccuguaacuaacacacugauauauuuaaaagaaaaacauuaaaacaugcuuuaauuuuaguuaaaaaaucauuuucuaaucucaucauguaaacgagcuaccauggaucugaaggcagguggaucuauuacuaauuguuagagacuuacuuuucccacaaccuaaggauuuaauucaagcauuuaacauagcacgucccacuguaaacuggggagaguuggggugaguaaacauuucuucuacaucagaaucugccugaagguggggacugugucuuuuuccuaauaaagugccugccaugugaauuccaguugaaauuggaacaaauauacagagaaaaaaggucagugaaugaggcugcagcuaaguuuucuugccacucaugagacaugugccuuuuggaccaggcugaggguagggugccgaagaguauguguugaaugaaucaaguuauuccauuuccagggacuuugauuucaggguuuguaaaauggaggucaaaauggaauccuaagaggacugcucugagucugcaacauguagcauaugugcaaguacuucaaaaggugacaggaggccccuacaaccucgaagucuaagagaugaccugguguccauugugccagcaauugagcaaggagcaugcuuagaauuuuuacagaauauugaagucuugggggaaauuagucuggacacagcauucugagaguuuaauaugaucuuccagcuuagcucagcuucuuaaaauuauucaaagaaguuauagaaaaucucugaaauaucagaauauacagacgucaaauacuucuuugugguuaaagugguauguuaugcuaaugaaacuuucaaaacaaauuuaaucauauuucccucacugguuacuuuuugauaugcagauuuuaccucuucuuguguggacagucuuucaaauacuuuuucccuccucugucugggcugguaagggcagcccuacuguggucgcauucauuuucagacaagcacgguguggugcgcguccuugcaaggcaagagauuuaguuuuagaugaaaaauccuuuucuuuggacauaugagcuauaagaaauauccuaaguucaauuccagaaaugagaaaaaagaaaauguucuggcuuaauguauaaaaguaggaacucaacagugaguaguugagggaugacaugaaccccugagaugcuuuccuucauacccggcggugcuucuuuguacauuuccucuggcagcaaugggcuauucucaaugauuacuuugccuaaauccuguccaaagaggcacacgugucuguggcuucguguuugugacagagcuacccaauaugaauaagagcugagaugaagccuuuuauuuauggcauaaaacugaauguuaaaaaaaggaaauuaaagacacuguggcuggcccucugcuuuuuaaccaggaauaaacucacacacuuacuguaugaucaauucaccuuguuuuuaaaaaaccucugaucuagaaaaaaaaaaaaggcuuaguaucucuuccauaaucaauuuucauaggcaggaaauucuucgcugugccaaacucaaguucacuucugcugaagcccaagcugcccucguguaucugaaacacugugagugggucuuuuaacuuuuuugaaaaaaggcugacagucuaagguucaggaaucaauagucuucaaauaggggucccauauaucuaggguaaaaaaguugagcaggguaaaaaaguugagcagggauacaagcacacuccuuuauauuucuuucauggaauaggcauagacugccuuucaaaaacagaaucugaugaagggcaggagggcaaaaaagaaauuucccagcaacagacuguuccagauaagcuuguaucuugcucugugucauguauauucuuuauaacaaguuaugggcuuucaaauauuaaauaacagucucuaucaugauaaaauauaauggccggaucuuucauuucuacugucuuuuaaaagccaauacauuuuuagcaaaugaacugaaguucugcuugacauuuucaucauacauuuccucuuaaaauguuauguaaaauagaaaugaaguuuuucucagcuuaggaaaagagaagcagaagucccaagagaccauaaagaggacagcccaguuguuccagccaagaccacacuagaucaaucuggagccagcuugaaccucggaaagagcacagguaagaucagcagaguugccuacccaguagagagcccagugaacccagaaguacaacccgacugauccauggugcugugaacaguaacaaaagcuuauaguuuuaagccacugagcuuggggguaguuuguuacacagcaauaaucuguguaauacagucuguguaaagaguguuuuuaugcaacaguaacacgugcccaaaugccuuuuaugcuacaggauauuugaauacaugguucccucuauucagcauuugaggcaagaaagaaaacaauuggucauuccuaccacucaaagaucccacccacaucuguuacaacacacagaaauuauggcacuguuccccauaggucuuaaauaauaugaaagaaacaauggacaaauggaaggacccugggauaaaauuucaaaggccugcauuuuagcucgucauuuauuguacuaacuauguaagcucaggauagucucuuaaugucucugagccucaguuuccuuaucugaaaaaugaggacaucaguuuuuguucauugcacacaggaucucauauauauuuagauauauacaugauugcaacacaauguaacaugaacaaaaauagugggagcccuauaccaauuuguuuauucaccaaacauuuauugaguccuguagccacuaaagaaacagagucaaauaaagcaugagggguucucccuucaauaaaugaaaugcacaugauauauaauauagaauauaaggauuuaauauacacaaaagcuuugagaugugaaaugcuaaggcagcaguggaggaaggaagguagaaagaaaccaaggaaggaaaaaaugagggagggaggaaagaauuuuuauccaagaugagaccagcauuccagccuggugcucuauaacuagagauuaaagggaagacagaguauggaaacugucaguuauuaagcuuccaguggguucaccucuaauguuaggacugucugucugaacuuggcuuagugaacauuuauggccacgcucauguccuugggauucaacguuuucugagauugcuuaauauacgugauggauuucugccugagccauccacaugucaauaagacaucugagagagauagacaaauggcuuauaauuuugccagauguuugccaaauaccguuaagauauuaauguagagaagcucuuucauguugucaauuuuagaaauccaaaucauuagagaaauggucuacauguagauauagguguuuauaucacauaguuaguuuaaaugaaaaaccucacuuuacagcauuucaaaugguuuacgccagucuauauaccccuaagugauucuuaaugagguccuggaaaugcuaaaguuucuaaggaucuucagaaucaccacauauaaaucuuguucaguauagcuuuuguucuaaaugcauucuauuaauuuuuagaaaauuggcagucuauguaugagauauaugcuagcccacuguuggauaugauuagucaauuaacuauaaccuucuuuccuaaucauuauagaucugaacagugucuuauaacugggaguguuuuucauccauccauccaucugucuauccauccaaauagacauccaagaaagaauugccuguuuauccaguccuucugucuacucauucauccaugcauccaucuguccauccuuccaacuauccaaugcagcugcccauucaucugucccauuuuccauccauugauccaccuauccauccauuuguccaucuguccauccuuucaucuauucaucuguccaucuacuugucugucugucuaucuaucucuguccauucaucaauccaucuaucuuccuauccauccaucgauccaaccaauuaaccauccacccauccaaccauauauccaucuauuuauuucuucuucugcucaaauaguuauugagcacuuacacuuuguuugccauuaugcauguuaaagacacaagaguaagaagguaucauuucaagagauucacauucuaguaaaagacacagucaucuaaagaaauaacuaucaugcacugagcuagaugucagaagggagauauucauucuuagacucaagcaauaugaauucaaaaccuaagggacagguuguaagaugguacugagacucacagaugaggaagcugauaguuuagccuguggggccauagggaaaaaacaucucagaagagaggaaucuugagcugaauacccuuauaagaauaugcuaggucuuauucacucagaaauccucagugcacaguccaguaucuucuccauaaggaauguucaacauauauuucuuaaaugaauggggcuuagagaggcuaggagacauucuggaugaagggaccaaugugcgcaaaggccugaggguuggaaaaacguggcuacaugauggaauuuagguuugcgguggccuuuaaaggauggggucucauucaggaggccaaaaggggaggaaaaaacauucuggaugggggagauaugagaaaauacuuccaagaaugacuacaucauguuugaaggggaguggaguggcuggugucacugaagaaaaauguggagacagggauugauggggagaaauaaugaggacaaagagaaguggggagauauagugaaucaccgcaaggaaaaauaugcuagacuuggcaacagaaugaaaauggggaugaagaagacgacuuagagguaacaauaagguuuuaaccccguauugggcuacugaugguaucaaaacagagaagaaauguaggguagcugguggggaguagggaagccaguuucuggcaggaauaugaugaauuugguuugagggggcaugaauuaggaauccagaggcugucagagcaauggcauuguggauuuggcaagagagcaccuccaaaguuagauuauuuaggagucaaaccuuagagaugacuguugaagucguaagcgaggaugaacaaucuaaggugagagagaggaaagauaaaaaaaaaaaaaaaaaaagggccaggaacuaauccuugggaauugcuaguaguugaugggaaagggaaaaggauacggggaugaaagcagaugaacugugggagaaauuggaauaaaaaaccgcagaaaccaauggagaaaagaauuugaagcagcagcagccuggccaaguguucaaguagccgccagucagaaagaaugaagaaggagcaaaguucauugguuuuggcaauggagaaaguugugacuuucgagagaacauuuguagcagagcaauaaggauggaagccagacuuggggguggggaagguuaagaggaggccagauaaaguccuucaaaaaucagccuagaaaauaaacuugaggccaagcgcuugaaaacauguuuuuuguguaauccaaccuguaggagaagucagugaaacuacccauguuuacaaacacaaaaaggcuguuugaacuucccggagaauccaaaauugcucauuugcagagagaggcucacuggagggucaauauggaaugagaucuugaaauaugcauucacuuaaauucuauguaaauauccaaagcaggagacuugagcuaaccaaaggcugggagaaccgagugcuuuccaggcagaaaagagagccaguuugcagaccuagagagaagcaacagggcagcuuuggagcucugcagggaauagggugaggcuugcaguucugggcuguggcuggaccacagcucaugugauugugugaacuuggccaaggagacuuggcuuuuaaguuuauuagggguugcuguuuagacgagucacuguucauggugaagaaaugauuagggguauagggaccacugaaguaguugcuagaaguuccgagugagagaagagggaugucuaaaccagggagggacuguagggaagugccaggauagcagaugcaaggugccaggcagcaggaagggucaaggguuuccagcuugcacaaugauggugagggaacaaaggaggaggaaaaagggccuccuccuucuccacuuagaauuccaagugcccaugugccacccaaguggaguuauccagugugugcuuuauguaauuggcuaucuggguuucaggcuccagagaagugauaggcugcggagagagccuugggaaaagcccauuuaugauuggaaugguauccauggaaaaugaagaggaauuccuuagucccuccggguuuuguuucuucuagcucuugacuucuagaaauugacuuaaugugaaauagacucaguuauucauuccacuaauaguuauugagcuacuacugugcaacagaugcugauguagacauaaccuauagaggaacucaaagcagaagucucuacuuucauggcaauugugugugugugugugugugugugugugugugugugaaugcaaugccauguggaagcaaaacacaaagaaggagaacuucuuucaaguuuacucuaaagacacccaaacagcacgucauugugagaaacugccuuaugcaagaaugguuccauguaauuuguugaccuaccuugcacaucaggaauuguuuacaagaauuacuaugagaaaauaauaacuauuccuugcccuuggcuuugaaaugcaaagaugagagaaauuccaauccauuauggaaauucaaacucauaauugccaacugucacagaccaguuucucaaauuagggcuguggugugugacccagacuucucuugcaucucccucagcuguaaggacaguuugccaugaacaggcaacaucacugcugucaucaaccccagcccuucggggugcuggcugugcuaagugcaugacauacauucucauuuaauucuuacagcagccccauguggucaauggcaugauuuacuucccaaguugcacaugaggaaacuuuggccaagagacuuuaaaggucacauuuaagccaguaauuuauaggaccagaauuugaacccauuucuaucuaauuccaaagcuauauauggcucauacaauaauucuuaaaacuuuuugcuuuuucaaaagauuaguguugguaacaagaauguaaugaggacuauaacuagaaaauuuuucuacuuggccuugguuguccugaaugccauugaggggucacucucaguccacauguguuacuaaaagaaaaucuuaaaaaaugaaacagcagaaauaagccaaagcucccaggucagucucagcauaugaaguguuggcuagaauuguagccaacuuagccuuccccugagugaacuuaucaguuucucaauauaaauagaucaucccaaauugcacugucuguaaaggauugcugaauccuauuuaguucacaaaaaucuucuuuguggccuacagaacuuuaauucucagguauuuauuucucuggagagucauuuggaaaagaaagaaagccaucuccaccauucucugcauagcuuacagccacagucuuggaugucuaauaugaacagaaaauccaguuucuauuccugggaaugcuucugcuaaggggucaaaaaaaaaaauacaagauguccaagaaacaacauacaaaacguuccugccagagcuucacaauccacuucccuuugcccuuccuuuucccuuccuuuaacacccacacccaugcccagaaugggcuuucuuucccuuuuaauaaaaaagacaucugcuaaugccuucuaagguagaggcagccuccagcccuugguggagagaggaaaggcaaugguagaucagcaagcaguagagaacuccaacauccccggggccaucuauuucuuaccaacccauaccuuguggguguaagaucaguaccaguaagacaguguuugggaucuagggggaaggcaguuaacauccaagaaauaacuagaguacauacaaagaaauccuaggcugcgugcagucaauucuuaaugugaucauucauuuucaaauauuugcugacuaaaugauacacacaugacuaaaacuuaauccugacagagcuagaaaaaaaaauuaacuggggauccacuauguuccagguacuguucuaggcacugaggauguggcggugauaaaagauguuuccagcuucuugguguuuauuuucuucuugggggaggcagaugauaaacaaaugcauauccaauauaaugacagguaauaaguguuaugaagaaaaacaacgcagggaagagagaaagaucgacaggggacauuguacugugaaguguggcagggaaagccucucugaugaggggccaucugagaagagagcugaaagaggugaaggagcaaguguuuuagauaucagggagcagaaacuauugcauguauugagggaaaaguuuucccauaaauuaaauaaacaagcuagaguagcuauuugucaauuuacucauucauucauucauucacuaauuuuauucaaauauuuacagggaaccugcuaugguuugaauauuuuuccccucuaaaacucauguugaaacuuaauccgcaauguggcaguuuugagaugagaagccuuuaagaagugauuggaccgagagugcucugccaucaggaguagauuaacuuauuuaugaauuaauggguuaauggauuaaugggucaugagaggaacugauggcuuuauaagaaguggaagagagacgugggcuggcauguuaacacacccaauccucuugccauaugaggcccugugccaucuugggacaccacagagauucccuaucagcaaaaagacuagaugcagugccuugacuuuggacuucucagcccucaaaguaagaaagaaauuccuuuucuuuaugaauuauccaguuucaaguauucugguauaaccaacagaaaacagacuaaggccgaaccuaugcaacucugugcccggcacugugaggguuacuggagguguugauggugaagaggcagacgugguuccucacugagucacagucuagcccaggaguggcaaauuuuucuccuaauaggccagauagaaauguuguaggcuuuugggccuucccaguuuuugucacacuacucaacucugcccuuguagcgcaaaaagagccaggacuacacgucaacaaacgcacagggcugugucccaguaaaacuuucuuuaccaaaauaagcagugggccggguuuaaccuauggacugcagaguuggcugaccuguacacuaaaaaacguccuugauuguuaagaaguugcuugugcaauaaaucaaacuuagggaagaaaauaaauuuaacaaaaaauaaaacaauuaauacucacccccucauguuuuuuuguuuuauuucagcuaucaggcaacauacuagaugucaguuguuauuuucugcacagcagugaguuccccugcccuacaccuccacgcacagauacuuucucucgggaaauccccucccccacccuaaccauggccugcaguauuuguagaccccugcuccagagguagacacacacauuccucaccuaaccaaacacagauuaacaugacauuacacccugaaaacacauggggaaacaguguggcaaacacaggugacaugggcuucuuucuaguuggggagggggagugggaagucagccagagaaaaucugcacagaacauucugcaucagaaugucugggccgaguacuguuuaacuaggugaagaauauucuaggcugaggggaaagcaugaguaaagaucuugggaacauaaagagagucggggaccucugguauuugagaggugccugagagauguuggauguuucgauucucaugaggccugggaacgaaggauggcguccaauccugccagguugcagcgaagacccagugacaauccauacaaauguguucaacagaugcacgccaaaugccuuuggagggcagauguuaucaaggccaagggagugucgacauguaagauacuccaaggggguuuauugauugcuccacauucuuaggaagcaacacuucagaugacugguuuuuuuggugaugugaaagagaguucuuccacaauucuuccuuuauaagcauccaaagacuuuccaaggccauugcauuaccuguugcuccuuuggaaaauaacguggucagaaagggauccucacaaauagcugggucuaaaucacacagagaugaagaggaugggcuuaaagauuccuagaguucucuaaagaaaaguucucugcuccccugucaaucauuccuugagggguggugaagaguaugccugggcgccaguggcagaggccacccucccucaaggaggcucccauccagugaaagggcaacgagagacuagguagccagaaaagucuguagguagcaaucaauauaguuguguuuuauuuacucaaaucuuucaaaaaaaaaaaaaagcaaaagauggcaggaaaaaaaucaucucuauagaacuaaaauuuugaauauguaaguacuuuaacuccucaugcauuucauaguauucaccaagugaauuauaguuugcccgucuuccuucguaggauaucuguuuuucauuuucaagcuuuaaaacacaaaaucauaccuuaaaagguaugucauuaauuccuccaguccugacaacuggaauacguauuuauauuuaaacagaucugcuacauaaaaucuagacauacuuaaaguagagaccaugauguaacagcccccauucacucaacacucugcuucaauggucaacucauggccaaacuuauuuucuuccuacucccacaccucccaagauuauuuuguaguaaacccuagacauugaauauuuacacccauuucaaaauucuuucuuucauuaccuuuaucauacccuugguucauuuuagacgggugcaguauuaucuccuccagguagauuuuaguaggcagaaaggugaagagugagaacugaccuucuaagaacuugagagaggaaaccagacuaagagauuuggggugcccacuugaucuagauauaugcaaagcagggccagcuaucuuggaaauaucuggaaugcaggcagagaggucaaguugcccuaacaagccacuggcacgagaauguuccccccgccccuuaccaagucccuuccaauuaacaaccaaagcacagucagcaagaauuggccgcccucccccaaccccagccauuuucauuauccugagaacauaugguuuaacugugcaugcauuuaagguugucuagaucuuaagcuggaaaggaacacuggacucuaaaauaauauuuuucucauuaauuucaccaggcugacuuucccuugcccagccuguuugcccacuuacccuauaaucuuuugaccaaauucaggaaauugcacaaugguuggucagcuccaggaacugccauuuuuaaucacacagucuguuuuugcuaccauguaccuugacuacagaggggcccguggucaacuaugauuauuggcuuugcugucucaucccagggcucuuguucauaaccagguuuauuuaaaaaaagggccagcucagugggcuaugggaacuuuuuaggaugccucuugacuuuaaaaaguagcaagaacuaugaaacaugguuauaaaaaaaaugccuugagcuaacuaacuucaaaaagaggaaugcagguaggcauggacugggauuccccucucucagaacuauugcuaacuuccagauuuauggaaaacagauugaaggcuugauugagaaagcuaagaaacacucaacuugagacaucugcauccugggauccccacaagaccuaucuggcagcccaucuaaagaauucuguaucucugggagugucccuagcccucuucuuauucuauguguaaugagauccaugcccaagcccuccacuauuaaggacauauauccaggagacucgaaucucaaucucuagcccagaccuuucuccuaagcgucagaugugaccaucccauugcccauuagauaucacuggcaccucacauugaucuucucccuaaaauggacucuuuagcugcuccacauaacucuuucuccuuccauguugccaccucagugacuggcaccauaauccaucugagggcccaugagucaaauggaagaggcagaccuauccuccucucuuccuuauccaguauaucuaccagggucugaugagucuaucuacuguuucucaaacucacucccucuuugaaugaugcuuugcagacaauagcucaucuuccaaaggugggaaaauaccauauaugacaaugaacaguaaaaaguaaaaacaguacuguuagagcucaaaugggcugccggguuccacagaugacuccuuacucauucccucuugcugggcccccuauaauaccuugugaacugcucagguaaccauagguccccacuaugaggacagcauuuaaaaccucuccuucccauccuaacuacucugcuaagacccugcccuucaagccuucaaagaugauuuuugucauuaauuuuguaggucaucuccuucuuaaccccuuaaaacagucaguucuauagacuaaauguuuguguccucuccaaauucgcaaguuaaaacuuaauccccuaaagaaaacuugguacauauauacccuggaauacuaugcagucguaaaaaggaacgagaucauguccuuugcagggacauggauagagcugaaagccauuaucuucagcaaacuaaugcagguucagaaaaccaaacaccacauguccucacuuauaagugggagcugaacaaugagaacacauggacacagaagggggaacaucacacacuggggccugucagguggcgguggggagggagaacaucgggauaaauagcuaaugcauaugaggcuuaauaccuaagugauggguugcuagguguaacaaaccugcacauccugcagauguaucccagaacuuaaaaugaaauuaaauuuuaaauaaagugaaaccuaauccccgaugugaugguauucaaaggcgaggccuuugggaggugacguagucaugaggguggagcccucauggaugggauuaguaucuuaaaugaguccugagggagcuugcuucccccuucugccaugugagguuacagcaagaagacaccuaucuaugaaccagaaaguaggaccucacuaggcaucuccuggugccuugaucuuggacuucccagccuucagaacugggagaaauaaauuucuguuauuuauaagccaccuagucuaugguauuuuuguuacagcagcccaaacagacuaaggcaggccgaugcagacacacauacuccuuuuccucaaggcuuuaggaaacugcauaaugucucaagaacuaauauuuucaaaaauguagacagauuuuacugccaaguaucuuaacugcaaagggguccucauuuucucaaccucaauuuacuuaagcagcaaguguucccagguuaaucucaucuuauuuugaguaccauaagacaguauucucucuuuaugcuuggaauguuuccaaguaucaggcaaugauauuugaacucauauccugaauagagaccaucagaauucuacagcuggaagggaccuuggagaucaucuagaaucaucagucuauagaaaaucucagauauggugagaucacaaaagcugagagagagagagacagcugggcuuacaucuugacuguguagcuuuaguaguuguguaaauuuuggcaaauuaucuggccaaucucggugucaguugccaugaccaugaaagaaugguaaugucucauaaagguguugaaaaggcccagcacucaauaaauggcagcaaacuaugacuuuccuuuuucucaucucauagcacacagcuuuaugaucucaugccaucuuggucaacauucuuuggauaauguccaguucuagguaacuucccucuuaaaaugaggugcucagaauaaaaagcacuaauguuucaaggugugcucugaucagcccccaguacagaggguuauggucuuucaugaucugauuaaccaaacaccuuaaaagggaggacaugugacuaccccgaguugguucauggcaagcuucuggucaucagauccucagcuugauccuucccaaccuguauuuccucuaccaauuuggccgagucugaaucagaacguaauguucaccucuguuaaauggcaucuuguuaguacuggcccaucaauuacuucugcuuagaucuucuggagccuucagagcuucugaauuucucacucugccagguucaucuaggauugaucuuagaagugggccuucugcuuuggcccccuucuuuucagucucuaaaugcuuaucaggccugcuaccucuucagccuucauuguucuaucugcugccccuaaaugccccucaccaagaacaugggacaaaacaauaaaccuuuuaagugcuauugcuuguuaggccaccagguuuugauaccauuucauacgcauaccagaucaaauggagcuguaagccauaacaaaggaauucauaauuacuaaccuagauuuggacaugacuggaauuggcuagaagccacaaauagaaaaaguacaaguuacuuccuaacgugagucaggucucuugaaaaaaccaaacauaaucagguauugggcucaaaauauagagccaagcuuccuccaaacuagauaccuuguggcucacccuaaaacaucuauaaugucagcugcugcuauaauggauauuggaaaaaauuuuuagaacuaaaauauaguauuucuccugggaauguauauaaaaaaugggaagaaagcagcaauuacuagagaaacucaauaaauaacuuagcaaccugucacuuuucuucaggugcacugauaacacauauuaaaaaaggauucaaaacuugcugccucucaaaagguuuuuuuuuuuuuuuuuuuugucgggggaggucaaguuuucuggcaaaguuccauucagaucaucagcaggaaaaaaacauccucuauaaugcaggcaaagacuuggaaugugcaucacauuuaaagaaauggguuugucuaagaccuucccuuggcacugccuuaaaaucaagggaaucugaaugcugguccuccuguauuauucauuacauaauugcuguguuuuauuagaaauaugaucuauuauaaccuugaauagaguacauuaaaugacauugaaaauuagauuauucugauuauuagagaagugagaaaugugcuaaacauuuguaagacugauaaucaaucaggguauccauuugaguguaauaaaaaucaaucuggagccaguguguuuaaaucuaauuuuuuaagcaugacauuuuccucagaguuucuuucuaaaaugucaccaucuucuaccacagugauugauucugucucuagggagaagcacucacuccaauuacuucauccacugcacacaaaccacaguccacuucaaaaaaaaaaaaaaaaaagccaaaugaaucacagaaaugacaauauauuuuacagggggagggcacagauuuaugucacucaagcuagaaaaucacccaucuuccuuucuggggcucaaacagauaaaauaugcuacuaagaucacaaugugucucuuuacuuacuuccaacagaaaugagggguuuuuauauuggguuuguauuucaccugagaaaaaagacuacaaugacuuauguaaaaucauuauuucccccauaucucuucagagaaaaaaaaggauacaaugacuuugucuuaauuuacccuuuuuuccauccacccaccgucuauccuccuuucuucccucucugccuucucuauguccauucguccauccaucuacucauccauacauccauccauaaacaauuauuaaacuccaacacagguuaccaagacacugccaacuuggggguucauugaucuuuuuccuuuugaguauauucagcuuacacagggugagaaggaugacuuaugacaucaaaggguaacccacugaacucauccugcuuucugcaggggguucacuagguuggcagaaaagcaaugaccgcccaauaauucagcuuggcccauuaaauuggcacaugggacuauucauuuuaugaaauuuugguauguuccugggaacaguaguggaagggggaagauggcaauuauugagcauuuaccagggccaaguacuugacauccauuagucugcugaaauuccaauggugggaggagaccucuguuuuucuggccuuggguuuucauguacagacaggccuuucaccagggugacacuccuggccucuuucucuaccucucuuucucauuuucccagggaggaagagaggcuuauauuggugagucuuaguaaaggcucuuagaauucuggguucaaacucucccaggccuucuccaugugugucugccugcaggaaacagaacaugggccuguucuccaugacacggaagcucccaggagcaggcucugcccuuggaggaggccuucggguaucaacucugcuguuaccagguagcuaagcuuaucugauuugggggugaaauuuuaggaagcccaucaaggcugcaccuguaagccccauccuccacuaagcaaauugcuauauaaguuaacucacacuaguaggaaggaacauuauguugccauuaaaacaaucuuuucaaagacuauuugaugacacagaggaaauauucgcaauguuaaacuaaaacaugagguaaggaaaauuuaaauauguguguguaugccgagaaaaaacucagaauaaaauaaauaaaaauauuaguaagacauuucuacaacauagaauuaugauuuauaucccucgcugucucccucaccuccuucgagucuucuucuuugcaaauuuccguacuuuccaaauugucugcagugacccuauguugcuuugauuauuguuaaaaggguacucuuuuuuuuuccauucaaaagaaaauagcuuuucucuggcacuaauaaguuucucagacuagacagugauuaucagaaacgaguugcugacauucugauccccauucaauuuccacagcuaccuugcaacugggccugaaugugugagggguggagaggccugugaauacuggacuccuccccaccacucaucgcucccugcucuccagggccccagcaccucucaucggguuagcuucuguagccuccucacacucucucugccucugcccugcccuccccuccagucugugcucgacggagcagacaccuggaugcuauucaccccaguguggcacucuucugcgcaaaacagcugaugccauugaaguaagagagaaaagcuggaauucgcacacagccuuacaaagcccaugugaacaggaucucuuccuguggccucugauuccuucuccugcugugggccccaucauguauuccccuguagacacaauggccuucucgauggucccuacacaugccagggcauacucuagcuaagcgcuucugcacuggcuguucccucugccugggugcccucucuccccuucuccccucccagaugucugcugucucccucaccuccuuugagucuuuacugaugugaugugucaccuucucauaaggccuuccuuaacuaauucaucaaaaauuacaaccugauuccccuuccugguuuuauuucacuucuuguuuugucuucuuuauuauuuucuccccaaacccacccaaaagauauaagccccaggagggcaggauuuucaagaauucuucacauguuaucaccagcacccggaagagugccugguacauccucagccuuucauaaauuguugucgaugaaggaucuggaagggaggcugugugcugggcagggaggagagaggggugcagcccuuggucugugggcuuguagcuacccagggaggagcugcaggacaggaacaaugcagagagguguucugucugaccuuuacagcccuggccccaaggcuuuacccgcuacucagagcaaugccaaccgcacacacaggggcacggagggaaugagaguggagagcgggugaacguuggauggccagcugggucugaggagaacuguucacugcaaguaacacaccuggacucaaagucuagguucuccugcagcuucuggcuugggagggcaggacacaagugaaugacaguaggcuaggaggacugacccaggcagauaucuaagccacacugagcaccuuugagaggcaaggagacaaagcagagagcuuccuugugguucaguagagcccaucacugccaucuuucuuaagggaaaaguacaaagguaugccagauagaaaaugccuagccaccaggccaggaaugguggcucaugccuguaaucccacagcuuuguggggcugaggaggguggaucacuugaggucagaaguucgagaccagccuggccaaaaugguaaaaccccaucucuacuaaaaaaauacaaacauuagcugggugugguggcuacuuuggaggcugaggcaggcggaucaccugaaccuggacggcagagguugcugugagcugagaucaugccacugcccuccagccugggcgacagaacgagacuccgucucaagaaaaacaacaacaacaacaacaacaacaaaauguacagacaacagaauaaaaucccugauuucuuacauccuauuucuugaaaccaauagcucaagugaacuuagugcaacuacgacaacuguagauucugucauagcaacugcuugaaaaacugacuucaguuuaggacaaaaaucuacacacuccagaaagagggaaggcaaaaagaaaguccguugaaagugcucagggaagguagcagccccuuggagauauugccuguaauguguagauuacugaaguggcauuuugaggagggggcgggggaaugaccaugucaaaugagccagacaagucugccuguuucccaaauuccagaugagcaguucuacaaucuaccaggagaaggaagaggaggaggauuuuuugguguguucagcuaaacaucagugucugacaagcaacacagggcaugagaugaacuaacugaaguaaccuuccagguaguaauugguuuuuggugaagauagcugcuaaacuaggucuuggguaacuaauuucccauagucuccauauagcaugagaaccuuauuaguaccagggaaaagcuucuuuguuuugaaauuuuacaaaaguaucauuuaaaaaacaacaugggcucacuguagacaauuuagaaauugcugaaacuugcuaagaagaauacauaaaucuuaauuaucuauguccucaaaauaagcccuauuaacauuuugauucauuuuauuguuuuucuaugcauuuauguauuuuuuucaacaaaaauaauauauccaauuuuucugaucuuguuuuucauuuaaacuuaacuuuguaaauauuucuucauguuauuaaauggccuuuggaagaaaauuacuuucaaugccaguauaguguucccuucuaugagugugaauuaauuuuguauagccauucuuuucccgucaguccuuuauuacccacucuaugcuagcauaaauaaugcugcaaugaacaucuuuauacaucaugauuacacacauuuuucauuacucuuuaaaauagcuucaagaaagggauuauaaaggauuuuucaauacauggccaagccauaugcaguuucuaauguuaagcuugcgucugucacaggcuugguucuugcucuucauugaagaucaugggggugcaucuauggaagguuacuuuugcauuuccaaucuugcuccucccuguggggagcugacugcucuucucgucaaaguugcccaucugcuagcccccacuggcaggcuauuacaccaucccucuggucaaucuaucacuccaaggaacauugccaucguccaucucacuuaggucagcgcugcuugcuuaauaguuccccaaauggccacagauggccaaugggcagauauagcaacauaaucugauuauaggacaacugugacccccuuggccaaccacccagaaugaguggauuugccacauugccccuccaagcugcagaguuauugaggcacucauggaagggccaucuugaaguacacgguuuaauuauuuucacugccugaacagacugaauuuucugucuuauuuggaggauguaugucaaggagaguaggaacugguuggggggagcgaggugccuuuaggaaaaaauucuuucuggcaacuccuaguuaauuaagaaaauauuagcagccagcuccuacucacagugagcuuugucuuuuaaaagccaagucuuuuaucuguucagaccccaaagcucuauggauacuuuagguggucccaaaccacguguacauguguauguacacaugagugucuuggcaugacugacauuuucggccaaauauucuuugucacaaggcccuuggcaggagguuuaguggcauuccuggcucuacuaguaucucuuccagguguuauaaaugucaacagacauuaccaguguuuccuaaguggcaaaaucaccugcaguuguguccauggguauacacaaauguuauaaucuugaauuugugagugcuuaagagcacaggcuugggaaucagauuaccaccaccaccacuaacuaugugaacacaccacuugauucugauucccuaucugcaaacagaaacaauacuaaacacuucacagaguuauuguaaggauuauguaagaaaauggauguaaggacuugggagggcccuuaguaagugcuccauaaauuuacuaauuaccugcuccauggcaguuacuaaugcuguuaggcaaguucacagccacauggaaaugcuuauugcacaagggaacagaggagggcaaagggaugaugacuuuuucagaaauaucugcacacacagcugcaaagcuucguuacauaaaauuuuguauuuuggcuaaauuccagcugucuuaguccauucuuagaugaguuaagacaaaugaacagcuuuuauuaauacuacaguaggaauccuagacucuugauugcucccugugguggacccuagacaguuugguugauugggaggagcaguacuuagcaucuauuucucuaccuuaccaccacccuaauuuccuuuggaaaaauuaccucuaccccauuggguuuaauugugauaggaugaaaaauccagucacuuauuacaggggaugaggagguccccaaaggcaggcaccuaguauucuacucacauaaucauuuuuuaaaagauuuuuuguauacuuuauuggccugcaaguagaauggaaaaacauggccuguaagccacagcucuccuucuuucaacacccauagcagacauacuaauugaucauagcucuugucacaaauauagccucagaauccgaugauacaauugaucagcauuagcugauagcauuagcugaucacuacuaauuggucagcauuagcacacaaagugaaaccucuucuuugccagcccuaaucuuaauaaaaggcuuaagcuaugccuagcuuuccuuucuucuucuuuccuuuucucucuuacauccuuucuuccuucuucaguugacaauuuauuuaacaaacaugauugaggucagcuaugcaaagaugguggaaauacagcuaccucccacgaaacgaauagcagaguucucagcuaguaccaugguggugaccacagaggggcucaggagucuguggaggaaggggccggaggguuguucuguaaagcaguuggagacuagaccaaauucgaagguaaagaggaggauauuuacacugucugcuuacaucaugcacauauucacaguaugucacaauaaggagugagguguuggggccaauggacuagaaagaaguucccuaaaauauccaggcuuucggcuguguaaggggaaauguucaugauucuaagcuaaacucucccuuuuugacugucaggggcauccacuuuuucacuuguaaaguuugaacuggucuuuucugcaagaugaugcaaaagaauccugauucaacucuccuccauacagagcuagacucauucauccauucaacaaacguacaugccagggacuguugcaagcacuggagagguagauaggaacacaaaagacaaaaaucuguguccucaugcaugauuacaggagaguaaaggucagaacgaaagacagaaaaaagacugagagagagaaggagagaaaaauaaaauucagucacagugggugagggaaaguauuuucaagaauugguggagagagccaaaggcagcugagaggcugaagaggaugaggagggauucagggccacuagaguggcuaaaucaauggauuuaucaauagagagcaagggucagcaaaaugaucucugcgggucauaccaucucugucacaacuacucaauuuugugguuguccugggaaagcagcuuuagacaaugaguauaaaugaauaggcaugguuguguuccaaaaaaacuuuauuuacaaaagcaggugaccagcuagauuuggcccacaggccacaguuuacugaccccugauuuaggucauuagagaacuuaaaaaaggcauuuuuuuuuuccucugcagagugguugggguagaagccagaaugcaaggaguuaagaaaugagugggucaugacagccauuaaggaggaagcccccaccaugaccugaaugagcccuagccaacaagcuaguaggagugauuucuuccuucucuuuaaucuuuucuauuauuacuuuucuuaauuacaaaaaucauacaugcucauuauaacaugugaaauaauguuaugaucucucucucacuccuccuccauccacagcacccuggggcaacccauauaaaaugucugguaacuauuucuuggugccuaugucucaccuuagugguuauaggacgcugugaccaugucaucagaagcugggaugcuggguacaaucagauaugcaaucugguuaccagggaaacagaggucacaaaacucacaguagagagaccuccuuaauuagugauucuaaaaggggaggaggaugagggcggaaguuaaaaauaacaaagugucuauccagggagcucacugauaaaccagauucuagagaguuuagcuaguugggaauuaguuaauuggguaaccauaccccgagguguggaccaaagaguuggggccugcccagacacugaggcuccagaucaaauuaacuaggaagauuaaaaagccuaaaccgcuuuccuuccacuaagcaugauuucuucucgaaauaucuuacaggauuaaaaucacgaagcagauauuacagaauuccauggucucgcuggcuggaugcuucacuggauggugagugaaggaaggaauugaucaauuacuaaaucacugggucaauaaauaaaauaaccaaucaacuaaggaaauacauaugaaaaggacuuagcauuauuauccuuuuacaguugucacucgguauaugcaggggauuucaggaccccuguguagaaccaaagcugggcauacuaaaguccagcagucggcccugcagaaccuguguguacgagaaguuggcccuuuguauaugugggguuugcaucccauaaauaccguauuuuugauccacacuugguugaaaaaaauucauauauaaagggacccacacaguucacucuaauuuauauauaaauggacccacaguucaaacuaauauuguuuaagagucaauuguauaagacaucaaugugauggggauacaaaauaaguaaugcagucuuagauugcacuauaagaaauccaguguauggaucgaggaagaugaucauuuuccuguacucuggacagaccaccucuggaauaccaggauccauuaaugggacucucuuauuuuaggauggacauugacuaaagagaauguagagagugugggggggaaaaaagaaauacaaaacaagagaaaaaaaaaaagaaauaaaggggaaaaaauaggccaaaaaaaagaaaaaaaaaaaaaaaagagagagagagaguguggccagguggugagucugugggugaggggcauuccugaagcauaccacaaaagcgaccacugaaacaguuagagauguuugguuugaaguagaggaagacguuucagaagggacacaaugccuaugaccaaauauugagaauuauucucaguaccuugagaagguagauauagggccaacagguaggaguuaaauagguagagguggggacuuucuaauugucccugcuucgcucaaauagaaugcugucaaccaugagacauucuucccaugguaacugaugugucugccagaggaucauugccagguagcugugcgguuucccuuaggucucuuucaaaccuuaaaguucuaugcaguuaccaucuuucaacuguuuuggaaagcacaggcaacuggccagcuuguugguaucuaaaugguuguacgaauugagagaacucaaaugucauuaacgguugucuguucauagaucauucaagguuaauuauacacaaagaaaccuuuuaaaaagcuuaggcaagacuauuuguaauuaagcuugcuucaacuugucugugauuagcagaguaguaucuuggaaaaugcuggcuguggguaagaggaacuaaaaugugacaucaacugcuuuuaccucuuugaacccaaguauauuuaccugaaaaauaaggcuuaaaaugcaaucccuaucuccuucacaaaaccuguuguacagcaucucauucgguguugcaccaaaugaaaugauguauauuauacaauagauuuccucaaacuauugugaugaaggaccaugauucuaguguuuucccuccauuucuaauuuaucauggacaaauacuuuuauaaaauacaguaaagaugaacuacuagaaaaaugaaaugcugcuugaauguugcagcaguaucaaguugcugaaguuucuaaaugccuacucuccacgucaggcccuaacuuguggggccuaguaacaaauagcacaccaaacaucucugguccauggaccauacuuugaauagcacuacucuaaacuguugaagaauauuauuaugaacguaauucuauaucuuaauacauuuuaaaaaucacaauuauaagacaucuaaaacccggauguaaagauagaauucaaaaugaugcuuagcaaaaaaaaggagcccgcauuaccaagucaaucccuuuccuuuugauaaccagauggguuuaaugauauaacugagucgaauuaugggaauaacaagaaaguucuauauaauuaugaaauggguguaaaccucccauccuggcagguggauuccaaucuuucuggacacugacguaguagcauugggcauuuuaaaguccuuucacaauuaaaaagguugaauugacuuagugucugauaaaacaaugaaaaagacacuuguuacugggaaacaccauugcuuaaaaaaaaaaguuucauuguugauuuuaaaucuaacugauuacuuggaagccccugaaaacuuccagagauaauauccugcacacaagggauuuuguuucuauaaaguaaagaggcagcaguuuucacagaguuaacucaguaaaguagcacuuucuacuuggauaaacugaccuagauauccugacuuccaugcaacaacaaaauaggcaggcuaagauuuuggggucugucugugaggagagaaaagagguaggagauacagguugggagaaggcccuggguaaagaagagcaagagucuucauuuugauuauaguuaaaacuucuguccucagcuuuaugaacugagggauucugcuccaggcauucaagaagagagucguaaaucaaacggcaucaugauucagaguugggcccauagaagagagccuccuuauaaaagggagcugcagaaauacacacuaaaacccacaguccccucauuccacaggcauuuucaugauacggcaaugugggguuaggaaucaagggcaccacaguaaaacagccccacaagagccucagugacuacaucugcaauaugggaauuuugugaaaacugaaugagucagugcauaguauugcgaauguagacuauaucaauaagugacguuugugugugcacgcaaacagagugcagcacauucggggccuauucaaacacacaaccaauuuugaaaagcagaguaagacagucucaggggaagaacuauauacaguugaaguaauuuacaagaacauaagcucacauuacucaauuagcuuggcaugagcuuaaagcaucaaauggcccuuuccagaugcuucuuguugucagccgcuuuccugucagcaggccucucuugaccaaccucccuucccuuccacuaagccaaaccccucuuucaacuuccucugucccuguggguuuggggucuuuucuugacucaguuccaaaccaccccuuccagccuccuacugcagcaggccccuccucagcaaccuguauagagaggccccggagucagcuuuuugauccgggugcuccccaggggaagucuuugacuaguuuuucucaugauucugggaauuucgucuguuacucaauuucucugaacuggauccaccaucuuguuuagcacaauguggguuucuuuucuuucucaauccaaauuucacuggaaaacuccccaacuuucuuuuccuagggcuucuaaaaauccuaugucacagugacuuucauaaaacucccaugaagaacccucugccacuuaccccacaaacuuuucaccauuucugcucccagugauaaguuucugagagaacauuucuuccagaaacgcccagcugcauuugcucaacacagcaacacaucugcauuuuauuuuucccugcaguuuaacuuuagcuguaacaaacgaauccccccauauccaccagagcccagagauaaaaauuguugauuguuuguuuguuuuuugaaaccacaaaucuuaucuagguuuguacucuacuuucuaacgaaugguuugauuuaaaacauuuuacccuccuucaagugucucaauuccauuuugucguuuuucccccaugguggguuuuuacuguaagcuagcuuaugagguuguaaugaauuggcauaaucuaacuuccauuucagccuucaaggaacagacccugcuaagucuucugaggcaugcacacuuuaauauucuuuauuccagugucgugucuuuagcaugacaaauauuauuagcauuagacuggaauucugcagacuaugguaucuaggccuggcuuugucucuaacuagcugugugacuuuagaaaagucacuuaaccuacucuuggcuuuaucucuuguucuuaaaaugagauuuaguuauuuuuuuguuucccuaucaacucuaagaguuggguucuacugaauauguuuugaauggugagauauuaauagcagguaagaggaaaaacauuguuuaguauaguggguaggugagaguggauggggaaacuugguaucacuguugucaucuuuauguccuccucaccuucgcuaauagcuuucucuguaucuggaacucuuguaagccacuucuuuuuccuugaccuacgauggaagguggggcuacaucucaauaagcccauugcaaguugagaauauucuaaguugaaaugcauuuaagacccugauaacacuguaaaauaaaaaaaauuccaaguccaaccuccuaagucaggaaccaucuguauucauuccauuugcccagcaacuuaaugaagcagggauucauauuauuucccauuuaagagacaaggaugguuuccagcuucaaccaugucccugcuaaggacaugaacucauaaaccaucauucucagcaaacuaacacaggaacagaaagccaaacaccgcauguucucacucauaagugggaguugaacaaugagaacacauggacacagggaagggaacaucacacaccagggccugucgggggcuggggggcuagaggauggauagcauuaggagaaauaccuaaugaagaugaggggcugaugggugcagcaaaccaccauggcacguguauaccuauguaacaaaccugcacauucugcacauguauuccagaaccuaaagcauaaaaaaaaaaaaaaagagauaaggacacagagacaugaagagguuauuugcccgaugucccauggccagcaggugguagagccaagauauaaagcuagguugugucccuaaacaccagacaauacugcccugacaucacuccaagcaagugaccacugaccccaaccaaaagauuuccauuucagaauucaucaacauucauuaauuaagaaaaagaaaagaggaacaaguuuuagaaugacugauccaaagcccucguaaauuaaguaaccaacagaacacucagcuugccuggcuaauaguggagugaaaaccaagccccuguccuugcugcuuuuccuucacugggcaacucaaaccugacuacuuucuccuccuuccauugcauaucauuaaugcaauacauccaguuugcuccauuuugcuucuccuacagccacauggcuauuuugaucauuuucauucacuuuacuggcaagcauacagaauauggucugggcuucagaaugacacaucugggugcaccugaaggaagggucucuggaggagugauggccuccaccuccucagcagaagcuggaacuucuuccaguguucagggcacuagcagcccagcauuagccugucccaucuuuuaguuaaagaugauggcuuaggugcuagucccaaagccaacagguaaggacucuuuggauaaaacaaaauacaaaccugaaaugugauuagauguguuucacaaaguuucuucugaaaaaaaaagaaaaagaaauaaacaaaaacuaugaccugugucacaaaaguguauccaaacagguauguucagcaaacacugugccggggggcccaggaaagccacugauaagggaaccuguuacacccagauacuugacggaagaaggaaaagcaggaagagcgggagaagcacacaugacauucccacagggcuugugagcagugaccuuucucuacuuaugcuauuaaggaaaaaaaguauaaaaacccugaguacuucucagacucaguaagguaacugaggacccauuaauaauaguaauaauaauuaauauuuauugaauguaguacuuacuauauaccagguacaaaguacccaagcacgguacauagguacccauccaaacuucucuacuguuaagguagguacuaugauuacucacauuuuacaaaugcucuugguuauuugcucaaagucuuaggucaacaaauggugaagcuggguuuucagcuaacauggacugauuccaaagucuauacuguuaauaaucucauuuucugaugauugauuauaaaagaauaaacugaaccuuuaauucucuaggaaguuggagcugcauugagccaaauaaagucaggcauuucuucaacuggcacauaguaaaagcauuucuuaaauugcuagacaugagcaaggacuuauugcugcuucugaggaagaacucugagaagcccccuaagagcacugaaaguuucaacaggaaugagucucaccaucacaagugagaaaaccaggauuuaaagauuuauucaaagcauugaaguguuaggaaguaaggcauuuacucuugcccaagaguuuacauuacuuuaaaucaugcuuucaauuacauaauuuaaaacuuauuuauacagauagucccugcuuuaaacuuaaacuuuguuaauugguuuucuuuuucauuuagcauugucuaauagaaucauguggguucuuuuugcucccucuaugggaucguuuuaugauuucugccaaugacugggcagaaugaaagcaacaaaguagaaaccuagauauaucguuugcaaaguaaguacuuacucuacuggcuggcacauaagauacaaucuccucccucacuucucacuaaucaaacauauccaaacuuuaucuugcauuccaugugcuauacuacccauggagaacuaaaagcccaagaugcaaaauaauaaacaaugcuauccuuuugugaaauaauacaccacuauccaggcaacuaaugacacauuaaguuuggcucauuaguguuuucgauugacuuuggugcuauuacaguccucucacauuccaguauuuccugauaccaauauauuuaucuaugggauuucauauuuuuucagggcuagcaaaacauaaccacauuuacagaacuuauuauaccuuauugaauagugguauaaaguauaauauuauuguuauauaaacaaaguaauguguccccuucccauaaaacugcauauuuucacuuuauuuauaaaaauagagcuuuuuguuagugugcauuaacauggccuuuacaaugaaugcauuagauuuaaaaguggaggcagccucuagaguauuuuuggcaaauauuauucuuucacaaagaauucucuuugaguuuuuaauauaauaccuucuggcucauuagcuauacaaguuuggcaugaccucaguuuugccugccaccuagugucagcaugcugaauugcaagcauaggacucaaguugguucaagaguacugaggccagccucugaagugaacuuuaaauguccugaaaagcaaugccuuucuuuccaaaaugcccaguuguauucccugggaggaauucucucaucuuguggcucggugucugagccacucucaacaaagaaugaaguuaaauucucacauuagaagcaguuauaggaagccucuuuagggcuccagacauuuggaccauguucauaauaauuugagaguuaaauauuuagcuccucuuccuggauguuagccagaggccauuugcuaaccaaaucaguuggucaagcauuuccacauuauauauggcagauuucaaacacucuugggaggcaaagugcuacaaagauaaaauaaauuaucacuagagaaacuaccacgacacucuaaaauacucuuccgucuuuugcuuuggggaaacaguaucauaaauaggagacauaucuuuuaaaaugaaaagugcuauuuguuuuuuaacagcuucacucuccuuucgucuccugccccucugcuguuaauaacaucugaucuuacauuuaagcaggaagaaaauguagccacaugauuuaaaaagcauguguuuaugacuugccauguuuaagcacugcugaauaaauguauauugaaaacauauuucaagugagaagccauaauaagggguuuagggauauucaauauuacucuacuaauucauagcacaccauaauuauggaauguguagacuuucuagauguaaauuauaauccaugacucagugagagcccuuugcagcccucccucaguggaaugccacaacauuacacauuuuaggcaaauugacacaaaauaaaauaaaucaugucaagagcuguauagaaccauuauuucagccuuaaacauuucauuaaaacugcacagcucaaaaucuccccuccccacccccaccuaucagacuguauugaaaugaauagguccaaauauccugaacaauguagcuuuuuacauuuucugguggaaagauuauuuuuacuaacaaaacugaauccagauuucuguucuucucccuucagcaaagacccugagggaaauuaaaucgagcucuucuuugccccucucaaauuccuaccuggcagaaaagaauucugacacaaaauuuuuauaauuugcaggccaugaaagugguaucugcuuuuuuuuuuuuuuuuuuaaagugucuauaucuuuuucuuguucuacaacaaaauuuaucaaaauaaaaaauacagaaaacuguagcacuucuggauguuagccagagagcguuugcuaaccaaaucaguuggucaagcauuuucacauuauuuauggcagauuucaaacauacauugcucuugggaggcaaagugcuacaaagauuaaauacauuaucaccagagaaacuaccagaagacuuuaauaauuugagauauacacacgcacgcacacacacaaacacacauauauaaaucuaucuguaucuaucuaucuucuaucuaucuaucuaucuaucuaucuaucuaucuaccuaucuaucuaucuaccuaucuaucuguauaucgaucucccccuuggccuugacuuucucagaguguccugcccugacuuccaacuacccacacuuguaucucuuugcuugugggcuuucuuuggcccuggaacccaugugguucacaggucuucggaaugaaguucuccuaagagcagcccucagcccuuaacuggugcuuauugggauugagauaacucugaggcuuguauuuuucauugcuucucauaguuccccagguuaaguucuacuugcacacagaauaacuaacuuaaaacacacucuucauuggcuaucuuuacuuccuuaucucuuucuauuucuccaccuguguuuccggcaauuauguaaaacaaacacacaaacuaaacaaaaacuauaugcauucaaauccuugucuuaggguuugcuccuaggguauaaaaguuaaaacguaaguccauaugauccugaaaccaggaaguggcauuugcuacaugcugucacucucuuaaauuucaauggauaauuuuuuuaguucuucaccguaggcaguaggcagaguaaugccucccccaucccacucaaagauguccacaucauaaucuccagaagcugugaauauguuauguggcaaggggaaauuuaaguugcagauggaauugagauuacuaaucagcugauccuaaaauaagauuauccuggaaaauccaggugggccugcuguaauuacaagacuccuuuaaaguggaagaggaagccugaagaguuacaaucagagcaauguaaugugagaaagacucuggccauggcuggcuuugaagauggaaguggccacaagucaaagaaugcaggcagcuucuaggagcuggaaaugacaagaaagugguuucuccccuagagccuccaaaaaggaaugcagcgcugccaaauucuugaucuuaguucagugagacccauuguggacgucagaccuccagaacuacaagauaguaaacuuguguuaguucaagccgcuaaaugugcgguaauuuguuaccacaguaauaggauaucaaacccuuggccuguagaacuggccaagucugaaguaauuaucaccauguagacucuccaccucuuacccauuucuucccauuguuuuucccccuacggaaucaaaggggauuccugcauaucucaacaaaacuucacaaguccuucugaacuccuaugaugugccagacccaggggauauaagggguagauaacacucaggcagccuucagucuagugggacauagagaaguccacagacagcugcaauccagcaaggucagcgcugagacaguaaucauaguaugaaggggagaggcagccacggguccguggguugcucagggaggggaggcgagcaggggccaggacaugaagggcaacacaggccacauaaacaaucugacccuaacccgagaaaauagcgagccacugagggguuuuaaaaaucacuuuuuugaguaccuugcguagcuguaaaagaauauaaguuauacauaagguauauaaaaauauauaauaaauauuaucuguguguccgccauauacuuuucuuuaacauggguauuuucaacugagcuauacuuuaccuccuacaaaauucacccuuuuuggcauacaguucuaugaguuuuaacaaauguauacagucaugggaaaaccacuaugaucaagauauggaauaguuccaacacccccgaaguucccucacauacuuuuaagacaaagcauaucauguuuuccuuugaaguuuccuuucccauuuccuccuccuucagaaguaacuccaucguccauuucaucauuuccucaguuuccuucugaauuuuaucacauuucuauccauuaaggaaaagguuguuuugcauguuuugagauuuauauaaaacauauguguuuuuaguugucagagacagaugcuucuguugcugacccuauguuaggaugaauccuaagccucauccauguuuuucuacuauacaauuucauuguuguauaguauuucauuguuugaauuuaugcauucuauugcugauuugaauaguguugcuaggaacauucuuguacacauuuuucuaggauguauauguauauacuagauguguauauauacacacaucacauguacacauacacauaccuaggcaauagcuauauuuuuuucugggucacuagguauaugccucuuucacuuuacuaacuaaugcuaaauuguuuuucaaaacuguuguauccacuuauccuccaaccagcuguaauauucuaauuacuccucaucucauugucacguuugagcucucuccugcucaaaauugaacaauugaacaauuuugagcaggagagagccacacauugauuauuauuuauugauuuagcuucagaaagaccacucugaccaagagauaaccuaagagaguagcauggcugaaggaggugaggcccaaucaaugcuaacuugcaaagaugagaacggauccagagaaggguuccuagggaggcgagucuucauguuuggcugcguuuuaaaaguugcugcuucugaaaguggacacaucagacuacucuguguggaguaguccucuggacagaugcaaauagaggagaaauaagaaucuuuuuucuccuaaggcagccaucucuacccucccuaccauggggaacauggaagccccuugagaggaaugggcccuuccaucccucaggaggagguaaggggaaggagacugcuuugagaucccaccugauuggauccuauccacuggacuggccagugcugaaucacauggcaggaggggaguccucccuuccuucuacuccuccuccagaggacacuaagccugaaagagggaaacaucugggugaguuaccucaguucaacaaucagaggauggcugguuccaaacacagcauggggcccaugcuggaauuuccccugucccagcacccuuuuuuggugccacuaaaauguuauaacaggguuucacaggacaauuuuacaccaagcugucuggacucaggagggcacaucugagacuuugcucaucuuccugucucagucucuugcuguccugaacagcuaaaucaaaugcuggccaucugggcacacuguccuucagggguuuaaccgaccauuucaaaacaguuugacaagcuuccuugaacuccauggugggcaggcucuuucuccaaacacucgaggcuuggcuucaagucugucugucuuccuuccucaacauccaccagccucuuuacuuucuuuucuccuggugccaacuccgcagacauuaccaauuagucaaacaucaguguuuggcaagcauuuuccuaaggcuucuggcucagcuugcagagcaccucauccacaggccucccgccuggcuuugugcagggccuuguugcuggagcaaaaacagcacucauuaugcuuugaguaggagacacugagguaaagaaacaaacagcaagaaaaucuguggggggcgaaggggagggcuuuucuuuggagguuuacagagugaguuguuuuguuuucucuuaaauccauagaagcaaagauaaucacaguuaguuuuacaguuuuagucacucaggagaaauaaucacauuuagguuuguuagaggaaugccaagagcaucuaucuacccucgaaaaccucaaaaaacccuuuuuaccuuaaaacauaaggguauacuaguuguccuuuguuucauuuacccugugcuuggaugguuugggacuaaaugcuucauguacaagcauguaugaacauaacacacuaccaaggucagcucagccccauuuuguacuuaaggaaacuccaguucacagacaauuuggagauggaauugaacccacagcugacuaauuucaaagcacagcuuuuuugaccucuauccuaaaggaaauugguuuaguugaaaaauacaaugcucuuucacuaccauuuuugguguuucucaguugcaggccucgccagcuaggucucccuaaggaggaaaucgagucacagacaaaggcccacugcuggguuuacaugagaaggcagcucacagggcauuucuggagcuguugccugcagagcugcaaauauuugccaucuagccacuugcugaucacugcucuaagcccgugcugcucaaagaaggaccugaggaccagaaggaucagcacgauguaggagacuguuggaauccagaaugucagguccccuuccagaccugccaauucagaaugugcauuuuaucaagauccccagaugacugguguacauaguccauuugagaagcacugcucuaaguaacucaaucuuucccacugcugacacugaauaaaguaguaauuacacacaaacacauaaacauacaccugccccucauccccaccucccacacacacccugcuuccaguugcaugcuuaauuaucaguaagguuuucuggcaagaacauucauuggcaaauaauaugauaccuucaccagcagaacuccauuauuaaaaucaugaguaaggaaucaugggaaacuaaagaucuaccugaagaaggggaacaccgcuaaguaccagcuuagauaucacccuguucucuuuaaaguuugagaguggccugccagaauugcauuggaagccagagaacuaguaaccagccauucauucacccacucauccauccauccagccauccauccguccauccaguccaucuaacauucuccauguaccuuuuaugugcuauuuaauguugguucuaucucuaauuuauuuaucaaaauccauucacuucucuuuauuuuuaaauuuaacuuaauuuuucauuucucuuuuaacuccauuaguccaagccaucauuaugcuuugccuggacaacuuaacuaaccaccccacuuccauucccagccccuugcccaaucuauucuccacacaguagaauacacaaucaguauauucaaacugcaaaugugaucaugucacucaauguuuaucacuuaucaaugggcuacacugcacugagaauaaaaaucaaacuccuucaggugggcuacaagaacaccacccuuuggcuuccucuucaaugacauauuggaccacuuccuuccucacuuacuauauuccagccccagcagucuucuuucauuuggguucccagaagacuuauuccagcccaggaaacuucuccccuuugcucuccuaccuggaaugcccucuucucuccauacuugugcucaggcuucacaccuccuccaugaggcuucccucaucagccaguccuaagucccuuccccuacuuauucucuaucacagcuugauuguuaauuaugcauuucuuuguugccuagauuaaugucuaccuuccauauaaaugaaaacgccaagaggaugaaccaugacugugucuguuuuguuuaccacucacccccuagccuacagcucagagcuuugcaacugcuguucucugccuggaacacuuuuccuuugauaucugccugcucacuugcucacuuccuuuaggucccugcccaaauguuaccuugccagacagaccauccgugaccacuuuucauaaaauagaccccuuuaccuccaugaugcucagcuucauauuuauauuuacauggcuaccacauuauacagcacaguucuaagcagugaugaccaccuucuauuuauguaaaauugcuuauuaucugccugugucuacccucucccaacccugaacauaaacuucaggacaucaggaacccuuuagucuaugcugacuuucauccaaaacagcacacaauaaauacugguuguugaaagucuacauaguaagugcucagaaaauaugugaauaaaugaaugagucaauucaugaaggcaugagcccgaagcuauguuugcugaggggggucuaugaagacaaugaaggugaaauuucugaccucaaggagcuuguuuuugaguaugggaggcaggggugauuuggugucacauaaauaccuccuaccuucauccuaucuccacucuuuccacaccggcucucucugccccuucuguccucugccucuccccucaaaaugacaccacacuuucauucugccugucuuguguugccuccaaaaugaacaggauaaccuagcauucugagaauuuucuuucugagcuagaucuuugaguguucuauuuuccccucaucuauuuaacaccaugaacauauggacuuuugaagagcuuugucagaacacuuuauaauguuaugagguacacugaaauuuuccacauaaaguauaauuucugauuuuauuuccaagagcuagaaaagaagaccuuuuaaaaauauacaaagggcuggacgugguggcucaagccuauaaucccagcacuuugggaggcugagggggguggaucaccugaggucaggaguuugagaccagucgggccaacaugaugaaacccugucucuauaaauauacaaaaauuagcugggugugauggugagcaccuguaaucucagcuacucaggaggcugaggcaggagacucacuugaacccaggaggcagagguugcagugaaccaagauugugccucugcacuccagccugggugacaaagcgagacuguaucucaugaaaaaaaauaaugauaaaaaagaaaaauaaaaacaugggaggaaaaagggacagaaagaagaggauaggaagaggaagaaagaaggaaggaaggagggagggaggaaggagggaggcagggagggaggaagggaggggggaagagaaggguaaagggaaaacuuuugaaggagcuugucagucugguuucaguccuuaacuuuuaugagauaaaaaagauuuguacucaauuacuuaggagcuucaucuuuauucuaccaagauggagaagauggugguuccaguggggcugcugguacuuugcaaaucuaacccuaaugucuguuggagaaagguucugauuaaauuauccuuuacaucuuauuuuucuggccuacaccuugaccuugacuguaaaaguacuuucugaacaguuugauuuuccaagcaguuuaaaaugaucauuuaugcugggugccgugguaacaaaaguaggucauuauuauuugguuguacgucuucuggaguccauuagaacugucgguuaacuaccuaagcucaaauuccucagaaagugcauguuuguuaucagccacacauuguguggagggaaagguagcaguucugauuucaaaugcuucuuggauacuucaagaauuucuugcgcuuuuuaaacaaauuccuuccuagcugcagugaacaaccuauaguauaucgaggucacagcagugaaaccccacagaaaauucauugugcuucagccuuaggcauugcccauaggauguaaugcuacaacuuuuuaaagaggcaguuuuuaaauuguacuuuauauaggaaugggaaugagagauuucucccuucuacuaucgcuaaaaaugguccauuuaaaaaaauaaugcaauguuacuaauagguccugugaacaagagaaaaaguuuguaaaaauugcugcagaaguuuuaugguuauuuuuucccccuuuagcuccgaaagugugagugagggcugauucuuuauucaaauaggaaaauaagaagaaagcuauuugcuuaccauuuucaaaaaacauucguuaagccuuuuuugagggaaccacauaaaguaugugggguaaacauugucccucacuuucagacaauccuaauuuguaguuuauucaguucagcuggugaaaaaccccucuccaaagaauagcaugcuaugguaauaagggcacuccccuuagaaacaguacagccagguucuauuuccagcacaaccccuaauuagccauugauguugccaaaucauuuuacuucuauaaaucuugaauucgugagucuuuaaaaaggaauuuccguaucucccuuguuuuccucguaugacagcugccaaaaucaaacuaccuggaggugauaauucauaucauucgcuuugccaaaaaacuuacccacacuuccuugagacaaugaucacacccuguguuugaaaaagucuuucuauuuauaagaaugugauucuuacccccauuagaugagaaaucaaguacaaacaagggcagagaaccauuccccugggaggacaucccucaauuccauauaugcaaagaaauaaugcuucugacaacauuggggaaacuuacuggaaaccagugauauucucaauacauuugggcacauauuggcugugauuccacuguguguugaaaaaccgaauccaguuuucaacgcauagugggauuacaauaaacacauaguugucaccaaaucaaacauuucuuugugucaaauacgagcccuugugaccaacagaacuuucuagacagcaccaucaaacuggagaacauuuaaauuauauucuaaucagguguccauuugucccucacccagugucuacuggagaccaaccagccugggucuccuucucugcggacagaaccuuaagccaagcaccuagggccauaacauacaguuucaaaauauaccucaggugugguugaagagggcaagacaggaauggagaugcccgacggcucuaagaggacccgcagaccucccccuuacccggggcugugcuuccagaaugaaauucugugccuuaauugagucugggccaagccuuuccaguguucucugucuuugcuccuccugcaaacugcccucaugucuuccuucucuuuaccucccaccuccaaauuugcucucaaacaagcaggcaacacuuuacuuccucucaggcaccaugaagugauguaaccugccaccuuucccugggcaacuucuauuuucaggggauaauaaagaaaccuuacugcuaaauaaagaaaacuucaauguugagggugaaaagccagagacaagcggucuguguuugguauacagaggagggugauggguguauauugccaccuacucguaaaacgugccccgcccccugcgccuaccgaaagguuguuuagaccauucucuuaguuucucucuucccaaccgcaguuuacuggcaagggacauagaaaguacaauuuugauggauuuuuaagucuacauguccaugguagaucccuuagaaaauguaaaguggauaauuacaacuucaauuaucuuccauaucacaaauaccggucuuuuucuccaccacuucugcuugaaguauuuuguuuucauauauuuucuugagugagguaauuaaccucuuugugucucagguauuucaucucuaaaaugaugauacucuuuuauagcacgccaugacaaaaauguucagagauccccauauaaaaaggugacauaugagaaaaaagcagcaagagaagucaaucuuggcacauuauguucaaaaaccacuuaacagcucucucucuacuguauuuggagcagagcacaguacgaauuagguuucacuguaauuauguccuggaagcaaauaugauuuucaaugaagagguuuuacugacucuaauuaaagggauguuacaaucuauugucucagauugugugaugucuggaagggaucuuaccaauuauugccucaaugcccuuguuuuauagacgugcacuacccagagagguuaagugacuugcccauggccacccagcuaguugggcauggcuggccccuaggugucacauucuggguucucagccuagugcuuuuuaauagacagcuucuacauuagacuaagguggauacuguauauucauuccuuccuacugcacagcucucuuccacauuuauuaaugaauuacaggccagcagaaccaaagcuccaguggauucucauaucuuauuuuuucccccagaauauccuagaagcugucagaggcaccaggaauaacucagaagcagcugucagcucucugcagcagcaaaguucacauguugauucacccuugaaacaggaacgugugugaugaguuuggaugggaggugaugcuugcggcacccccgguuuuguauaauuagaucuaggaaggaacucuaagaaagaugguuguaucuuuuagaugcgcaaaguuugaaagcuaaguaggccggggaaguucuaccgugacaagagcauguauagcaaagaucucuucacuggagacacgcucuguagauaggaagucuugggugauguggacuucaggagaaagguaacgcccuuuccuugccugaugggggagacccagacauagguugcucugaaggcucugaguuaauaaaauuaaccacauuuauauccucuguuucuaaagcauuuugauuucucaaagcacuuugacagcuuuuugauacucuugauauuuuauugucacaaacucccuuagguguauaaaggguaggaaugaggacuuuugugcuacagcugacaaaacagaggcaguuacuguucuugcuugaaguccaucuuuaaaaugggccagugcaucaugcuggcuuaagggaauuugcuuuacauaccuuuuugguaguuuauuaaaggcuucagugaaggguaauaaguuugucaugagcuggacuuaaguguuagagcauuucacuauauaucauguguggcuauaaaugagugagguuuuauaugauacaugacuguucaaagaaaagucauccugaguuuaccuguuccaacgcuagugucaccacuuacauuuuucucucuccucuucuggaacugccuucugaggcaauuucuagauaagaaaagcaagcucauuuauucacagucgcuacuuauuuuaucuaaaaaaagaguuaucaguuggauguuuaaauucucaucuauaugugcuuuuaaaaggauauaacuucauaguuaguugcauuuguauuaggaaccaacucuuuuuauguucccuguaccuaaaaugaccagauuuuggagacugggagaggaauaguuuaagaauuuucaguccagagcugaaaucagaaggucccuacugaacuguugagauaggaugguaaggcauguaacuacugaguagcuucuaugaacuggauagaaaugaaggcugcaguuacaaauugcacauauauuuggcguggaacuaaacucuuauaaccaguguuugaauuagaauagaaaauuuuaagagugaauauggcaaggguuggcaaaacuuuuuccuuaaagggccagauaguagauauuuuagguuuugugggcaguauggccucugugacaacuacucaacucuguuguuuagcaaggaggcagcagcagacaauacauaagugaaugcauguggcuguuccaguaaaauuuuauugauaaaaacaggcagcaggccagauuuggcucauaggcugaccccugauuauggucuuuuacacugaggugaauauggauguuaucuucagauaucaagauuucuaaauguuuaggaauggauuugauccucuugggggaaacaaagaaguaaaugcaaaaacaguauuggccucaauuuuucucaaccauuucuaucuaaagcauugucaaugcccaacauuacuuaguguuagaaaaucaggaaaacugaaguuuuaucucagaauaaucugaguuaauucgcuuuuuaaaaguagcuuuucuuuuuuuuaaucacacaaacaaaugugcacuaaaaugauaagugauaaaaauacagguaagcuuaaaaaacguggcaauaacuuuugacauuuuggguuuuaucuuucaaaucuuauguguuguuacaaauaugagaucaaacugugcauaauuuuguuuuauacuuucuaacuuaauaaauuuuuuauuaaauuaaaaagaaauggaacaucauuagucaucaggaaaaugcacauuaaaaccacaaugagcuaccacuucagacccaggaggaucucugaaauuaaaagacugaaauaucaagguauggcaaggauguggaacaaguggaauucccauacacugcugauggaggguaaaauggcagguagaauaaccacuuggaaaacgaacugcuuuuaauaaaauuaaacacgugucccugugacugaguaauuucacucuuaggucuauacccgggagaaauaaguggccaugccucccacaaagcauguacaggauauucaaggcaauguuauucauaauagcuucuaaccagaaacaacccaaauguccaucaacaugagaaaagccuaucuauaaaauagaaugcuacucaguaacagaaggagcaaacaaccaauauaugcagcaacaugggaaaauccuacagagguaaugaugaaugaaagaagcuagacacaaaagagcauacacugugacucuguguaggugaaguucaacaagcaaagcuaaccuauggugacagauauuggaagaguuuaccuuaauuauaaccaccacccaaaucaagauacaaaauguuccaaccccagaaagcucccccaugcuuccuucuaagaucuuaggagguaguuugaaggaugcauauauuuaucaaaacuuacuaaacaguacacuuaaaagucugugccauuaagauauguaaguuauaccuuaauaaagagaaaaauguucuaaaauaaaaaguugauuucuacuuuaaaagggcaaaucaaacagaaauagacaauacccauaaaugcauuauuugaaggagaacuauuuuaaaguauagaauuugaaauggaaugaagaggagagucaacucuuguuuugaggaagccaucuuuauuguacucucucaauuucaugcccaucguuauuucuuuugggucuaaggucauaaggauugccuugcuuuugcaugccuuuuuauuucaauuuggaaaacagaugagauugaauaacuaacuaccuggagggauguccugaggaagagcaacgaaaaaugucaaggacauccuaaaugacgucucccaguacucacuuuauaaagaccugugggaaacauucaucucaaacaucaguaucuagaaaaucugugauucuucugaacaacaaggcuauuuuccucuuguggacaccgagagucuugucacugaacuuguccccuuuuagcucugacuaccagaaacaauuuuuaccaaauaagagcccucaucuagcacauacacaacuuaguauacgaaucugacuccaagguuuacuuuuauauuuucccuuacaucaauuaaccuaacauuuuaaaaucaucgguuuuuuaaaauuaagauacaauucaaaugcuauaaauuugcccuuuuaaaauguguuauucagugguuuuuaauauauucacaaauuucacaaauugugaaacagucaccaccaucuaaguccagaauauuuccauuagcagcccuccccauucaccacugcuugacaacuucuagcaacucugaaguuacuuuguguuucuauggauuugcccuuucuggacauuuuguauggaugaucucauagaauauggggccuuuugugucuggcuucuuucacuuagcguaauauuuucaaaggucauccaugucguaccauauaucaauauuucauuccuuuuuauggaugaaaaauauucuguuguaaggauauaucauauuuuacuugucuauucaucaauuaaugcauauuuggguguuucagcuuuuugcuauuaugaauaaugcuucuaugagcauuucugucaacuuucuguguagauacauguuuuuauuucucuugaguauauacuuaggaguaaaaugaaugggucccauaauaacucucuguuuaaguucuugaggaacugccaaacuguuucccauaguggcaauguaccauuuaugaucccacuagcagugugcgaguguccaaauuucuguacaucuuccuaacauuuguuauugcucgucuuucuuauuacagcccucuuaaugggugugaagcagcaucucaucaugguuuugaccugcauuuccaugaugacuaaagauguugaacaucuuuucauguauuuauuaguuauuuguauauuuucuuugguggaaugucuacucaaauccauugcccauuuuaaaauugagcuauuuaucuuuuuacuguugaguugucauuuuuuucacauuacuuuuguaagccucauuguauucauugaagacagcaacaagagauaaauauauuucuauaaagagggugaggguuuccuaauauuugcucuugcagagauaaccaaccccauuaguuuugauauuuuagaagugacauuacauauuuucaaucaacuuguuaaaauaccaucucaugaaaccacaaguuguaugucuuuaugucuaaauuucgaaugcuggauuaauugcucguacucugcaaacuggcauuagggaagaauuugucauuuuuacugcuuucuuuucugccgucaguauauauuaaacacuuuuaaaaaauaaaaauaaaagggacaaggaagcuggacacaguggcucacaccuguaaucucaacacuuugggagggcgagguguguggaucacuugaggccagguguuugagaucagccuggccaacauggcaaaacccuauuucugcuaaaaauacaaaaauuaguuggguguggagguguaugcuuauaaucccagcuacuugggugggugaggcacgagaaucacuugaacccaggaggcagagauugcagugagccaagauugcaucacugcacuccagccuggacgacagagugugacccugucucaaaaaaaaaaaaagacaaggaaauaaagaugaaccuuugauaaaucuagaacucacaaauaaauuacucugauggcuuuuuuuaacuagguugccuauuguaccagccaaaacuuuuuguuaacuucccuaagccagucucaauuugauuauucauuugaagucccaguucccuuuaaugaaugaaucaaaauauaaagcaccuugcuuuuuuuaauuauggaaaaaagaauaauuagcuaauuauuaaacuggaauccacauaaguucauaaaucacaucuugaacacuauauuucuaaaaggaacauacugccacuacugauaauuuaacacuuagcaauaacaauucuuacauuaucuuuuuuuagcuguuuauuaucugauggguaaaauaauuuuucaaauauaacaaguuguaaagaaaucccuggccuguuaauuuggagugcauagcccuaaaagaaaaagcuaguuagguggguugaugcaauuugggguauuagauaaccauagucagggaacuaggaguagaucauggcccauagugcauuucuggugcuccuuacacauucaaagcugaagugaaaagggucucaaaccagaggaaaaggcaaaaugccaagauguuaaaacacugccugaagaaauguuaagguauuaacaggaaggaagauucuucuaaugagagguauuacucuucuugaugauaacacaauuucucuaugcacaggaagaaauggccguuccacuacuccauauuuuaaucuuuuuccuuuucaccgagguauaaaauacacacauaguuuugcauguacauaucagauuaaaguuuagaauguccagcaccccacagggauuccauguggcucuuuugagucaauaccuccuuucugaggguaaccaccauucuucucauuaucauauagacaaguuuugcucauuuuaaaucuuuaaacaaauggaauaauauagacuguuucuugucucuuguucuaaguucuuucacucaaugucauuugaguucauccaugcuguuaguucuuuauuacuaagcauauuccaugauuugaauaugucacaauuuauuuacacauucuacuguugacagacauauggguuuguucccccucccccccaggauuggacuauuaucaauaaaucugcugugaacauucuuguaugugucuuuggguggguccauauucucauuucuauugaguauguucccaggaauauaaccacucagucauauugguauguuuagcuuuaggagauacugccaaagaguuuuccaaacuuuggcuugauuuauacuuccacaagccacacaugagaguuccaguugcuucacauuucacaaacauuugcuauugucaguccuuuuagugucagccauucugguggaguaaagcaccacacuucaaucugauggaugcaauucuauuuuuaaggaauacaaugccacacagaaggcacuauuuguaaaaacaaaauggggcuuugcacuccauagaccuggacaccguuauuauccuuaagaauguggggaaggccaucuccaagaguuuccucagccccaagagacaggaggaagcccugaugccuuucuuccugaaauaacucacucacugcauccauuagaguagggugggaguacauucugagacugcauauuugcagauuucugagagcugaaaguccaaggacacaauauccaaguuuccauucaguuuaaaacuacucaaacauugugucuggacacuuucaggacauaaagugggacuccuucacuuauuaccuuucacuugauucucuuccuguccuccuuaaaucucuugaguccacagaguuuacuagaagcaacuuuuaucuuucccuuuggaagggccauaucaugacuggcuccuaaauggguccauuuucaaacacuaguuaaguuccucaguuuuauuuuaagauuuaaacaauguugcuaaaccaaaauauuguuuagaagucagaccaacugacguuauaauccccuucccccaaaaaaacaagcaaagaaaaauggaggaguugcauuuuccaauaucaauaaaauauuuguguccuaaaaucauuuugaaaaugaaaggagcagauuuuuuuuuuuuaaucauggagguauuuuacgcuugguaaaaugaagugucggaacaaucaaguguguauuuuggacaaaaacuuuccuucuccugagaaaacaggguguuugcuuugcuuggucccaguacuaaaagaugccugucuucauuaaucuaauucaucagauaauugcucaacucuuuguuuuccagcuguaaagggagaaggaugaaagaaauaaccuaaccaugacaguuaauauuuugugauagcagagggagaagagauagaguuuaaguccuugauaccacuccaggaggagcaaauuccagacuguacucuaugcaaggauuuacugagcgauuuagguagccacucuccugagaauugcugucacugggagaagguacuuaaagggccauguucauugcuccagaacacagggacugcaggagaauuucagguugcuauuuuuagggagacauuuguuuccaaacaaagggcucucugccagcuauuuuagaagcacuugcauauuuauucagccaacucucuuugcuggggauugucuuugggcacuaagguuuuaucaaugucuauuuaaagcagaauaaaaaauagcucaagaugaaaacauacaauauuuccaguuuagaauguaaggcacuuccuuuuuucuuacaggguugaaaccagauaucugguuucucccucucucccuuccucucccccuuucugaaauugccaccugucuuacaaucugagugugucuugguuuaauaggcaccguuuucccuuuuagugguauacaaaauaauagugcaccuuaagaaaugaucgauuugaugaaauguguguguguguguguguguguguaguuuugagagaaaguaaaucucuguuaggaccuauuuacaagcuuaaucuguuuacauccaccauggaaaaaacagcauugggaugucaugucaugaaagggguaacaugcuaucacucauauggugcaaagugggagaggaggcagaaugggaaagguaaaaaugggcucaugauaucaauaagaccuaauguuuucuugggcuuguauuucacuuuaaguucacguguucaaaucucuuaacucuuggaagaucagacagaaguuccugauucagaauccccaguccuuagguacccuuuucuuucuuuucuucauuucuuuccuuucuuuccuucuuucucucucccucucugucucuuucuuucuucuuugagauggagucuccgucuguuguccaggcuggagugcgguggcgcgaucucagcucacugcaaccuccgccucccagguccaagcgauucuccugccuuagccuccugaguagcugggauuacaggugcaugccaccacaucuggcuacuuuuuuuuuuuuuuuuuuuuuuaguaaagacaggguuuuaccguguuagcugggauggucucaaucuccugaccucgugauccaccucccaaagugcugggauuacaggcaugagccaucgcacccagccguacccuuugcuuucaauucauuccagaaauaucuauuaaguacaaggcacuaggcucacaauuaaagauauaaauaaaaaccaaacuccauacuuguucuugaagcacccccagccagugagggaccuucugugcgaugaguuuucccucucucaacaccuauacacacacacagacaccaaaagcuccuggaccacccaaaaaacaguuugacucugaaagucaucucaauagaggugccacuaacacuucauagcauggagaggcaagagugacccacacacacuccuugcuguuagaaaagugugucgcguguaugugcgcaugccugcucauuuaggaagaagguggcuucaaggaggaguagggagggaaaggcauugcaggcagagagaacagcaggcaccgccuaaggaugcugugucacaugagaggacaccgaguggucagugauggcuaguguguggcacauuugggggcacaugacaagagaucaguguuggacaggcuggggcagcugugcagggcucucugcccaugcuaacacauuuggacauuuggaguugauuguguaagcgaugaagugccaugaauuccaacaucagaucaccuggcucagagcugaaacugcuucuggccccaucuacccaucaccuugcuuuguggggguagauuugagucccaaggacauguacuucuuguuuugaguaaagggaccacugggucggaaggagcauuagcuguccuguacaaucacuaaggaccgcugaugaaugaauacaccaaucuuuagagaccaggauggcucaguaucauaacagauaccggaacaguaacaggagcuaacgcuuagcuaaguacuguuuuuagccccugccauguauuaauucauuuccuucucacaauagccacaugaaguagguacuauuacucucuucauguuacagacaagcaacuugguguacacagauguuaagugaccugcccaagaucacacagagcuaaguaaguggugggcugggguaugaaucugacucccccuuaaguccaggcuuuaagcagcauacugcaucccuccaucaguucccccggaugcuuaaaauccacugugacagauccacccauucauugaccccuuguuuuaucaggaaaggucuaaaccuugaggaugcaaaaaagcaagacccuccuucccauccucaaguugugcacagaguucagcaugugaggaaggguuagcggcaggcaguaaggcaggggcaugucagugggaucugaccagcaacugaggcacuacagagacucugagagggcucaggccacagcugcagacucugcuucuauuccuaagauacaagaacauauaaaaccaguguuucucaaacuucaguccuuugaaguacugccuucacaauuuugcacauauucacaggcugcuacacacuuaacgauuucugucucaauugauuuuuuuucuuaaauaaaauuuagaggaaauguuuguauuacuacuauaaaggggaaaggggugucauuugccauaaauagaaagguaggguaaaaaauaaacaggguuggcugggcacuguggcucacacuuguaaucccagcacuuugggaggcugaggugggcagaucacgaggucaggagauugagaccauccuggcuaacacggugaaaccugucccuacuaaaaauacaaaaaauuagccgagcgugguggcgggcgccuguagucccagcuacuugggaggcugaggcaggagaauggcgugaacccaggaggcggagcuugcagugagccgagaucgugccacugcacuccagccugggcaacagagcaagacgccaucucaaaaaaaaacaaaccaaaacaaaaaacaaaaaauaaacaggguuuucaggucaagugacuguguuuguaaaguuuuauuggaacaaagccaugcucaauugugaagcucugaagcugcaauaguagaguugaguaguugcaaaaaaacaccaaauggacugcagaugcuaaaauauuuacugccuggccuuuuaagaaaauuugcagacaucugaaauaaauacauuucaguccuaccuagggauuguugccaucuguuaaaaagacagauuagcagagauucaagaaauauuaauuaaggcuguauuggcaucaaacugagauuuuucucauugguaauaaaaagacaauaaauauuggaaaggaaaaucuuuaucauuaaaugaguucauacugucuuaugccaaguucaauauucccuaaaauuauauuucauaucacagugugcaguuuacacuuagggaaauacugcauuaaacuaguauacacguuaaaucaaaccacauaauuauagauuuuuuuuuugagacagggucuugcuguguugcccaggcuggagugcaguggcucgaucuuggcccaaugcagccucugccuccuggguucauguaauucuugugccucagccuccagaguagcugggauuacagaggcucaccaccaugcccggcuaauuuuuuuguauuuuuaguagagacaggguuucacuguguugcccaggcuggucucaaacuccugaccucaagugaucuacccaccucagccucccaaagugcugggauuacaggugugggccacugugcccggccuguaauuauagaauauuugaugugggagcgaauacaggugaagauacugaaaaccguguagcuuuaaauaugugcaagaacuucauuguuuagagaagcaaaggguaguugaaaggaugcugggaauuagaauuaagacccauggguguauaccagcugugugaccucaggcaggucucuuacccucucucaaucucaggaaacugaaucagaauaugauuccuguccuaucugcugcaugggauaaccugaagucuuggggcuguugccauuaguaaagccccucaugaccaugaacuaccacagcaccacugauauccuccccagcuuuccucucagguggcuaacagcaaaagcagucuugcugaggaggccacaggguggacaggaguugguugggagaagggacaugacggaucuggaggaaggcaggccacagagucccaaauaaggcagaggagagauggaaggugccagaugagcaaagaaaggcagcugcugggaggacggggaaggggaagggcaacuuugucucuguggcgauuuagcuugggcucagcacugcuggaagacccugauggccucaccuugagcugacugaggaaggaagggggccaggcguccuuucuaacaccccaguucaguuuucuccauggaguuggguuccaggauaccaggauacucucccauucucugauuacacaugucucggcaucucugggcaaaugagccaccuggcucccgguuuaaguagccaagaaagguggauauuuauuuuagaaaccaugcuugcaaacuuuauuuuuaaggcugugacauaauauuuggagcugcacuucuaagcugugguguucuaaacaauucaaaaugaauagagucucuacuuuuaacuuuucuccugaaguauaaucaaggcuguagcuauaauaaaacacagcuguggcagcagcaacagcggcaaccaaacugugucaccaaaagaagcaguagcagacaaccacucucauucggcacuuacuaugugccaagcacggugcuaaaugcauuaccccaugaguccaauccacaaaacaauccugcaacauuucugugauaaucuccacgcaauggguuaguucauuucacgugaagcaaaauuuugccaugugcccaaguugagauagcuagaggcgagggcugcauuugaccucagcucaggcuaacuucaaagcccuuuguucuuugcccugugcuguucuauuguguaauggaaauuucucauuuuucuaaggugagaauguacugaguguccccucuccaggagacaggcaguggggagaaauauauuaguaaagcugaaggaauuuuaauacuuccuuuucagucugaguguuaaugggcuuugagucccacaguggcacugacaucaccgggcugcugguacccaaacauaauuuuuuuuuuuuuuaaaucuccuaaacagaugcaggcaaauauucauauuuggcaaguagaaaggggcagcagauuuuuauuuuccagcuucuaggacauuuuuagguauaaaaguaggaaguuuccagccuuucacuuacuuuuggggggcucuucagggauuugugugccacagagcaagaagagaagguggggguuaaugguaguuucuggugaacagaacaaaaugaucacagugaacccuggaagcaaaguaacaggcugggaucuaacacgggaacaaaugaagaaauaaacuaaaauuagaaagacauuaagugcccugaugaugauuuuuauguaauuucccaacuacacagugcaaccuacaauaugaauuucccuguuauuaagccaguaaaauccagcaguagaaccaaugagcacaucaauauaauuugugcacaagcaaaggugauucuaacugagguuaagugccuuuaguccaaaagguuuguuuuaaucuaaguuuaacaguaaaggggaaaugagagaaacacagagcaacaaaauccucccacagaaguaucuaaguguccauacaaagcacauucauuccauccaaucgacccauggggacguucaugucuaaaguauaaauuggaauuuagagacuuuaugaaaagcuguuuuuaagcucaauaugccccaaaugagaaggugucaaugagugcuuagggacuuuuaaauucagagauuauucaauugcucuauucuacaaauacacuuaugaaacugucauaggaaaaaaaugcugugaaauaaacauuaaaaagcauucucaaacaaaaucaaagacauguuuugcccaucacucaagggcaugggcacauaaacauaaccucaaagagcaauacaaagaggcucccugugugaauucacggccagugguuuucagaaagaaaggagcuggaaugaggggguggcagcaacaguaccuuccaugguguuucuguuacagacacaggguaggggcacccagucuuggaggaggccaaugacccaugggaaccuagccuaaccucaggggcauccaggguauacuacucucccuuccucacagcacccgagucauaauucuggccuacuucuugucuuccauuuuccuucugaccuccugaccccagugucuccccuaucccuggacccccuucuuugauagcuaagguuuggcaaaaguaagguccaaaccccaauacauguccaucuuugcuucucccucuuaacugggcuucugucaugcacaacuccccaagacaccugcucagcucagccuuuuucacuggcaaaagcccuagaagaucuaaugucuucugggggagggaacugggaagaggaagcagcuuauggaaacacugcugucuaaacaggauuaaaagcaucaauucucaugucacgccugggcuguuagucaauaccaauguuucucucauccagguagaaaacacagccuccaagaaguugaguaacuuguucugggccccuagcagauaaacgaaugacugcgauuugaauacacaccuagaauuguuuugccucugacaacuuuucagaaaguaaagccagggagaagauggguuugccuuuaaaacuggucacauuuaaccccuugaucaaucuaacuucaccgagcaaagcuucaugcuauauucaggggcuacaaggugagaaagacaugaugcaugccuuuuaagaguuuauaauccagccagggagacucacuggugugugaagaaucauacuaucuguauaauauaauaaguuugcgguucauggagcuuugugcgaagcacugugagaaaacaggguuggggagggaagaaugaauaauucugccuagaguguggaaugaggcuuaggggaggcuucaaagaggaaaugacauuucaucaggcuccugggguucaacugauggagaaggagguaaauccucagaaaaauggagacauacggcucauaagucagcaugguguaguguggcuggaagcugggugugucuacugguaggggagaagcaugggaugggaucacagagcagcccuaaguggcauccuuggccaccggaugagccacuuaaagcagacauuggcaaaccauggccugugggccaaaccuagcccuucaucugcuuuuguaaauaaagauuuacuggaauauaaccacacuuguuuguuuauauuuuccauggcuacuuuugcgcuauaauggcagaguuaaguaaugaagacagggacaaauauuuucuuuuuuugugagacagggucuugcucuguugcccaggcuggagugaaguggcaugaaaauggcucauugcagccucaaccucccaggcucaagugauccuccuuccucagccucccgauuagcugaguagcugggaccacagguccacaccaucacucucagcuaauuuuuaaaaaaauuuuguagaguuggggucuugccacguugcccaggcuggucucaaacuacugggcucaagagauccucccaucuccuucucacaaauugcugggauugcaagugugagcuacugcacagggccucaaaaauauuuucuaaaauuucuaacaucuuuuaaaaaagagcugguuuuuuuuuuuuuuuuuuuuuuuugagauggagucucacccugucgcccaggcuggagugcaauggugcgaucucggcuuauugcaaccuccgccucccaaguucaagcgauucuccugccuuggccuccugaguagcugggauuauaggagcgcgcuaccaugccugaagagcugguucuuuuaaaaaaugguuugcugaccuuuggcuuaaagaucugaacuauucauuugaauuucuguaacugacuuaaaugcauaugaucaggcuuucuagggcuuuacucccaugguuucuaaacaguaucaucuuaaaucuucuuucccaucauggaccauuagcuauuaucuauaccguaagcuugucuggacauuucuuucauaauccaaauguuaugccuucauuuauuguuucucuuuuucauuaauuguuuuuauuucagggcuuugccacaugcuuuccucuucugacaucauuacaaaccucccacgccaccagcagaaguucaucauucgagucaguuugcuuccuuugccuccuucuccaauucuucauaaacuauuguaccaccucuuuagaaugcugcuaaaaaucgaguuuuuuuuucacuugccauuauucuaugcuuugacagacagcuguuucucugcaaaaaggcuucccuaguccuauaagcccuuggaaaauacaagguauacccagcagcauuuacaaaacagaaaaaaaaaaaaaugaagaaauaagcauacuguucugauaggccacguuaaaggauuucuuuuacuuguaaauccccuuacacauguaaaaucaaauuugaucuauaaaaauuaaauuugcacaugauuuucuaggggauacaucucuaauauagagcaaggagcaugguuauuguuuuauuaaccacuggcaauaaaauagaguggaaaaaggaacucggaguuuuaaacgcugcuuccuauggcacgcaguauauauuucaguuugaauauagacuuucucaucaaacugccugguuccaaaucucagcacugccccuuacuaacuguguuaccuugaguaaauuaaugucucugugucucagcuuccacaucugccaaaaaaauggugggaccugggaaggaggaauuguaacuaaucuaucucauaggguuguuaugaagaucaaugggauaaagcauuaaaagugguuaaugcaggccaggcgcgguggcucacgccuguaaucccagcacucugggaggcugaagugggugggucaccugaggucaggaguucaagaccagccuggccaacaugaugaauagccuggccaacuugaugaaacgccaucucuacuaaagauacaaaaauuagccgggcgugguggcaggcgccuauaaugccagcuacuugggaggcuuaggcaggaguaucgcuugaacccaggagguggagguugcagggagcugagaucacgccacugcacuccagccugggugacacaaaaaaaaaaaaaaaaaaaaagugguuaauguaauacuuggcacauagaaaauacccuguccaguuagcuauuacuauaaugauucuuaaauuuucucaguuuuauccuucuuuuuuucucccacagcauaaagaagagugccuugggaacagcacugugggaccugacaaaucaugguggacaugaggucauuuuugccuccugucuuucugauuccccucugaggaacauuuucuuccacacuccccacccacaugguuugggugaagucaaccucaauccugggcuguagauauugacacaugauccagaccuggcuaaucacaauauucuauccccugcccaaagcaaugcccugcucaaagcaaugcguucacagaagggcacaugacccaaguuaggccaaugagaaucugucccuaggcuuugauggaacaaucgggaucuaauagucucucuuuuugcugggucaauagauuaacagucuggagcuguuggugcccuucuuuguuagacauggggaaaaucuuccugggaaugaagccagcacagcaaaaaucagcugugagagacaaagagaaacaaugccccaaaaacaaacaugugccuuuggauccagcauauuacucuggacuguucagugacaugcguagaguuguguagcuuaagccaguuugagcuggguuuucugucacucucaucuaaaggauucugacacauacagaugaacugacauguccuauggcuagaauggaaugugaaucuugcuaaucucgcuacuucagagaaggcauggggaggagagguggccgauuucacuguagucuugguuaugucuucagccaguugggacugcugggagaaccgugucaucuuucugaguccuaguguacuuguacgucaaaugagagaggugagugaaaaucaaucucuaagaucccuuuucacuucuaacauucuaugaguaucuauuauucuugguuucauuucaguugcguauacugugguauaauugguuacugauucucauauuugccugcuuccuucuguuucaacuuuaaaaauauccaauuagacucucaaucucuacauuccaaguguuuauuucuuucccuucaauuuccuucuaacaaaaauacauuuauuuuuguguacuuggacauaaugaucccauuuucuucccauuucuauauuuuuaaaucuaauuaaggugauaagcuccuugagggcugaugcuggaguuuuccuguggguguaaacauuauuuuuuuuaauugccaaccaagcugccaguuuuuacagagcagcaggauauggguuuuaaguaauguaagcaggaaaugggucuccagcccacacaaaauaaugcaaaaguacugauuuucccugaguccacaucuggcuuacucauuuauaauuucagccugaacugaaauucucccacagaaaugcugugugccauccaugucuacagaacaucagaccaaaacuagagcagaaggugaucaucccgugaaucucacacauaggaauaaucuggcuauuucagguuauccugcuuuucucuucaguggaaggauuuagagccugagccaauugaauguuagcuuccuaucuucaaauguauggauuuugaguaacucaauggcucuaaaauuuggagagagggaaaggaacuggaugaaaagugacccaugaucugcagauggaauuguccagaggaaaaagagcuucccagaaggaauggcacaugcaggaugcuuuccugucugaugacccaguccauucucauucaugaggacucuaaauauuaacaagacacucauuccaaaagcuguaauggguucuucuuggcagauauaacaaaacgaccuggaggcagugguuucauaggguuggcugguucaguaauucaauggugcuauuaagggcuugauuucugucuuuccacuuuuccaucuacagugcaugcuuuguccuacagcugacuucccuggggauuggaggauggccaccagggguacuuguggcuaccuguuuccuuguucacauggauggagggaaggguacuccuguccugauauucuacgcacgagucuugaauucccucucauugaaccagccuagguuacauguucacgcaugcggcuggaacauaaaauacacugauuggcuuuaauugacugaguggaucccagcugugaagcuuucucugaaacauugaaaccuaagggguauaaaagaaaacuaaaaucugaguacaguuaggaaaggugaaggggcaggaguacaguuaggaaagauaucugggugggcuaccaacaaacaucugcuacaaucccugagcaauagcucccagcagagggcaagauucccagcugagcacccucagaguaaugccucugguuggcuacaggggcuuuaccucuucaaucaguuuucacccaagggucacguuucccaguuccaacaucuaagagcccuugauucauaauguaauuccuccaacuccauuagaggaucaugauuggggugccuggcucuuuauccuaugcuccuggagggcagcagccaugucucagguaucucuaggguccccacgcagcacccagcccacugcucacaugugcacagcacgccaucaccaaaauccccccaugauggagugacagaaagagcagcagccccacaagagcaucacugggcacauagccccaugaccucccuaugccugcuugagccaagccauccaccuaauacuuucuuauucccuacauuuguacacaucaaauagagaaagagcgaaauuuguugcaguguacacauacucuuuuuauacuaaagccgguauauuucaaauccccaucaucagauauuuauggaccaguagccaauuuuuaauguauuuuuaaaauaucuuuugcacuaauaaagugcauuauuguuuggaaaagauggcuuggagaagaaaaacgaaaucaaguuuggaaaaaugccagugucccagauuuugaaauguuucuuccacaaguuauacaauccuucccuccuaaaaaagggcaaauuaugacuacuguuaacauucaugccuaucauuuuaucuuauccucaccgauacaggcgaagauccuuauacccauugucaagauaggggaaauggagucaccgugugacuguguaauaugcuugaguuacugcuaauggcucugggauccacagugaguuagccacugcuuuggaauacaaaucugacauccacgacgccuaacuccugccuuuccaccaacugucacucaaguuucaucucaaaaucuccauaucaauccccauuuucaugucaucucuauucacaccuacccuuggcaagauuucguuagugucgugugugaauuccacaugacuguggaaggugagcaaaucacagagauaaggaaaacagggaaaaaguuuuuugagacuccacuuacauucuuuggacauucccacuucaaagcacuucuggagucgacaguauuggcaucgauuccuggugacuuuauuaauaacacaguucuuaucucggugacaaguguaaaucauauucuucugaauacuucugcggaaaaagcccugcaagcaagcaagaagaugaaaaaacucaguaaagcaaaugagcuucaucagaaaucaaagccaaccuuaucaaugcauuaauugcucuuuuugaguaacgaagugauggcagcagaaaaguuaacuuacauaaaccuuaaaauccucgugagauaucaauaguuucuuccuuuguugcaaacccaaaagccccuuuuaaucaaaacuagacaugaccauuauuaucuugcuaaaggaaaguuaauuccaagcugauuuacuuggaaaacaccagaguuggguucccuccaaacaggcuuagcuucauaacuggcucccuugcugacgagaacaauuucagaugagcgcacuaccaagaaaaccaauauaugaggauuuuuacccaauaaaagaaauuacuggcugggugcaguggcucacuccuguaaucccagcacuuugggaggcugaggcaggaggaucauuugagguaaggaguuugagaccagccuggcuaacauggugaaacccugucucuacuaaaaaauacaaaaauuagcaggcacaguugugcgugccuguaaucccagcccuugggaggcugaggcaggagaauugcgugaaccugggaggcagagguugcagugagcugagauugugccaccgcacuccagucugggugacagagugagacucugucucaacaacaacaacaaccaaaaaaaaaaaaaaaaaaaaaaaaaaacaagaaaagaaagaaaaagaaauuauuugccuaaugcaagaguuaguuuuuucaaaggagucuucucugaguucuuuuacauagcuccucucacaacauuuaaaauacaauuuaaaaaaauuauccaaaauuggaaacaagaaauaaaaaugagugucugcccauuuaauggcauguuagagcuaugucguccaacaugguagcuauuagucacaugaggcuacuuaaaucaaaauuaaugaaaaguaaauaaaauuaagaauucaguucuuuaguuacauuagcuacauuucaaaugcugaagagccacaucuggcccauagcuaccauauuaaacaccacauauacaaaauauuuucaucauugcagaaagcguuaccggguaguaauguacuacagcacugacugacaagcccaucgaagugucaucuaacacucacaggaaauauaacuuuguuugacuuacuuuuuacuauugauuggacccagauucuauacagacuguagaaaauugguaaauuacacauaauuuuugucuaguguaggugcaaaacauuucugaccagaugaacaauaaccccaaauauuauuguuuuauugcccuguaggaaaugaaccauuuuguaucuagcuuugcaaucuuauuccgguauucucuuuuccuucccuccuuucucucucguuuucuaucuaccugaauaucuuucucauauccuccuuuaaaccagcuuugucauccuacuauucccuucaucaaugaguuaaauaaauuuuuggcauguguuuacuaaacaaacacuugaaagaguuuuuugcuuuuuaacuuuuugaaaaucacauuuugacaaaagaagcaauuuauccugauuuucugggaaacaccgaugaaauaaagcagacuucaggcuccagaagaaaggguccccaacuuccucuuugucuuccccguuucuacauacagcuuugcagacaauggaugaucaagugaugcuugccgaauacacagaugaaggguauaccugcugccuuuucucucuucugaaugcccaagaaaaacuuccacauugcuaugaguauuaagagugaggaagucuacuuuaccaguugugaugugacuuauaccuacacgagaaacuacucucuugaauguaagaaacacaucaucaaauguguugaacagaaacuaagccccaccaucugaguucaacuuucccugcaguacauuaacacugcaggagccagagcuaagaacguucaaagcuaaagcacauuagcaaagaaugcucauguaacacacauugcuuaggauacuuacgugggcacccuaggauuuuaaugucuaaauaagcauauuuuuacuggcaugguucaacuauaagugccuggaaaucuuguuuaagguugcaaguccugucacauaucccagacacacacauuuuccaagaaaacacaguuuauuuuugugccacuggaacuacaaaugugcuuagaaucuaaaauaacagguuacaaauacugugaaauccucccagaaucugugcagaguggucaucuaaaaacauaucuuucccuacaaaaaauauaacugugggccacuuucugcugccagauguagaaacucaguuuacagaaaccuccaucgcucuucugccgagaaacauuaacacaauggaaaacauggucuuuuauauacgugggaagaaaaugagguauggacaaaggugacccccuccauuuauuuuauuaaaaaccaaauuuuuaguucagcaaacacuuagucagugaccagaaaggagagaagaacaaucucacgaugcucaaaugaaagaagaccagagaauuaaagaacuuuaugucacuaauugcccagucagugugauucaguaacaaugauggcagaaacuaaauaggacuucuugguuuuccaaaucagauuuuuggcuggauuucaggagaaggucuaaguuucaguaaaucauuuccaccaugcuagaauacuugcuggcuaaaauauaugcuaugagguauuuuuauacguggguugaguaaacagacgugcccuccaagccgaauagagguuugcaucauaaaaauucuccuccuccuucauugauauuaugaguuuauacaaaccucacucccuuguagaccacugcuuugaggacccagaguguguggcggguagggggugggggcaguuauccucauacaccuaaaguuuacuuagcuaauauuucaauuuagguugacuccuccuucuauuuuugacacuauuuaaaguggaaaccauuuaucucuggcuuacuuggaaaaccagaccaacugucaauauuagaagguacucaugaaauaagagaaaugcaaauaauacaauaaucagaugucauuucacucauacuggacacugugucugcugcaggccaggagccccagcccuccucacuucuugcugaaaagggagcuuggccagcaugagacacacaucagcacugacucaagauuuucuguuugaggaauucagagaaaaaaaauaagcuucuuacuaugugacugauuuaaagccauggaucuuucccaccuaaaauuagaacccccaaacuucaggacaaaguuugggacaguuauugaagccaagggaugguuagacacaucuggagaagaggagguucaaaaguugagcguguacagaggaugaauucagucccauuuggaggagcaaccugagaggagagaguggagguagcauaggucgagcccuggauuaggaguugaacgccugggcugcaagcuccucauggucacugagaggacuugagcaagucacaaccaucugggacuaagcucucucuuccccugaaugagggauugggcaguuuacuuggaagguccucuccagccacaaauuucugggauuccaagugugucaucacaccaggaagugaugaguuggguaccuagagagugagacuuggggaguuucugcgggcaaagaaauuggcgaaagaagaggugguauuuuggcgaaagaagaggugguauuugcagacuaaggaaagagagacugucuaucugcaugggcaagaauagcaacuucuggaaaccagccuguggcuuaaaggacaccaucaugagggcuuuuauauucaucuuagaacugagucaucguaacaccucugagggccucaggcagguaucugugcugcacugaaguuggaauguuucaauacuaucccaagagauuguggcuagaagucuuaagaccugguuuucggccaggcgcgguggcucaccccuguaaucccagcacuuugggaggccaaggugggcggaucaccugagggucgggaguucgagaccagccugaccaacguggagaaagcccgucucuacuaaaaauacaaaauuagccaggcaugguggcgcaugccuguaauuccagcuacucgggaggcugaggcaggagaaucgcuugaacccgggaggcagagguugcagugagcugagauugugccacugcacuccagcuuggguaacaagagugaaacuccgucucaaaaagcaaacaaacaaacaaaaaaacaacaccugguuuucugcuaccaacucuggaacugcugacaccguaaugguacucuuucauuuucugggaacuuccuuuucucaguaaacccaggaaaauucuaugaggucacuuggccaggaagccuucucugacugaucuaagcauacauggaugcuuccucuccuaggcaaucaugguauuuugcuuuuccuuccauguuauaccuauucaaggaugauacuuaaagucuaaaacaauaccacugucugcuuuagagguuacauaggugacaugggggaaugccaaccuguggcugguggccccagccucagggagcccaauaggcacugugcauuuauccauuaaggugucucagugccaucaagugugccaccuuccuugccgauacucaugccucccugacaggggaguaggauagguauaaaggcugguuccuaggaaccugagcugacaaguugguggacucaagguggccuccaggcagugccaaauaugacaccccuggaacuaagacaguacaguuggauggaggaagggaagacccaaggcaacggucaggcaaaaacuggcaggaaaauguuucaauuuuucaacaccuaauaaauuguacugggacacaccagcugaauagcucagggcugggacagaacccaacacacagaagauauucaaauaauaauuguugacuaacaacuguuagucaauuguaauuguaauuguugaugaaguccuagcuauaaccagagccauaguaaccgucuuggauuauaccuuaguuucuuaaauguauuccuugagggugauaucauuuguauuuacgcaauuaaacaaucagauuucucagcuguuaguagcagacacacugaucugaguuggaaucagcucagucagggccucuguuggcugugacuugugcacguugacuaugucuuuuguuauacaucauagcuucugcuggcuaaucacgaauucuguuggucaaacuugaguuuuguugcuuaauaaugaauucuguugcuuaauccuaauucuuguugguuaauuaugacuuuucuugauuaaccauggcuugauuagucaugacuucuguuguuuaugauaguuaagccgguaacacaaugaacaccaauuacugagaucagaaagacagaucuguguuacacacugagucaagcauuuucuaaccguggauuuuucaaucuuccuaccucaugcucuuugacugcuguuaccaaagaacugagguacaaccaaaaaggaaaaagaaaaacucacaugguggagaaggcuauauaugcauuagagccauuugguucauguauuagcaguaauuauggaaugcccacaucugacucagauuacuucugucucccugaggguaugaaguaccacuguuuccaaucauuccuauuaucuacagugcagaaagaagcaaaaaucaaaaggcaagauaacugucuuuuuuacaccuaaauauccuucucuacccaaauacauaaaauuuauaauuuucuugauggacauaucuuaaaucacaaaucaagaaaggacauggaaaaaagugguucaucucccucccuccugcauauuuugauauggaauuggguuaggccaucuucccuccucugauacccucaaacuauugcuuuagauuuuuuuucuucacacaugaaccccguuucaccuucuaauuuucagauguuaucacacacaauaaucuccacuaucuuccacagggggugauuucuguugguuuagauacuggccuggugaauugucuaguucaggcacauguggauuugaacugugacucggccacuuacuaucuguaugaccuuaagugaguuauacuaagaccucaauuuccucaccuguaaaaaaaugaugacaaaguaccuccugagagaacuuuguguauccaaagagggaaugcaugcaaaguguuagcacagucuggccacauagcaggcguccagugaauagcagcuacuguuauugacaaaacuucuuuccucaguuuuuucugaacaauuucccauacacauucuauguuuaaaauaaagauccccaaauaguauaggacaguguccaaccucuaaacaauauaggcucuuggggauggacaacuucaugauaccaaaggccaucucuauauuuaauugcucacuuuuugauacauucacucgaugccaauuagaguagaugugguaagcuuucuuggagcauacaaaggugguuccuguccuuucucaguacagaagaaacaguaagucaagugaacacuauguaagaugccaccaagcagugcgauaagaacuuuuauggaagcagacagugaaaaaguauccacuguagugccugauccacauauugcagacacauaaaauauuuacugagcaaauaaaggccuuaggaauucaaaggaguuagaagggaggaaaacuggcacuugaucucagcucuaguggaaaaaguagaauuggaaaggcaggcuuucccccaagaauauuauggguaagcaacagagaucaggaguaagaaagugcagggaacagccagugguccaggcuggcagagauguaaaugauggcaugugugugugugugugugugugugugcguaagauacagcuggaaaagggggcuaauguuuaaacuggggaagaucuuaaagccaugcaaaguguuuacuagagagacacuguacucuucugugcaguagagggcuagagucagaauuauauucugccaagauuguccaggaagcugugauucauugacuucgucaugcaucuaucugaaguagauauugagcucuggguaucaauacaaauaccuaauccccugagccugcccuugggucuaggcaggaauguagcccaagaauccuugcuuucuaaaguaacagugcaaucugcugacucauauuuaaucauacauuugcuugugagaauucauacugugguguuuugaauggaaguuauuuuuuagccuuagagccauugauaucagguuuaacauguguggaaugugucaugauuguuugaagaaaggaauuaaggcuuuuuaaaaaauuuuuaaaggcaauuuggcacuauauuuaguuguaaaaagcauuggaucaggggaauccacccaaaaagugguguggaaaguacaucuaugugaacugggcuguugcagaguuaauuucuaucccaugcaaaguucaaaaggauaauuucuccuucuagagcaaaagaaggaaaagcauuacuuagucauauuuuccucacucacuaaaagacucuaaccucaucugaauaaaaaaguaaccaaaugaccagcccagguagucauucagccaugcagcaaggcuggagcucugugcagugugaccccaggccagcagagagcugccaauaaugcucauuuccagccaguaguaaaugcugccaguaggaggugaguguggaauaaucccaucacagcuacucugggaaacaugguuuuuaaaccaggaaacacguugccuuaaacaaacaaaaaacacccucuggagagaguggaagucuaugcgugacaacgucugagaaguuauucauagcaaaauuuggggggagaaagagaaaagugaagaccuuuucaccccacugaaagacaaugggugagagggagggagaaaguagaaaaacacccuauuauuuugaugacagugaguuuccuucuaggcagggagggugggcauaaauguaaugaaaagaacauugaacaagucaaguuagauggggccaaacuccaggacacaaaaaagaaaaagaccacaaauccauacuccaaacaagaaagcugaguugucucaagggcaaaagcugagaguuguuuauuuuuguuuaaaaaaaaaaaaaaaagguaauaaauccccaucaggacauggucccagugcuggggacuuaguaaagguguagccauggcuucuauaagaucuguuagucuauagcaccucuugccugcuaacuuggaggguaucuucuggucuuucacugagaaucugaccauguguuuuaggccuaaaagucuccuuucaauucccuuggucuagaagcuuccucggcacacuuacuauuagaaaagaaagccugaauuuugaaaauaugcguagaaaaaugguucuaaagaaggcagagauuacagguuuagcaaaacaucaucacuguaaagcuaaucuuucgagaagaauaugauuacagcauuuuccuggauuuugucaggugaauccuugagagcugaaccucuguuagacccagagaccacagcucucaauccuuuuaauccccaauuaauuaaaacucccugagaauaccaacaaaaagguggcccauguucuuaacucagaaccugaacucacaucaucagacaucaaggucuaaacuuccaaagucuaugaugucccaggaagggcgugaagccaauguauucaguucacaauguucuuuauuuuagaggaacaugagccagggaagaaauguuacuagguaacguaaacuggaaaccaauaguaaggagagauuacucaguuggauaaaauguccuuuaauuuaggugaaaauauaucuuuuucuauuuccaaaacaugaccuuggauaccauacuucuuaaaugaccagguaucauauaggucugauuaucaaaaccccacuuuaauugguaggcaacaaguccaccagguuuugugaccaauuaucucaaaacaaaauuuucagggagcaaguuucauaaggcaaguaaacacugcuaaacugucuucaaaaagugaagagcuguguucugggcagggcaugugacugugcagucccacagggccuugcaucuagaagggcccagagcuuaguuuacugcucugcugucacugucuuaaaauucaaaauaauuuuauaauuuuuuuuuuuuuuugagacagagucucacuuuguugcccaggcuggaguacagcggugcauucuuggcucacuacaaccuccgcuucuuggguuccagcgauucuugugccucagccuuccgaguagcuaggaucacaggcaccugccaccacaccuggcuaauuuuuguaauuuuaguagacacaggguuucaccauguuggccaggauggacuugaacuccuggccucgaacgauuugccugccucggucucccacaguguugggauuacaggcaugagguaccacgcacgcccagcccuaaauaauuuuugaauaagagacaagcauuuucauuuuguauaaaguccugcaaauuauguagucaguccaggcuacagaauaccaucuacagcaaaaguguucaaucucuuuuuccuuuaugaggacguggcagucuuggauagucucggauagucucucuucucuucugguugaccuuauguuuaaagacuguagaucagacagaauuaaguaguucacuguaaucacacucauucucccacaggauccccuugggaugccucugagaaauuccacgaccugaguaaaagcuagaaagaaaaaccuuacaggagggguuuuauguuuuacuacugggcuuuauuuuuguaguguaaaagggacuugggggugggggugcagggggagugggagaagccaaaagaacacaaagaacuucuuugaaacuagauaaaauuuccuucgaaacagcacacauaucuacgcacgguuucaagaggauaucuuaaaguucauuauaaauccccuaggugucucugaccacuacuuggaagccacugaaauaaaggugacuuaaaaagaaggugaagaguaugagguugaguaguuacccaaagaauuucugugcaguaggcuaaauaucauaaauaugauaucuugcggacuacuuugucucuucucaagaguuugaauuaagaugugguaggaagaaaaacuguaugacaaggggaaacgaagccucuaaaaugcaagauuucgcucuucuccacaugcuuucuuuaaaucugguucugagaauuugaaccaacuaaagacaucuguuuucuaaauuacuuaggucaguuauuuugugcccuuccuuggugaaauccauaguuaccgaucuauuaucaggauuacucuaaguauaacacggcaagaagccaaugaauuuuaaguuuuuaaauuuucaauuauuuuauugaaaaaaaaaugcaacaaaauagcugcucagcuacagcccaggaguuagcggaccccagcugcuuuguacauuaauuacuaaaucucaucuggacccaaauuaaauuuucucaucuguacugagaagcgggggagaaaaagguaagcagaaggagagagagccaaaacaugcucauauauacugaaacccuuuaccaaagagcaugaauuuuaaaaucucuuuuagaaguuugguaugcaacauuuggccauuaacaaaaccagaacauggcucuaccauaacaugcugguugacggcaaggcacaucaccauggcgaugcugcauauugcauaauucaaaggccucucacagacccaaauaauuaugauguacuuguauugcuuuauaauguuaaggaccuaaauuaguacagaaaaauaaaugcuugucuagagcuuggugcauuuuuuccaagucuauuuaauuuucagggccauguuggaaucuucucacuggaauuuuucucgcuuauacaugguuccaucccgaaccuggaguaaaaaggaaaaacucauagagucuaugagaaugggagaaggaaagcuagucaggcauuuacauuuaagucaagucugacaacugaaaaauaacagggauuuauuggauguagccuucugcuucucuucaccacagacacugcucugacagugcaaaaaucucacuaaguuuauugagaaaauauuacuuaagcuccagcucucaaaauggauucuguccuuguauggaaaagcuguggugaguccaggcugacgccugauaaugcuaagaguaucgaccucuacacacugagaucagcaaugaaaugguuuaaagcccaccugccccucaaaguugcucaugccuuuguccagucauacuuacccaggccccccaaaccuagaguguuuucucucugcucagugccuuuccacaggcccuaggacuugaaaguccuuucccugccuuguucuuugguucaggacugcucaugcuccaaaauacagcccccaagaggggucaggcucccgccaagcccccacuaccagcauaugcuguuggaacauucucucuacaacagugcaacaauugaucuuugugucucuuucuucuuugaaaccggaguccuuugcaggcagggauguaacaaucuuuuuuugugauggaguauaugcaacuuuuauaauuaaagaauaauaucauauggauauuccauguagaaggaaaaggaagaaaaggaagaucagcaaagaaauguaaauuuaaaccaaaauacuuuauaugcaaggaaaggaagaaggaaguuauauuuucauugguaaaacucuaauaucauaaauucaggcagcaauguuaacuuacugauuuauuccaaauuagcaaaaaauaggcucaaauuucacccacaggcuccucuuucuugauccuuaaaauuaaaguagcuauauuaugucagcacagugccaagauuugaaauuaaauagguccccaaugcaaaagaaaaaguucuuuuaaacaacaugaacuugucugcaauuagcacauuauagcuuccaccuaagcaccaugcuauaugaaaauacacuccuggagcugcugcuguuucaaagaccuuaagcugugcacuuucugaaguuguuuuguaggagaacauuuaacagaacacacacaauuaauuuuuuaaguguuaccucucugcuuuuccauuucauaccugacuuuaguugauaaaaagaggagcagccuuuugauuacacuggagagaaggggaaaaacagucuccguaauaaaagagguaccugccaauuaguuagauuguucuccaguuuucaauuaaaggcagccuaauggauguagggggaccuguuuuauuuucccugacagagcccuuauuuuuaaacucuuagcuucauuuuccaaaauugcuggcuuuagacagaagaaacauauaucuugagugaaaagcuguacuguucuucuucuauuuccuguaucaaaauuacauuuuucuccucaguggcuacuucccaucuggcccacaaagcuuucugcugcccaggaugggcuuguuaacggaugguggucccugaugcuauaacccacuccaaaagauggggugucagacccugcccccaggccaggaagccucaucuaggagcuuuggggguguuucagccuaauuuugcuuuccucaggugaucauuccauggaacgucauuuacccuucucauuuucuccagaaggacaaaagagauaacuuaggagggaguguuuauuuugaacucauccaaaagcacuucagucucuccuaagcaucagccuguggaugaaauuugggaauuauuuuccuuagaugaaacaggacugaacauuuccuuggacauggcuggccuucuuccucggaacacacacauauucaagauugauauuuuuauucagaguuuucucaaaugaauaauuaggagauguucacaggcagguguaggaaaaagagccgggcccccguaaaucaugauuaaacuacauuuaaccaccaaagaucugaaccaccucuuguuaacagcuuagcaguuuuguuucugugggauagcacagucccuagacuuuggggaauuguggggccaauuccccauacugucaacaguaguuauagcagcugaauaaaucccuccagauuggaccaaccacucccuccaggcuggaaaauaagccaugaaucacauuauccugguaacuugagauuuaacauaucuauagagggaagauauaaagcuucauguauuaauuccuauuuguuuucaacaucaccugaaguuuaguugguucaaaccaaagauggcuacaagaggcacauuagaacagagcaugacgccuuagugagcauuagaauagaccccgugaaagcaccaggcagugacacaaaaguaaugcuuucauccugccaagaaaacagaaagguguuuuaggagccccucagaaggagauucugaauuaauguguaauuucagguuuccaaauggcuuuuaugagcuugcuuacccaaaguauuucagaacaucaucucuuuuaauuuuuaauuuuuauccgcucaaagcuccaaaaauauacugaucugaaucauugccucucaucuuguuaucuuaaugggggaaggauagaguaucaugccgaccauuccgcauuagguguccucauuuacagauugaaaaaaaaaaaaaaagugccggacauaaauuauuuaaaaucuauuguaucaguguguguucuguaagcauucacuaccggcaaagcagacagauuauuuuucacuuuuaauuguguugauaccuuaucugcuuuguugaaagcagagagugguaggugaaaccacaucgcacgcugaggaacagagaagcaauggggucuauuauuuaaagccaaaguaacccauuuaguggacauaacuuuaacacacuuccauggaagcgaaaaccuggaguugcuauuuacgucuguaaugugugucuauuacugugucaaacgcgacugaggguagcacagggccaggcuucuuaaggaagcuguuagcugacugcaucagggacaccagacaccucacaucaccaucccagcacaaaaggagagaaagugugugacugagcaggggaacuaguccagcaucccuccucucucuccucuccaagucucagguguguuguaaagcaauguaaaucagaggucaucauagguauacuugaccuaauccaaaccuuguccuaaucuaagaaaaauauuuagaguaagaagaauauacuuagauaauaaaauuaauaaucugugacuggaaccugauugaaauaaaauuauacagagggauacaaggauucauuauuagaaauucaaaauuagcccuucucccauuguccgugaagaccaucaucaggaaaugcauauaugugcuggauauaucagaauguagccaaaaaaguaccucaccauuauccgaauuuaaaagacccuuccaaacucagcaacuuagcaauucauuugggugaaguggcagaugaugguaggguauauacagauaaugacuauagaauuguucugauguaguuuauuaaguugaagaccugucauaacucuagcuuuuuguauccucagcaccaaauccagcaccuugccuggcauucaguaaguauuugcucacauggauggguggaagguugcaugggagagugacuucguuggccaaauauccucugccagggcuguaggguggcuuaagugacuucuaccucuacccaaguagaaguccaaagggcucuaagcuagucuacuuucuuccuuuaacuggcuuuguacucuaagcaaacaguugaaccauuucuguaguuccauuucacaagucugaaaugaucucuacaugccuucuagcacugauauuugagauuuccacgugucuuauuaaaggaacacacacucagcaugucuccaacauaagccuuagcucuauaccuuuugugacacauggcugguuugguaagauccaacgagcuaaagaaagcccagucucccaaauaugggcccuuuuugcauugacucaaaauccagcaaaaagacaacucccagcaaaauacucaagucaauaaccagacacaaaauggaacugcaucauaucugauauuugugaguuucauuuccacacugucaaauauaauucguggcaacccacuucagugaaagcccaauguaagccacugcacuguucuuacccuccaaacuccacaaccccaaccagugugagcuucaaauugaacuccugaccuuuccagcaauuauccccagaaucuagacagccccaucaucaccucaagccaacgugugagaggagcagcagccaggaaugcucugccucuguucccgaagggaaccagagugagagaggauccugcuuuccuuuccaucugcuuucuccaauaaaagggaaaaaauaaauggaaaugaaaaguauacaauuaaaaaaaauuacauuuaacuuccuuuugcuaaugucuguaagaugauuuuuggccuggcaggagacuccagaugggccguguaaugaauauaauuuaauacaaagaaccggaguucacagaaacacauuuuuccaagucugaagguaguggguugucucacacuguuuaaugcaaaacaccaggacaaguuauugcauuuauuugcuguugcacauuggccuuuaaaccuaauaugaguggggcuagaccugaagccaugaaaccagaagcugucacucucugagaugaggcuggcaccagugcacacucacccaaaaggccagagaccacuaaccacucaauguguuuuuccucuggggucugaggauuuauaucaccaauuaaggccauaaugagugccccaaguugaccuccuaggagcaagaauuaauuaagcacaguauuucuuaguaaagaaugacauuuuuccaaacgaguuauauaagguggccacauuuucugauauuacugugcuucuauguacaauuccuaauuguuaacacaaauagaauauuccaggaacacagcuuaguuuauguuuuuaauuugacaguaaaagaaaauaauuuuuacuuuuauccuuauuuuggaggcaaagagaguguuuugaguguaucgugugugugugaaacacaaaauuauuuacauuaguaauauaauaucacuucuuucaauuauuaauaugacuauaaaugaaggaagcuaagacucauauuuauaaccuucccagcuuucaaaaaugaaaagucauguuuuaaacccaguuguacuccagcauucguguguuuccauaaauaugacaauggagguuaaaaaaaaaauagguuaaagcuuccauuuuguaaacuacaccuuaaauauccucauccagggguuggcagauuucuauaaagggccaaauagaaacucuuuaagcugugggccagagacuuagcugcaaauacucaacucuaccaucacagaaugaaagcaaucauagacaauacagaaaugaauggauuggcuguguaccaagaaaacuuuauaaacacugaaauugaauuucauauaauuuucauauguuauauuaauuuuuuuuucaagcauuuaaaauguaaaaaaaaauucuuagcucuuggccauacaaaaacaggcagcagacccgguuuagccuaugggccauaauuugacaaccccuggcuaaaacauauguauauuuuguaguaaucagcgagguuggagaaaacacggucucuuucucacucucucacacaugcacacacguacacauacacccuaauuaucaacaucacggucucagaaacuauugauguacuacagaaaaaauguggcuucaagcaugucucuuuugcuaugaaccaggacaugaagaaaaccucagccuugaagaaauguuacaagggugguaggaaaaagacaccucuuuccuccucgcccuuucucauaaagaaaauucccacucuaaauuagaaaucaugucuuucccuccuuuaaggaguuaacauagccagcacagaucuggaaaucccuacagccuacuugccaauuaauguauuuaacucuaaagagcaggaguuuuuaauuuagcucauccuucacuaacggaacauuuugguagaaaauauuaggauuuccaaauaacuuuauagcucuguaaauugccaacauaccaucugcaauugaauuaacauuuauaaccaaacugaaauaauaaauaaagcaaauuacgcugcaaauauuugugagugcccaauaugcacuugagaacgauaauuagcauuuuauaaucacgcuucauuuucuuuauccgacucccugucacauuaaugauaaaauauuuuaaacugugcucuaucagcaaauggcaguacaaucucuagauuagccauuaacuaacauggagaaugaacacaguuugugcugcugacauuaugcacccagaaguuuuacucauaaucacauccuccagucucccuugcucuuaucucuggguuuuguuuuguuuuccuaugcuaccaaaacaaggcugagaaagccagugcuucauuugcaccaucugaaccagaagcucuaugggaacuaaagccacacacucucuuuuuuugagugaaaaaaaaaaaaaaaaaaaagaagaaauaugauuuuaaaauuuaugacuuucugaucuagaaaaccagggucuagaggucaagaagcuuaagucacucaaauggaaucacucuuguccucaaauaauuccaaaguucucucucauuaucaucugacauccucuaccacaguaugugugauucuuuuucuagguucaaauaaauguuaauucaacuaaauaaacuagugaagacuauauauguacacauauuuuuucaacuaaaauuucuaccaauuagcaaaauuuccccaaguuuucccauuaucuuccuugaaagucaauucccuuaaaacaauugugucccgaugcuuucuugaaucauuucugccucucgcuccaugucuguuugcacuugacauuuugggguucucugccugugucgcuuggcuguaauucucacaucucuuugauccagggcuguucuguccacuacaguagccacuagccacauguagcuauugagcacuugaaauguggcucauucaaacugagauguguuggaagugugaaaguuaacaucaaauuuugaagacuaacuaugaaauuacuauguaaaaauauuucaauaguuuuauauuaauuguugaaauaauuuuugauauugcaguacauaauguauauuaguaaaauuaacuucauuuguuucuuuuuaaaaauguggcagcuagagggcuaggcggguggcucacgccuguaaucccagcacuuugggaggccgagcugggcggaucaugaggucaggagaucgagaccauccuggcuaacauggugaaaccccgucucuacuaaaaauacaaaaaaauagccgggcaugguggcacgcgccuguagucccagcuacucgggaggcugagguagaagaaucaccugaaccugggaggcagagguugcagugagccgagaucacgccacugcacuccggccugggagacagagagagacuccgucucaaaaaaaaaaaaaaaaaaaaaaaaaaaaaaaaaaaauuuggcugcuagaaaauuuaaaguuacauguguaacuugcauuuguuguuagcauauuucuguugaacagugcuggucuacuggguucuaaaugcagugaugccugaaacuuuuuguugaguacaugcucugcuauugaccaaaaugauuauuuuucaaaggccaaaucaaguaaagcuuuugaucaacuaaauccuacaugagugucaucaggcaacuccagaaauuucaaagagcaguaaucuuugucucagccugcauacagucauauuuuuauugcgacaaauguuugauaagccagacauaccacuugaauauagaaggaaaguggaaaugacuguuuccauagcauuaugugcugcuaugugcuaagcauccccacauguccagccagguucuguaggaaaaaaaagggagcugaaagcagaggcuucuuauugcagagguagucuagugguugggggcuuggguccugcugccagauacccuagguucaaguucggccucugccuguuauuagcugugugaucucagacaaguuacauaaccucucugugccuuaccuugucuuuuaaauggggauaguacuauuuucuaccuugugggauuguuaugaauauuaaauuuguuaauagccuaaaacaguaccuggcagagcauaagcagucaaaaaauauuugcuguuauuaugauuacuagucuuuacugccuuuaaagacagacagaaguguucacaaagcaaauggaagugguaaaaggugcaaagaaagcuaaaaacaaagaguaaggugagaccaggaaagaagguaaguuggauguaggugaagaggaaaaauaucugcaauguaccacagggacaauauguacaauaugcacagaagcacuguccugcuaggaucauucacacaaaccaugccugccaccagcugauaggcugauucagugaccauaacagacaggcucugcaugcuuaaccgagggaacaaucuguuaauucuaacaguuuauggaucugccuuuuagguuauaaaaggaaagcacauuucuggacuagcuucugggcuagcuuuaaaaauauuuggccaguguuuuucaaaaauuuuuaaaugcagaaaaauucaaaaaacauaauucuuuuauuuucauccauuauuucuuccuggcauuuaaggcagagguugcaaacugcuaauuuccaaacugaauugagcuaacagacauguuuauuuuggcucagugguggccgacacagucuuuuaaaaacuuuuaaauacauugccaauacuuaaagaauagauuuaaaauaugcaagagauugacuuaauguucuuuccuaauauuucuugccuaaucauuguaugaucugagugguuuuuaguagugaaaugucuggagaaccaaaaaauaccuugaaaaagccauaauccucaaguaauagaggaauucucuugaaauauugaaaaaccuggcagugcuaguuccacauuccuguagggcaguggcucucaaaaugugguuccugggcuagcacucagcauucccugggagcuuguuagaaaugcacauuucuagacccccugaaccugaaacucugggaauaggaucaauuaaucgauccuuugacaagccauccaggugauucucaucauuauaagcuuguacuccauugaggcaugcaguagcaaagaauuagaagacagcuacuaucuuugcuacacuccccaccacccucuacuguaacaaaucagccugcauuauuuacuuaccugcccugcccucccaauaaagcaccugguuucucaaauccaauaauaaaaauuaacucuaauaagaaaaaauaaauaacaacuucucaaugggcugauuucugaagaaaaugaucagguaucuuuuuaucuaaacacaacuaaaaggauugacucucaccuuuagaauuauaugaaacaucaccaaaaugcauccuugccauacuuucaaggacuagugaaucagauaauguuaaagaugggaguuaguuaccuuagcuaccauuugaaccuaaccuggcccaugacauaggcagaaaaucauguuccuaaagggaaagggaaagagaaguaaccgggagguucacagacuuggcccaggugcuacacccuaccuggaaaauguugcagcaacagcaacuacuuuauagagcuguuaugaggauuaaaugaguuaaaaacaugggucuggaauauagcaaauucuagauacgugcucuuggcacuaaagaagcacuguguauauacuacacugucuacuucucaaaauuauuccagugcucacauguuauuacacaaaagaugaaacuggauuucagugguuuguccaaacgauggagccaagauuugaacccaggcuaugugauucccaauccaauggaaauuacugguuuaggcuaaggggcugcauaccaguaauaggaaaagcagaauccacacaccucuacaauauuccgccucaucaaaauugagucuguugugaaauaugcaaaucucucacuuccaaacaaauauaaccaaguuuuuuauuuauuauuauucaaggguaaugggcauuuugugggucauucaaguucuuuuccagcuuccucguuauugcacugcugguaauguaugcaugggagcaagaggagggaggaagucuuaucagucuguuucacuuccauguggcuguuauucaaaaacauccaguagaagagggguugaaagaugcaguagaauuaacaugaccuguuguuucugugaucagugauaauccacuuccuuuaugagagauaauaaagccuugguaggugguaaugaaauguuugaaccaaguaugagauuugaagacuuccaagucuucaacucugacuaacaaaguaacaauucagagcugucaaaaacacuuccaucauucuuuagaucuccuuaaaauccaugaaauucaauucuuucaaaagucaucacauguacuuauaaggauucgaacaaaauucagcacauuccauuucauuuuguguuuaaauuuuaaauaggaacaaauuaauaaauagcuuuugggguuuuaaucuaauuugaaauguaaaaaagaaaaauaaaauucauggucagagacaggcauggacugcauaauaccaugcacaacaaggcugagauuuuacaaagcagccauuuaacauagaguaagacaccuuucauuucauaauaugguauuaccauacugaaaccaaugaacacaccaugacagauucacugaguaguuuuuaaguaaauaccccugcauauuuucucauugcccuucccuugacacacuguacuucacgaaaauucacauccaaguucaaaggcaaaaaaaaaagaagacagacagacagacaacauuuuuaaaacagcccagccuuagaaauauguacagaauucaugccuguuucaagugcucuuucucccuucccagaggguacaauuaaaggcccauagacgacuuccaaauggaggccaaagagaauuuuggucagagucaacaggaguucaccacccugaccaugcacaggaauagcucuccccaaaaggaauaaauaacuauuuuggcaggcagcacccugaaaacgcaaggacuggagcagcuuacauuagagcccacauuugguaaaaauaaaaaauucacccaguggccuagaaucaauaugagaauagugauaugaucugaugcaagccaggagaaagcagggggccugaacuugagaccacucccugagagaucagcuugcggucuguuuccauaaagcuggcagagccaggugucacaugggccuucugauuucuucuuuuucucccuguguccauagacgucaugucgauacuaaggguacugcauuuuucucagucaccaggaaagccagaacgcacucacagcagcuuaaaggugggugguagccacauguccauccgccauuuaacugagugaguguguccccugaaguagggcaagauggguggugggaacccacagcucccucagucugucucaguucccaucugcuuuucagaaugagccacuagucuuccgagggcacagagaugcauauuuuuccuacaacaggcucucaagaacaagccaccugcuucaucuggcaucuaacugaagaaagagccugugauucaaaacuaaacucagucugcagcagcuuggauuuuccaaagauggccacaauaauagcuccuucccagaugcucuuuuaaagugacuauggcacuaucccaaugaaaggaggguuuauguccccuccucuuguaccuggauggaucuguggcugcuuuaaccaauagaauuugacaggaggaacacuaugggacuugcaaggcuagggaauaaaaggccauguggcuccuaccuuguccucugcaaccuucguuuuuggaccucugagcccccauguaauaggucugacaacucugagaccaccauuuuguaaggaggcccaagccacaucaagaagcugcuuguauugaugcuccaguuagcaguucuagcugaggacuuagcaggcaacaccaacuacgagaccuauaacugaagacaacuccaauaccuaccagacacugaguuacuccagauguugacugucaucagcugggccccagauagcaggaagcaaagacaaaucauccccacuaugcuuacauaaauucaugacccacaaucugugagccaaauaaaaaaguuuuaugcuauuaagauuugcgaugguuuguuauacagcaaugguaacugggacacgucuugggugauuuaagggucauuuuaaccauauacaauauuuaccucauaugcuuauucuagaaguuaaacccuaagggagaagggauuccacucucugucuuacuuacauaauagagcuguuauaaaaaggagauguugcauauguacauccucaauaaacugcaguaugcaaguacuuguaguaauuauaggauuuaucacuucaaaaugaacagaaggcaucuguuauuucacuguuguauaugacaaacagggaaagaccaauauuugaaacccaaaaccaguucaacuuggggcuaagaaguaaccugaauaauugauaaguucaaccauuguguaaaggaaacagucacccuuggcagacaccaaaaagccaucucaucagguggcauacugagccccaauguuguucuugagucaccuaccccaugcccaagagcagcauggcaauaggcagcuaggaagauacagcaagacagauggggcaggcaccucugcauaccucugaaucucagaugagcauuuacuuuccuagaacuaaaaaugaaaugaauaaaggaugccuauugacauuuucauucuuccuuucugaucuguuaggacauacuuggccaacaguauccuaaacaucuccuccauuugccccauagcuauuguccugugauaacuuggaucuaguacaaaugugcucuaauucuguguuuucucccaccucuucuacauacuauuuauuauugagucauucaacaaacguuuauugagugccuacaucaugccaagauuugcugugggugcugagaauacagaagugaacaagacuuacaaaguuccuauucucauagcacuuacacacuagugggagagaaaaacagugacuaaguaaacuauucaugaaagaguuucaaauaguaaucaguaccacaaugaaaguuccacuacaggaaacuugcaaccucaggauggcugccagcacuucuacuccagggaagacucaacaagccauuguggaaaaaaugguguuuacacagaaugggacaguuguaggcccacgacugggucucucacauaaagacaaggauagcaggugcccuuuaacugcuuggggaggucccagaaaggcaggggagacuguagaaagauaaaaugaaagauacguuaugaucauauucaguuuggagggaggcaauuuggggugccacacaauuuuuuuuccuaaaucuacccuauaaacuauucuuaagaaacuuguaaaaagugucugcagagaauggaguguaaaaauagaaggcacagccaaauaagaguaucucuacucaaaagguuuuacauaaaccucuuauuaagggccccaaagaguuugauauugcuggggaggggacccuuuauccagugcauauaaaugcagcugugcaagacaaguacacugagaaccacaugguuaugggaaaacaaaaaaucauuguaauucuuagagcagaagaaaggaguaaacauuggcaacugcccauucuccuucuucuagacacaugguauguuugcauuuucaucuacuccauuuggauuaggugaggccaagaggacugcuuuagucaaugaguugugaguggaaaugauguguuugagauucaguagaaagauaccagugcaagugggcaauucuccauuguucuuccccuuaauucaagggccagugauuuucuaaauggaggugacuccaucagucuugguccuugagugaagguaacauggaguagaacuaucuauccaaaauggacacauggugugagugacaaauacacaacuacuauuugaagccauuguaauuuugaguuuguuccugcagcauaaccuggccuuaccauaacuaaaaugggaagaguuagggccucaacugugaauggaagaaaggauguuacugugagaguaacaaaugccagaugcauuuccugcaggaguaauagcacugcagagccaaggagacugaucuugaagccuacuuuagaauguuauuggucagcguggauauggcagaggacuuccaugagaggagaggugacuuggguuccagcaaggauucagaaacaaacauuuacccacauccauugacugugcuccccagauggcuugaagaaaaagaaguaagugucacaaaauaucaagccccaaaauuuuucuguuauuuuuucuuuccuauauaaauucuguuuuauauauucuuauaggaaugucagcuuuauuauuuaaaauaaguuacuaaaauacuaauuacuuaauaguaauauacuucaacauaacuuaucuauagugauuuuuugcaggggaucccccccccuuuguuauuuggauaauagcuuauccaccccgauauaauacagguaaacauuuaguuccuuggaggucacucuuaccaucccucauccaaugcucauauuucugauaguguacguaguggagaacagaaauauucuuucugaggcccagagcucauaagaaauaagacagauaaaaauaaucaaauaacaaaggaauaccugauguagacucaauaauucaaaaauacucuuuuagguaucuuaaaccaccaaagucugggauaucaauccugugaacucucuaacagcaaacaucauacacgugagcauagcaaaagaagugccugcauuaugaauuuggguuuaaaaaccaaauauauucagugaggacaguaagacccauuuacgauuuguaauguaauucauaauuuugcacagaucuuaccugucacaaauacuuagagaaaaaaaugauaucuguauguauacuguacacaacaugagacucaaauuuuuggucaacaggcaagaauuagcaccaaacaugcauuuaaguagggcauacuuuccaccuaauucuuaaagcagaaaaugauaauuuaagagcaaaauacaacugaauuagaaauuauacauuuaauuucauuuuagugaaauaacaagaauuagcagaaucacuuaauuucugauacccucuuucuacguuuugguauuggaaugaaaacuuucauacuuuuuaucacagcucaacacaacaaacauacuaaaagauauucaagcauuucagcauaacguuuuugaugaaaucaugagauugacaaacuguagagccaaacagaauaaaugucaucaaacaauaucuuagcaaguguugggacuguaaacuggcuuagggucccagccagcugaaggaacaccuaacagagcaggaugacucuggaaacugaaaaauaaaaaaaaauaccaccaccucaugcuauuauucugaauuuauuuauguuaaugaggaaugacacauauaaauuagagcagcagcuuucagaaguauuucuuauugaaaacaugaccauaaucgcaaaguccccagauguggcauagcucauguacaauuugaguacaauacagagaaguaagauccaaacaaaaauucucauuucccugaggaauagucagaugaucccuacuggguuugacuaauaaggauaauuuuccugaugugggggacuuuccagggcuguaugaauggugguguuguguacuuagaauugcugcuauuuucagauucaaaagcccaguggagaauuaacauugcuuggucauucuaguuucuccaaauuuguuuaaccaugaaaauccuuuauaaaacuaugguauucuccccaucgcugaccuaccucagaguuuucuacugcucauuauuuuaaggcucacagaaccugagaaguacauuuuacacgcuccaguucagaguugcagccaagauaaagguuuuuuuuuuuuccugccagacauagaaaauaccuccauagaagcagaaccgagagggucaccgaagaucuugcuuuuuucuuauugaaauauuuacuuugcaaauccaccaaucucuguuauaaaugaaacauuacaugaagcccugagagggaggagaagcccaugugaaaacacaagggcugccucagaaacacuugagaacaaguuaagaagugaaauucacuauauauaugccuucucauacaucuugacaccagugaaaaggaagcagacacccuggcagacgggccaccuugacuguacugacaaguuuggugacaagcuuuauaaaaacaguucuaccuugaacauuuauaaagccugcauuuugcugcuuuugaaauaaaacaaaaccaaccccaacaaaaaugccccaggaauagugcuagccacagaacugcugccagaaauccaggcaggacgcugcuagcaaaggaaugucaucuuuucaauauggaacaagaaacaaggcucuaauggggccggccugccagaaccccagcuuuuccccuucaccccagacaaugcuagcuuuguacaggcagagaugcacacagaguuuuauuucccucuauuuuuuuuuuuucagggaugaguucuaggguccauagaacaaaauuuucccuucugguguugcuuauccauaugacacauuuaaucuuccuuucugaaguggaaaaauacucaauaacaacaacaacaacaaaaagacauaguuccuaaaaggcacaagagaaauucuaaucccaaagaaacuauuaugguaggagauagugacaagaagacaaugagagggaugcgugguuuucaggacauaagcauugcguugugcugguaugacuguugugcuuaaggacacauauuugauacaacaagagaacagaaaacaacuguuucaucugguguuccauggagugaucuguuuccagagcuauggcaagaacuggcuuuguagguccuaaugagagacauaugucagucuccagcagugugcuuuucaaagggauuuucugggguaauuuugucuacguguaaucuuugccuugugugaugacacuggaaucuaaccccugauaaaggucuaccucuauuggguaaggcuuucccaguuucucaaaaugucaaagcugaaugaacuaggaauauggggauguuuagaaucagaggccuugaaaagauaguuugauaaauuucagggaaccuuacagaaauguauuuaaggagguucucacaguaaccauuucaguaacagaaucacauuauaaaucaaaaccacagaugguagaaucugcucucauaaauucuuaguuuccucaucugugaaauggagggggaaacaaucgauuccaccuacuucucuaaauaugaugaggaucaaauaaaaaaaaccuaugguagaaacuuagcucuucaccaaauccauaauuucuuucccuaaaaguaggucuguaccugagcacauggcuagacuacaucucugagucgacuuugcaguugguuuuggucacgugucccauucuagccaaugagguaugccauucuuggccggggcuuuuaagaagcagguguacugccucccccacgcucucuuuucauuccaguagcuagaauaagaugaugcuaagaaccuaagaggaugacaagcugcagcacuggcaggaguccuaaucacuguguggagaagagaaggcugccagucaagagcugaugugagaaaaaaguccuguagcaaacauuguaccuuguggggguuuacuuuuacuucagcuaagccuggcuuaauuuaauuucauacaugaaaaugcauuagaaacacuaaggcuauaggaauguaagauauaagacaguuuuauuauuuccaugguuuuacauagguacgcggguggggagagaggcaacuguagagagugggaagaccaagggcucugagcccugcccugacaaugagaagguagaggggggcugaugaagaaggaaagccuuuccagacaauuucauuucauaucaccucuuuacaggcauccacccaggagaaggaaauauggaaagcucucuuaacuuuucuaguaaaagguggagaaacaaagaggauaauugcaauaauagcagaccuuuaguuuguuauaacaaaaacagcaaaugaaaguguucuagauauuuucaaacaacaagcaaaguaagcaucuacacaagcauuccugaacguuuaaccauuaaaaaauuuauaagccucuuaaaaccaccaaauuaaauaaacuauuuuuaccacgccaacucaaggaaaaaaaaaaaacacgcagaguugcgggcuaauucagaauucacuccccccgcccccaacuuccuguuuauccauacaccagaaggaaaaaaaaaaaaagacagauuuuucugcuuuuucaauccaaaaucaguucucaauuuguuagaagaagaaaaguguuuucuccuuccguaggaauuauuacuaggaaaagguagauugucauuucagcugucuugagguuccucgauauggagguagauucucuaagcugagauuuuucuuaaagcacuaacagcccucaguacucuuccacgucaguauaucauuccaggcacuaguucuuaagaguuugccuaaagauaguaucagagaggacauacguuuugcaaugaagguuaacugagguagaaggcagaaauuacuaagaaaugagcuagacuuuggucaccaaagaccuuguccuguuuauauauaauuccaugaauguuuacaugaauguaucaucccaagcccuauguaauuagaugcaauucauuauauaauuagauaaaauguaugaaaguaauauacuauuugcauuauuauacaauuauaucuuauuaugcguuauuuauaacuacacuaauuacuguauaauuagauauaacuuaugauaaaagcauauauacauuaacguccuacuaugugccgccucccuagcacuaugcaaagcccuaguaauaaggcugugacaagagagaccugcccagcccuccuggaguuuauagcugacauuaaacuaaugacuugguaauaaugacuugguaauaaugacuuaauuucaauuguguuaagugcuacaaaggcgaacaacagcaaauguaaaagagggggaccuaaccuggggguuccaaaggaaggcuucucugaggaaaugguauuuauugaguccuuuugagugucuuuaauauccuauggaucccuaguuguuuauauaggguuaugcaaaauaaauguuaacagaauggauagauuuccauuuuuccauguaacucuauauaggcaauuuuauucugaguccucuugccuuccagccccaucuucaacuuuugccuggaacacuccucuccccuuccucaucuggaaaaugcuuacacaucuauaaaaucacaucuucuauaaaagccuuccaugaaugugucagagggauccgagacuccuucucugugcccaucaaacccuuagcuacaauugucacagcacaugccacacuguuuccuugcucauucauucauccauccaaugaauauuuaccauuuaccuguaaucgaggagcuuagcuuuaaaauugcauuuuaaaacuuuuuuuuucuuuucuugcucucagcauuaaaacguacuuaaaaacuuuuuguuuuccucccuuccuaccagacacucucuugaacuacuagcuuaucuaauuaggcacuuacuuagaaguuccaggagcuaauuuuuaaacaaaccagguauggagacccagcugugaaauugcagagauuaccucaaaaggguuagucuacaacccgggcauugcugaaaugauggcacgcugugcuucagguggaccgugacucaacacggccuccggaacugaacacgcagaccuugcacccagcaccacucccacaugcucccaccccuccuccacguuccccuuuuuaagccccucuccacagccuaaaguuuggaauggucuuucaaagacuugagccuggucauuccccaaaagccagaauuuaaauccuuuuaccacaccuagcuucucauguuuucugccuccaagcagccagcagcugggcuugagccaguuacaucccuauuauuggacaggccugguucucuguauuuuuuaggcaaugggauucagcauuggaaaaaauauacacaaaacuuucauuucuauauccuggagcugucucauggaaggcacuuaauaaaugucugaugaaugaaugaggaaacauguaaauccuccaugguuggcagauuauagcaacagggaacagagggacgcuuuuugggucuaugagggaaacuacucugugugauccaauauaguaaugaaguuuauggcagguuucauaauucauucagcuaucacagagugguacacagaguguccuguuuuuguuauuguuuuggauauguuauuuuguucuuugggaucaauacugcagcaaaccccuaaaacagaagcaacuaucagagugaggaaagcuaaaaauauucuccaaagacagcaucauguucauguuuauccacuccaauuaaaaacaacaaugugguuuuaaauggccuuggucaaauaaaaucauuaagcucauuuaaaguauuuaauagaaguucuaaaauuaagugcagacauccaucuuccugauugcaaaacuuuuugugacugaacauucugcuugcugucugccaggaaaacccagcccagcagccgaacgcugucauggagaugagggccucccucucuucagaggcuagcaaaacaaaggcagaugagaaaaauggacaaaauuagcccugagggacugagggggcuaguggaguuuaaacucuuaaaagacugcuuuaaauagaaggcuaccaaugugaccuucagcaagcauuuccucugcgcccuuguggagaagacacgccaucacggcugugccaggccucgcccuggggccuucugcaggacaggcuggauuguggcccccaaagguuggcuuagggauaggaaguuuccacccaucaaaggcaaaauguagagagcaaggacaaagcugcaucugggaacaugcccauguguggguucugccugcuaacugucccuucuugggaaagacugacugccuuguaagcgcuuccuuuuuuaauuuuuugucgcagagaugucauuucuuuuaugaaaugaucaagacaauauguuuuuuaaaaauaugccccuaucuguuaguuuuaaauuugguggccuaugaaacccccacucuagaccauaacacaccacugcuucagaccuucugucuaaguguggcugaagcagugggguguuuuuuuuaacaggaaaaggauuugaaucccagcucuagcaaaggcuagcuguguguccuuggccacguuccuuaacuacucggacccucuguuaccucaucuauaaaaugugggucacggagccuaccuugcagagcuguugugagaaauaaaagcgcuauggguuaaaaaaaaaaaaaaaaaaaaaaaagcccaaaugccuaguguacagaaggcacccaacaaggguaguuuucuucuucccucuacuccacacuuggacguacaaacacuggagaccucuuacuccacguaagccagcccuaacaagaaaucagugccauuauuagguucacugcuuuuaugucuguauuugacaugguacuggguucaaacuuguggauuugcuuucauuuuacagauaggcuaaggcccagagaagucaauggacauagccagaagaaguagaaaugcuccgagaauccaaguguuugguuucugaccuaaaaugcuuucucucuaugacucacaccgcugguuccuccucagccaugagaucccaccugacccccaucacaucaggcccccuugaccccugugaaauagaauaccccuaaauuauucuuuauuagaccauucuguuuauuguuuuccaaauuuaaauuaucaucugucccuugugugagacacuaaauuccaugaggaacuuugucauguucacuguuguaucucuagcacccggcauagggccugaaacuuaguagguguucaacaaacauaugcuuaaggaugaaugauuggugaauaagguugucagaagagacuugcccaucaaacuagggaauaauagaagacgguauguaaccaaaugcaaguucugguaggcucucccuuuugcaaggugacuuugucacuucuccccuuaggaggugaaguuuauuucuucauccauagaauccaagcuuagucacgcaauuuguuuggccaaggggauauuagcaaaugugauacaagcagagggugagaaguguuuguuugagcugguucacuggauaaguggcguuggcuugcuaugauuguauggugauugucuucucuuacugaugggaacccauccaccacgugaagaagccuaggcuaggcuaauggugagcaacaacagggggagaggaucuggucauccugccaaggccccagacaugugagugagaccguccuagaccaccuggcccaagccaagucagccaagacaagaagaccuauccagaauuauaaugaauaauaaaugucuauuguuuuaagacauuaagcauuugaguuauuuguuaagcagaagaagcuaacugauacaacagcauagacuauguuccagaaaccucuccaaggugugacgucagguauuucuggacguagcucaauuaccuggauacuucuaauuucucugauuuuggaugaugggaaagugggauuugagugugauuggaaggguggaggaaugaccagacauggcuuaaagcuucuaagccacagagcccugggcagguggacaugaacuucuuuuagcaguguggaaguggagcagcagacccaggcccauagcccagcaaaaccagcgggcuugccacuuuuggcaugagagcuuuggggcaccagcuucugaguuuuagaaguuguaagaagaauaacaucaucaagggccaaaucugguccacugcuuuuguaaacaaaguuuuauugaaacauagccauucccauuuuuguacauauuaucuacagcaccuuucaugcuacagugacagaguugaauaauggcagcaaagaccacauagcccucaaagccuaaaauauuuacuauguggcucuuugcagaagcaauuuggcaaccucuguacuaggguaauccagggaggcuccauggaguaguagggucuuaaugugagccuugaaggaaagaggcaguguuauuuugauagaaaagaauggagaacugcagaaagaacacuacaagaacaguacuaagauuauaauugauguuacaucacugugugcaaaagucauuauaauaacuuaaugauaaaacaaacgauaggcugggagcgguggcucacgccuguaaucccagcauuuugggaggccuaggugggugaaucaccugagguuggaaguuugagaccagccugaccaacauggaguaaccccgucucuacuaaaaauacaaaauuagcugggugugguggcacaugcuuguaaagccuguaaucccagcuacucgggaggcugaggcaggagaauugcuugaacccgggaggcagagguugcagugagccuagaucgcgccacugcacuccagccugggcaacaagagugaaacuccgucucaacaaaaacaaaacaaaacaaaacaauaacuaagcauguaugugccacuuaguacuuaucacuuacuaugugcuagguacuauucuauaugcuuuauacauaguaaaaacauuuuauccucacaacaauaccaugagguagguaauaucacccccauuuuuccagaugagaaaagagagaguugcaccaagcuuauaaguagucuagcuagaauucacaucccagcauucucacucuagacuucacauuccucaaaagcuacaaaaguugaaauguaaaauaugauuaaggccaaaauuuugcauuaaauuuuagcuaugagcaauaagacuguuuuccaaagacauuauuuuauuuuguccuauuauuuuuuuaauauugcuuuauuauuuuauacuguuaaacauucuuggcuaaccacacugcacauuccuuuuguguacucuuuguccccuacacaaaaacugccaucgcucaccuggaaacccccuaaacagggcaucccuacagugugucuagugguuauacugccaugguaaugcugugucaauacagcagccgcugaccauucauucccagagauggaccacacccauuuguuaaauucugaccaccaucguauggcugcagcagaggcugagacugucacccagucccuaggaggauggaaaguucucuuccccaaauaauagucaauuaggucauccugguuaugacaggcagaagccaccguaggcauuacuucuugaagauauaccaggcucuguuugggaguccuacuuuagagcagagguucucagcuuacaguaguaaacuuugauuuccagccaaugguugggccaguuucuaccggucaacaaggggccuauggugcaucugcugguauccuaaaaugauaccacacacagggcccauaguaaauaucaaauuaaauacaggcagaauucaagaagaaaaguugcuucuggauucauuaccuuauuauaucacaagggagauaauagauacuuuccgaaaggauuuacuuuuuacagacuacuagacaauaaucuuuucuacgggguauucuggcaaucugauucgaaagccuuaaaaauauacaaagccagugaucuaaaaauuccacuuauacugauuuauccuaaggaaaauuuuauccuaaggaaauuuucagagauauacuuaaaggccauaauuuaaaguguuauuuauaaucgaaaaaaacuguaagcaccuuaaucaguuaaauaaauuaugacauaaccguaaacuacuauauuaauuguauaaccauaaaagcuaugcaguugcuuaaauuugggucauaaaauauuauuaaagauuaaguuaaaaccaguauacaacacaaaauuccauuuuucugaaacaauaacaauaugcauauacuuacagaaaagcugaguuuuacagggguucccucccaggguagaauaaugguuguuuuaauuuucuauuuuuauacaauaaauucuauacuguauugauaauuuuuuuaaaugacaauaaaauuauauuuaauuuuuuuaaaguuauauuucuuuuucuuuggcuguuguauuuuaccauuaccuccucauguuucucaguucugugaauuuugucacuguauuuucccagcaagcuuaaauguagaccaagucuuucccaaugaccagggagaagagcaauccacccacaauauaaaaauauuaucaaauucaacuggcugccgaacucaccugaccuuauuggguuuauagcucuguuaaaaagauacaccauaauaugacucuguaucacuuaacugagcuuaucaaaguuguuugugccgguauggguuuuguuuuuauugggguuuuuccuaaaaaggagucagaaucccaaacuaagcucagagaacucacugacuaugagcugauuaaagcaguuugugcuauacagaucaugaaacagcuucauaugcagcuccuaguaugugccacagagacacguuggauaaugaugagagcagguacgcugaguuacagcauaccucacucagauuucuggacaugagaugacuuaacauuuuucagaaauaaagaaguaucuuuucauuuacuuuucaaauaaacauuagaaaaucauuuauuuauauauugcacaacaaguggacaaaaugaacuagcuauuccacugaaaccuuuccaaaucucaggauaaauuuaaguagguucagcuagggguuacuaauaauaaagcaauaauugaaugaacaaaugucuuccuuuuuagucagcugccaacugguugcccauauaacuuuccugacuaccaugucagaaucuacuggagaaaagagaauugccauaaaauagcacaauuccagaggcagagagauguuccuaagccuuuaaugaauuucccaaaacuggccuuauuauauucauaaaccauaauacauauguuuauuuaaaugguuugaaaagaagggaaaaacucacaaaauuacuuugaggggcugagugacauuuacgcauuuguacaaucuuuuuuuuuuuuuugagauggagucucacucugucgucaggcuggaguccaguggcgcgaucucggcuuacugcaaccucugccucccggguucaagcaauucuccugccucagccucccaaguagcugggacuacaggcaagcgccaccacacccagcuaauuuuuguacuuuuaguagagaugggguuucaccauuuuggccagaauggucucgaucucuugacuucgugaucugccugccuugaccucccaaagugcugggauuacaggugugagccacugcaccuggccaaauuuguucaaucuuuaagcacccacuauaugccagacuauguaugacaugcugggcaguggagcuaggguccccaaccacuuuguguucauaggcaaucagacaugcaguacaguggucuaauuacaaaaaugacacccauucccccggccccuccauaucuauaucacuuauuacuuugaagcucugcccauuaagaaauugaguggggcugggcgugguggcucacaccuguauucccagcacuuugggaggccaaggugggaggaucacuugagcccaggaauucgaggucagccugggcaacauacgugagacccccaucucuacaaaaaagcuuuuucaaguugacagauucguuuuauuuuauuuaaaagaagaacaaaaguugaguugauguuccuaccuacugagucuaggcugaccuuauaacuugcuuuggccaauaguguggcagaaguaguaaugagaugcuucuuagccuaagccucuggagaccuuaugugcuuuuguucugucuucuggaacccugccucugcgaacaagccagggccagccugaugggaaugagggaucacauggaggagagcugagucuccccagcccacagucagcaccccuagaagcagagccaacuagcuaaccuacaacugcccagagauacaugguggagccuagccaaguccaggugaaccaugcagaugaguuuggcugaaacugcugacccacagaauugcaggcuaaauaaagaauuguugucuuaagccauuuaguuuuaggaugguuuguuauacaacagugccugaccaauauauacaguuaagugcuaacucugcuaagccaaauauaaaaugccauggaguaccuguaacauuauuccaacauguuaacaauuacaaaugaaucaugcaauuuagauguauaaacaacagauguaaacaaccauccagagaggacuuaaagaaguuauauaucuagggaagggcuaguucaaaacagccauaguuccuuugagaaauuuuuuauggaugaguuaguuguauuugccuuugaagucauguuucuuuucuuuccugaaaaaaaagaagaagcucuuucacucaauuaagacuguuggacuugaaaacaauugucuugcuugauucaaagcagccauauacuacucucugacacauguucagccuccaguauuccguaggcaggaauuuuaaauccagcuccccugaauuuaugacacacauacaguagcaagucccuacaggcugaaaaucaaacuguaauucaaaggccacagagcugaggaaaacagccagcagacaaaucccaguuucaaccuugaauucccugcaaguugauucaguggacugucagucauauucaaaaauaagauaaaacuacagacaccagacggcauguucuaaagagaaaaagaacgaugcuuuucaagauucuuccaaccaguucuuuguuuuuuguuuguuugguuuuugagacaaagucucgcuguuguccagguuggagugcaguggugugaucuuggcuggcugcaaccgcugcuucccaguuucaagugauucucgugucucagccuccugaguagcugggacuagauguaccagccacucacgccuggcuaauuuuuguauuuuuaguagagaugagguuuugccauguuggucaggcgggccucaaacuccuaaccucaagugauugcgcaccuuggccucccaaagugcugggauuacaggcgugagccaucacaccuggccuagccaguucuuauuaucuaaaaggaauuauuauguggggguaauuuaagggccuuagaaccuuugacccucaucagucauuugcagaaguuucugaauuuuaaaccaaagauauauaaggaaguaauaaaaaccacugaauauaacugaauucaccacacuuaugggaggugauguuacacauccagcccauuuuuggaacuggguaggucaccuccauaaaguacauggagaaugagaguucaucaggcacagaagugugaauacucaccuuacaucccucacaggcgcugaccccauagugguacccugaugauuuguccuggcagacgaagcaggguuuguacacucgagggggaggaaguggagauggggggcuugggacgaguuccucagagcuggugcucuguguuucaauugcuauaauagagaugggguagagggagaaaaaagagaaaauguauuuuaguucauuacuuuuuucaacagugaauucauaugcuucugccccaaauucagcaauaacacuagcaagaaugggcucauaaaaacagcugucauuguaggcccagcaguggugacacugacauugaugugguacucuacgguuuacaaagcagucucauacaucucucacuugcaguccacagcucacacagaacugugagggccaugguuuuuaucacaauuuuagccacaacagaaacagaaacucaaaggaaggaagugacuugucuaacuaagaccagcagagcagugguagagccaagacacaaauucagauagucauacuacaaaccccaguagcuucugauucauguagaaucucaaacgacuugaccuuguugcucacuuaaccaaaaguaaauuuucuuuguagcucacaccuguaauccuagcacuuugggaggcugaggcagggggaucaccugaggucaggaguuugagaccagccuggccagcauggugaaaccccaucucuacuaaaaauacaaaaauuagcaaggugugguggugugcgccuguaaucccagcuacucaggaggcugaggcaggagaaucgcuugaacccaggaggcagagguugcagugagcugaaaucguacgacugaacuccagccugggcaacagagcaagacuccgucucaaaaauaaauaaauaaauaaauaaauaaauaaauaaaaauuuuaaaauuuuccuuuggacaaaugaagaaaaugcccaaauuauucauucaacaaguguacugggagggucuuuagcaugaugcagccauaacugaucuucauuaauaacaauauggguaagauccuugcuacucaaagaaggcuccuugggccaacaugcaucggcaucacuuaagaucuuauuagaaaaauaguaucaggucccagcucaggccuguggaaucugaaucugcauuuugaugaaauccccagaugacuaaauguacaauuaacauuugagaagcaguagguuaaaacuaaugaugacacagaguggugcgauucacuuuuaagucauguuacucuuuauucuagauuaaaaaaauaauaauccuccauccuguuaucuaaccacccaaauuccaugggaaaugggaguucacaaaauauaagaacgggguguucuccuaccccuaauucuccaggauuguacucagaaucaaagcaagaacuggcuguacuucuaucacagguaaauaugcucauaaaauaagauggaaaucgggaaggagaauuaaaagugguuaaauaauguuccagaaucuucuagucuccaaauugcuuuuuaauacacaguguauuucccagaauauaaaguuuccaguugcccuacugcuuauaaucucccagaguagauauucuccugacuggauuauccugcaggcaagcuuuuagcaagucaggucaacucuacccacuaaacuuauuguuaauccauccccacaucacuauccugcuaccacaccaugcuaauaauccaccaucgccucucacaacugcugcaauagcuucuucauuggucacuucaugccccuucuuccuaccuagugucuauucuucaaacaagcagucaagauaguuguucaaauguuaaaauccaucuguuucacucgccuaucuaaagcccuccaauagucaccaauuagaucaaagucaaacuccuuaguauguucuacaagacuuuucaucacacggcauuuuagcagcaucauuuccuucagugaguccccuaauuuauugaguucuauauaauuggcaucuauucugucuucugaauaggccaagcucucauaccaacugaggcuauugugauaacuauuuguccuuucuagauauucucagaccuucaaauaucugguuguuuuucguuucuuagaucacaaagcaaaugcuaccuucccagagaugauuucucucauuaaaaugccccucuccauuccuggucacucugucucacuauuuuauuuccauaaaacccuaaccaguguucaaauuuuagauguuuguauauaauuuuauauucuacaucugccauccccuauacucuaaauauugaguuucauaagggaaagaaacucaccugcauuguauacaucuguguuccaggacuaguagagguccuggcacauggcagauaaucaauaaauauuuguugaauuagcacaugaacuuuuuccuuuuccuuuuucuuccucauuuugagcacuaagagucccucuaaguuguuaaaugauaaaauuagaaaccaaauagcucuuauacuccuuugcuuccuuaaaaaaguaauuaauuagcccuuuggaacagaaucaacuauaauuauaguauuuucauaauucagaagaaucuuggaaugaauucauuugaguaguacagguccuaguagauaaaucuauuauagucuuuacugguuagaaccaagguaucugggaugaagauaucaaucuugaguacauuauuucuggcagauaggaagcccuugcuuugaauaaguuggcacaguggcagcaacuguuuuauagaagggcugguaucugagaugucacuaaagcuuaucagcuaucaagcaguagaugcaaaagcauucuucacacggaacuaaucagcuucacugaaagcgaauuaacaagaaaacacugcuuguuaaaauuagaaaacaauguaucacugucuauuaaaaaucuaaggaaaaauacacacagaaucacucacccacaaucuuuucacucagagaaauucacuguguacgaccuuccagaauuuuuuucuaugcacauaaauguuuuggguuugucuacuaagguggaauuauacugacacugcugaggacuuuguuuaaccuaugaugucaucaauuuauuuccuugucgauaaauauuuuucacagaaaacauuccauugugaugaacaacuuuguagcuaaucucaccacaucuuuauuuccuucaaauacauuacugaaguguaauuaucaguucaaagguuguuauuuuaaaaauauuuuguuuuuaaugcauguugauaaacugacuucuagaaagguuguguagauuuacacucccugauaucaacguaagugaccccuuccccagaugccucucaaaccuuuuggagugguuugauuugugugcuucuacuuccauccaugugcuucaacaacugacagagucaugucaucaccacuaugaucaaucucgcauugaguucuucacagaaggaagguggggagcgguguguuuuaagguccuacucguucguguagaacagcuaaucuggccugucuaggaaaguuguaaauagaauucugguagggcuggaaucagcugucagagcuaugcccugaauuucaaaaguggguaguaauuuccauaaauaugccacuucaaacacaugcacugaagggaguccagcauuucaccuucccaaagaaaggaaacaaaauugugcauaauuuaauacccaagaaacuuggggcaaagcacacaaaaaacgggaagucuacuggacauuaaagaucccaaagcauuuuacaaagauuggaucuuuuccuauggauaagagucauuuauaacaaaugaaugaauccagaaggcuuuuccugaacaguugccaugaacgaaaauguucuauuguaaguaaucaauagugagagcccuggccuuuuauuuaggugguggugauuucaccaauaauucuaggaacuuucucaugugaguacaauagauucucagacuguucauguguucaaucauuuguuuggcugagugacauaacaugccaggcauuguguuauacgcuaugggcaaugauaguacauaaucccuuauccuugacaaauuuggccuaauagagaauaaaccaacaaugauaauacaguggguuccaaacuuggcugcacacuagaaccagcuggggagcuuuuuaacguccuaaugaccaaguuguaucccagaucuauuaugccagaaugucugagaauggagcuaggaauugccauuuuaaaaaaaauucccuuuuggcugacuguaagauuuaaaacagaaaaacaaaacaaaaaauaaaaauaauaaaaaguauucccaggcgaauccaaacugaaguaguuugggaaccacuaauauaaugucagagugaacuauaggccuuauuuaucccaggagaaaucaagggagccuuccaagaggaagugacugggcuauguuuuuaaaugauaaauugguucuuucuacuguuuuuauaauuugaauccugcaaaugccauaaaugaacauaauuugaaugcuacaaaugccacaaaaacagaaagggaaaaacguuauguacgauccccaaaaaaaaucaucuuuggaaaaauuuucccacugguaguaaaaaauuaaguauuugacucucucucucucucucucucucucucucucucucuauauauauauauauauauauauucaaauaucacccucagaauugauggucaguggucuuuuauuuccucuauguggccuauaacacugagaacaaugcaaggcaaaaaaaaaaaaaaaaaaaaaaaaaucagugguauagucugucagaucaccaaagcuagccucaggcgaacaugccaagacaaauucuagaauuacaaccaggaaaccaggauauggcaucaauauaaaagauuuguacuuuaaugcaaucucuugccuuuuugguaagguagcaaaaacauacuuuggcaaaguuuaucagagguccuuuucuuuuuuugccuuccuccaccccccaagaaagucagugggaaauaagcagggggacagcccauggcuuuccuuuuaccagucauuuuugguauuuaaggcagauacagagugcucagccauugaucuguucacugucauccugcuuaaaucaauaaucuauuagucccuuuaaauuagaguuagauucaucaaaugcccuugagaggccucaaacauuuuguuccuuauugcaggcaagcacaaucagucuauggaaugauaaaauuuuugcuugaaaacucugccggcucagcagacaauguguucuguauuagcucauucagcgaucucaggcaggccaaaaaagcaguuuuuagacuucccagggggaaaagaggcuugugucauucaauaaaacaacuacacugcagccauccugaugugauuucaguuuggagaagcagucuuagaggaauaauucggaucugcuuuuugucuccugcuuuuauuuauuuccuugccuacuuauggacuuacucaguucuguuugcugcuugaaugcccaacaagcagcagccuccaauguggcauccaaacugcuaaccagaugggcuucccugcuucgucagggaaugggcaagucagaggaacuucugcuacucgggugagauggaugcuuggcucuguggguccccgcccagagcacagucagcaccagugaugcugagagggcugcucugaacugcgcacaugaguggagacagugagccucagggaagaugagaaugaaccaaaucugcagcauuguccucggaagcugcuagccccuauuuuagacaucuccacccccacaacauacagauaacuaucacuaaggaaaacaaagcuagaauccccuuccuuguacaauaaauuagucaugggacucauugcuuuuaaaucaauguuccucaaaguguggccugcagcaggggaauucuugagguuagggagaaggacauuugcuuuaaauucgugcuuuucagacuaucaauggugaagcaccauuucuuagucuuucccccaaucccucauggauugaucaaauucaauacaaaugaaucuccaggaaauaggaguuaaggaaaaacaacgacguccaaagcacaagcuccaacucuuuaaaaaaaauuagauuuaauggacauaaaauuacccugucaaauugcuccaaaaguuuugaaacacuugcucucaaugucugaacuucucuccuugcggacgggcacaggucuccggauugcauuuugagaaacaguccucuaaaaggacuucaaacucagagguuguuugcagacaaaacaaaaacaaagcuaaacaaaaucuccaccgacugggaugguacaaaagcagaauucccgaguucccacugacgaagcuuucuuaaacacugccacagcucuuggguugauucauucccaaaagaaaagaaauuaacauugcugccuguuaagaggacuuggcacuuacgaauuuaacucaccugagaaaacacaguauaaauguccuuguuguuacaacacaccugagugucauuuaaacacacagaaagucuucgacaauagcucccuucacaauuccuuacaugcuuggcauuuuucuaaagguuagauuaaguagcagauaacauuuuuaagagagcucaguauacuuuuuuuuuuuucuuugugagagcuaauuuacggcuggcuaaaacgauguugacagauuucaggauuuuagguugggccugauuacaggcaggcaggcaucaugcauuaggaaagccuagccuuuuuacuagaaccuucugugauuaagacaguauuuuaaugcacucucugggcagcugagcuuuaaaagaaaaaggaguuauaaagcaaaagacauuuccugcauggccccaggggaauuuugagcccagagcuccgaaucccaguggaagggaguaauuucagcuaauuaaggaagaagagcaaaguugcguuuggucaaaauguucguuuggacuucauuuguguuggcaccaaagagagccuaucuggauuuuuuucucccuuuuucuguggauucacugcaggacugcaaagccuacagcucacauacauuagggagagauucaaaggaaacgccaaaguucaacuaaaguacaaguaauuagaaccagauucuccgcuauuugcgugugcgcaugcguguaugaacucguguguagacauuuuaguaaaauguaauuuauaugcauccaaacauuuggggcacgggaagacuccauacugucacucacuuaauuuuuaugucgccuuuucaggagaggaucugcuuuuaaucaucuuucaggagaaacgguuuccacacacauggguuuugcaaaucugugaaucgcauccugaauuagguaauugccaaacaagaaaaacucugcuuugaaaucuugccuuacucugcugcuggcuuuguuauuauuaagcagcuccaagauuagucccggguuugggguggcuagagagggaggacgauggggagugaaggaaaauaucauuguugggcuuuggcagucuugacucaguaaccugcccgugacccuaaagaaguguguguuugccggggucaccagggauccuggccgagggcuggagcuggguugugagaaacucugcuauucugaccacauaugaaacaggugcugaacauaggcaggagacaaaaggaagggcugggggaaagaauuugguuuugagucuuuaauaaagccuugcucagcaaagugugguccuggacaagcagcaucagcaucaccuggaaacuuguuaaaaugcagaaucuuggccgggcacaguggcucaugccuguaaucccagcacuuaauccaaggugggaagaucaccugaggucgggaguucaagaccagccugaccaacauggagaaaccccaucucuacuaaaaauacaaaauuagcuaggcgugaugaugcaugccuguaaucccagcuacucgggaggcugaggcaggagaaucgcuugaacccgggaggcggagguugcagugagccgagaucgugccauugcaccccagccugcacagcaagagcgaaacugucucaaaaaaaaaaaaaaaaaaaaaaagcagaaucuuggccccaccccagaaaugcagaaucagaauaggcauccuaacaagaccccuugaucauuuuuacgcacauugaugucugagacacccuaacauaaaaaaugucuuguuauuguccuaaccuuccuguaaucccauuuugcugaguuaauuuagcaucagaacucugucaacuugcccuuugcacagguccuuacuaaauacuccaccuuguuaaguacuuaaugcauuaagaucuucaggcuguguguguuuaugcuuaccauaaaccagaagucuucguucacucucacagaacuuuggcaguggcuuuuaguuggcaguguguucaaaguuguaccagaagagccugaacuaauaguaauuacuauuuacugagcgccuacuguguuagggaccaugcaaagugcuuaauagacauuaguucauuuacuccuucccccauaccaugaggagagggagaacugagcaccuuagaauuaggaaauuuaaaacacaacaauccuuucagacuuuauaaaugagauguaaaugacuuaauauguuuacuauuaucucaccaaaccccccccgcuuuuuaaauucucauuuuccaucucccugauuuguuuccuagucugggaaggucacaggguuugcucuggucaggccuacuuacucaaauuugagaagugcagaacuuuguaauucucuugcuuuuaacucacgguuauaacuuuccaaacacugauuccauucaagauaugguuaaauuugacaagauaguuugggccuuagaaagagaguaagacucaggacccacuaaucacucuguguuguagcuacaccugucugggcuuacggccagcaauagaaguuauuccugggacuggcuuuuaccacgggaagugcugucauauuuucauaagguaccaugacacguucaacaccaacauuucauuuugauaauauguguucucaccacaaggaauauauucaaaaauaucucauagguuguuuugcaugacauuuuaaacacguuuucuaucacuauuuucuaggacauacuaagauagcuuaugccaguguucaaauaaauccucucuuacagucacuuaacaggccgacacaucuaacugcuuauuaaugaucugaacguggaggcaucagaaaugaaacugcauuaagugaacaaaugcuagaacaggucucgggagucauguguagacgaagcuaauugcuuugcaauauugagguccccugaagaguuuuucucaacaucaacucacucaguuccauauuucacuucuaucuucuaucgggauucccauaauauuuacaaaaggaacuaucacacuaauaaaugacauuauuuuaucugaucgaauuuccugcacacagaguagauuaaaacaggagcauuaacauguauaucauuucagauacacacauucacauucauuucagauauccacacacacauucguugcuuauguacuauauaucuauuugaaaaccacauuaguaccagucugacagaaaaccaaaagggaaauacuuggaagacaacaaugaaauuaugcuuugucacauaccuugccacucgucuaagaucuaaggaaguucaaguaugauugauuacacuagaauuuagccaaaacccucuuuuucucaauaaaauaaugcuuggcuuacucagaauuuugcugcaaagaaauuuuucuguuuuguuucuuacagguaugcaccauaugaacagccucaaaauaacuuugaaaccgauuuaauccucacuguguggguuuucuugguuccuaaaaagaaagaaaaugccaugagccugcauaaaauuguguggaggaggugacgggaaagugguaagcuuugcugccagguggaccugaauuugaaucucucuucugccacuuacaaauggccauagaguuuuauuucucugagcccuaguccuucuuugcugaaaaugcagauaauccugauuucuguugguaaaccagagacaacguuugcaauuugccugacacacaguaagugcucaauaaaugauagccaaccuucaccuccacuuuuccccuccucccacaaacacauuucccuuccaccuuccuuaaucuagggcaggguuuuuuuuguuuuuuuucugagauggaguuuugcucuuguugcccaaccuggcaugggcagccaugccauggcacgaucucagcucacugcaaccuccgccucccgggaucaagagauucuccugccucagccucccaaguaguuggaauuaauaaaugugcgccaccacgcccggcuauuuuuuuguauuuuuaguggaaaccggguuucaccauguuagccaggcucgucucgaacuccugaccucaggugauccuccuccuuggccucccaaagugcugagauuacaggcgugagccaccgcacccggccggguagggguuuuuagccagcaccauuuugucucucacgggacauucugcaacaucaggagacauuucuggcugucacaauugggggcugcuccuggcaucuaguagguagaggccagggaugcuacaaaacaucucacaaugcccaggacaggccccuccuacacaacaaagaauuaucuggccccaauuauagauagugcugagguugaaaaacacugaucuaggcugaggauacuacugguggggagacucugggaccaaagaguggggacaacaaagaaaauacuacagcucuggagaaauggaaacugcagaguccuacaaugcagaugguaugagcucaguuccuaauucugccucuuacuagcagucacuuauccuuccugauccucagaaaaauugagaugacaaccacgcuuacuacauugcaggauuuacacuuuguaaacuauaaaaaguauaaaaacauguaaaaauaauagcuaaugcuuuauuauuagaaauuuauuaauuauuauuuauuaucuggggaaaaguggauuaaguccguaucaauaaugcgacuaauauggucaccacagaaaacaacagaaccaucuccagagucuagucaaacauuucaacaauaguaaucacuaacacucauggagcauauacuguaggcuagucaugcuccuucacucuacucuaagcauuuuucaucuauuaguacaucugauccccagagugacccaauaagagagcuagucuuggccaggcgcaguggcuuaagccuguaaucccagcacuugggagguuguggcggguggaucacuugaggacagaaguuugagaccagccuggccaacguagugaaaccccaucucuacuaaaaauacacacaaaaaaaauuugugguggcgugcgccuguaaucucaguuacucgggaggcuggggcaggagaauugcuugaacccaggagguggagguugcagugagccgagaucgcaccauugcacucuagccugggcaacacagcaggacuccgucuaaaaaaaaaaaaaagagagagagaaagagauugcuagucuaguuuuacuauuucuuuuugacaggcaagaagaaaccagagguauaaugugguuagguaacuuguucaaggccauacagcugcuaaauaaaaagcauggauuugaacuuaaauggucuuaaguucaagggaaugggucugacccccauguugagagaagacuaugacauccccucuuaggacugugcagaacuccugucacaagcagcugucccuggcaggaaguuuuagaguaugcaggguacgucuaagucagacagacagacacacaguuaacccagcauaaagaacaaaaguaaaacuggaaaauucaaaagaaagaaguuaaggagacagaaauaaugcccuguuuucuuuccagucagagcaauaaaauaggaaagucccccagaagcaaacacaggaauuagaaggcacacacaaacacacucacuaaccccuucugcauguucccugcugagaacccagcccucagcagggagaauggcagcagcuaagaccaagauuccaaaggccucuggcggcaguccaacggcguguggcugaacacugucaggagcagucacucaggccaaauggagucugcacaaccaccagcuccagggcucuucggggaggcagaggaggagaggacucugagcccccagccccuacgcagguucuccuucccucaccugaaggccacauauacucccuuaaccaaaauuuauuuggcacaagaaugaacccaauauccagaauugguugugcaauagcuuuucugucacugucuacagaacuagcacgccccaaaugaggggcugaaugacucuuuucccaagaugucuggggauugcggggguggaggggggugagaggaguaacuugaaguagacacugaacauccuuacugugcccucuacuuggcuaauacauaaugcaucaguucaaaggaugcacuugauauuucauuugaaaagauucucggccgggcacgguggcucacgccuauaaucucagcaguuugggaggccaagacaggcggaucaccugagacugggaguuugagaccagccugaccaacaugaagaaacccuaucucuacuaacaauacaaaauuagcugggugugguggugcaugccugcaaucccagcuacucgggaggcugaggcaggagaauugcuugaaccugggaggcagagauuguggugagccgagaucauaccacugcacuccagccugggcaacaagagugaaacucugucucaaaaaacaaaaagaaagaaaagauucucaaguuucuauauagaacuguucaaacuacaggaaugcuacauuguugguuauuuuuuuuccuucagagcagugauuccuagguaugagaaagcuaagaguuucaaagugcuuuagcauuauuucuuuuuuaaaaauguuaagaaaaucuugaaaaaauaauucaaagacauuuucaccaaccuuccaauugagagcagucccccaagguucaggucuuuuuuugauauucccgaaacuuguccaccuuuauaggcaaguugucugaggcauaugguuggaaguaugaacucgggagucggccuuccuggauucaaauccucacucuccuacuuacuggcugugugacuuuuggaaaguuacuuaaccucucugagccucaauuucugcuuguauaaaaugauaguauauucuucauugcaucauugugagcauuaaauaacaucauuuuaaaguacuuugcacaaugccugccacauaauaguguuacacaagcaauuauuaucauuauuguaucaugcuuaugcugaugaaucucaaugcuauucaccuucccuucuuuccccaucuugauuuggugaccuucacuuccauuuucccucucaaaauaauuuucccuucugauguaccuaagagauucucuaaaaacuaaugugaggaaagcaagucaugucaguuuucccucucucagcuguccuuuccuucccaggcccacaggcauuaaucagaagugcucucauuccucguaggauuuccuggccaauccccaauccaggcugccuagcccccucagaaauggcuucuuuaaaccccucuuuaccacagcgaucucucauuggagagccuucaauugcuguucaaaacccaaagucccaaaucauugcaaggaccaaggugguuuggggagcagaaggcagugauuaucagucagcaacaucaacugcugacaaacauuuauugagcaccugccagggaccagaccccuugauacaugcugguuuauaaagaaguuagaauacacuaucuccugcccacgcaaacagacaacugaaaaaugccacaaggcaaacauggccccagcuagaaaaaggaucugaugggggucagaggcugucaugaguggguguguuacuagcauacacaaagauuuuggcggccuugacuuuaaauacucagggcuaaaagaguguccaguacauaucaaaaguucaaucaguguugguuaaaaaaaaaaagaauuaaaaaaaugaaaucugcauacaaauccuuacaugugaugugaaauaaauacuuucagccaguucagcagaaucugccaacagcacacuuuauauggcgggggacaacuugagggguguuuucacacacauuaccccauuugcugccuccuaacaaaagugugaagagcaaggauuauuaacacgaucaguuuuuuuuuuucuuuuuuuaaaucucuguuauucaccugaggaaacugaagcuuagagaaguuaaaugacuuggccaaggucacacaguuaggaaaugaacugaaagugaguucauccccugaauccacacgcaagauuaguauaaaugagaaaccaaguacacauuuauauuccuaacaguccuauucauuuuuuaauuuuuuuuuuuuuuuuuuuuuuuuuuuuugagacggagucuggcucugucacccaggcuggaguggaguggugcaaucucggcucacugccagcuccgccucccggguucacgcuauucuccugccucagccucccaaguagcugggacuacaggcgccugccaccacgcccggcuaauuuuuuguauuuuuaguagagaugggguuucaccguguucgccaggauggucucaaucuccugaccucuugaucugcccgccucggccucccaaagugcugggauuacaggcgugagccacugcgcccggcccauuuuuuaauguuuuaaggcagggucugcaaauuuuguaaauggucagauaggaaauacuuuaggcuuugugggcugucuggucucugucacagucauucaacucugccccccaugggggaaggcagucacagacaaaauguaaauguauaggugugacacauuccaagaaagcuuuauuuacaaaauccagauuugguguaguuuucagcccagcuuuaagauaaaggaaauaaaaacuauuccuccuaacagugacuguacauguuacuauaaaauucaugcauuuccucacuuccaggguaaagacagaggaugacagccauaugucacagagacguggguaauauuuuaaagauacuaacacuacaguguguuguaagggcuacacauuuucuucaaaaccucauguauacauuuuuauuaguuagggaggucaauauguccgccauaaauacauuuuaaaauuccuucccacauauucugucuauugggauuauuuaucaugcuuuguucccuggcguagagccagggagaauaugggaguuuuaauaccuuuaauccauuacauggauuuuuuuagagcuccauaagacaaaaugaaaugcacucucauggucauauaugcaauaaaccugguaugucacuuaauauuucaugucccauuuaauauuucaguuguaacuguucccagcuuucaacguccaaaaugacacaauuccagccaucuuuucgcuccaauugcuuuuuuguucuuguuuagagaacuccugacaauuuauaaauaauaacucucacuguggacuuugagaggcaauuauuauugcucucugauauuccuuauuauuuuuuuuugagaaggagucucacccugucacccaggcuggagugcaguggcgcgaccucggcucacugcaaccccugccuccugggcucaagcaauucuccugcuucagccucucgaguagcugggacuacaggcgugcccccaccaugccagguuaauuuuuuguauuuucaguauagacaggguuucaccauguuggccaggcuggucuugaacuccugaccucaagugauccaccugucucggccuuccuaagugcugggauuacaggcgugagcuaugcguccggacugcucuuugauauucugaagaaguaugaaauaacugucuacugacauaugccacccaguuuacggcaacguggugaacuggucaugcuuauuuuaauuaggccauguuaaccuuguuuugaaaaggagguguuuggcugggcgggguggcacaugccuguaauccuagcacuuugggaggcugaggcgggcagauugccugagcucaggaguucaagagcagccugggcaacacagugaaauuccgucucuacuaaaauacaaaaaauuagccagguguggucaugugugcuuguaaucccagcuacucaggaggcugagacaggagaaucacuugaacccgggaggcggagguugcacugaccugagaucguaccaccacacuccagccugggcgacagagcaagauucugucuccaaaaaaaaagaaaaaagaaaagagguguucauucauuucuccagcuaacugauaugguaacacuggucucuaaagauggucugcucaauacaccucaccuccuguaaugcaaugggucucuuuuucucaaauugcuuguaaaacugacucacacaucuaccggagcccaaaugugaauaccaccugccuaucacuugcacauacccucuuuuauuuugagaugcagauguuugcuuauagugcuguuguauuuuuacuuguuccuacaggagauacauugaaucuuccugcccguacuggacacugcaguucaaaauaauagcaaaagaccugcagguaauaggccauaauacucacuugauacccacuaaaggaggguuuagaucacuuguucucuguuaccuuucaugaaacaucuguuucauaugagccacuuggaaguguauacaucuguaaauaauaagccugauguguacauaauuuaaugaauuaggacauaaaaaggaauugaacaguaggggcacagcaauuagaagaacugcccauuuuguuaaaaacguauuauuuccagcuuucacuuguuaacccuuuuauuauucuguggguucugaggcuucuaaucuuccccaucccucuucccugcaaacaaaauagaaauuuauaucguuggcaaagaaaaggaacccuacauuauacaaagcugaguugggaacuuuggacucacuuucuccuacucgggagauucaagguagguauuugaaccucucagugccuaggaaucugcgucugcaaaguggggauaacagggccuuucucuucaggcugcucugaggacuagaugacaugguucauuuuaagcaccugacacauaauaagcacuuaauaaauauuaauuaugauagugauuguuuuacuuuaauaaaaaucaaucgcaacuuuaaaucauggggguggggaagcaaaccgugguucaaaaguuucucuugagaguuguuuuagcgauuuauuuauuuuauuauuauuauuauuacuuuuugagacagagucuagcucuguugucuaggcuggagugcaguggugcuaucucggcucacuguaaccucugccucccggguucaagugauucuccugucucagccucccgaguagcugggauuacaggcacccaucaccacgcccagcuaauuuuuguauuuuaguagaaauaggguuucaccauguuggccaggcuggucuugaacuccugagcucaggugaucugcccaccuuagacucccaaagugcugggauuacaggcaugagccaccgcaaccgguccuuuagcuuuaucauuuuuuuuuuuuuauauauauuuuagauggacugucugucugucgcccaggcuagagaacgauggugcaaucuuggcucacugcaaccuccgccucccggguuuuaagcgauucuccugccucagccuccugaguagcugagauuaccggcgcgcuuuagcuuuauuuuuauuuacuuucuucacaccauuucuagggauaggccaaaaaaaaagggguggugggggggacaagggggagcaauaauguccuggcuaacaggaaguaccaucagaaaaucuauuucugugaccucaaaguaagugccaguagcccagggaaauauuccacucucauguuuucaggccaguuugccagcaaaugcacuuauaagggcuuacuuacuuugccaucccagccaaacugaaccucccaaguuuuugacagcccccaucaaguuuacuagagguguuuugaauaaccaaaaaauauuagcucacuugagauguucucaauuucguuuucacugaacuacacucagcauauuucugagcaccuacugugugccgcacucuggguuaugagcagaggacacacguaagcaggaggaggcacccgggggagagcucaugguauuucccagaaggcaaacugaggcuuccauagaauauggccaguuccucucugccucccugaaguuuguugaaauguucaagcugaguugaaagcuugaaaauguugggagauacucugcccaucucaaaaccaagcagguguggagcacgggaauagacaucguaugucuccaugauuugauugcuacagggaauguaauucccgcccacugagauucugcaaaaaucuugguuuagcugugcaaacuaaauguuagcaaaacaagugcuaaauacuugccaggccccaggaaaaauaguuccacccagaaggaaaaggaguuaaacaaugacugaaaucaccacccuacagcauucuguuuacauuuuccugcagucuguuuaccugcuacauaaagggauaauuagagcuuguuaauagccauaggagagaagaguaaaggcugaagggaaaaaggaaauaaagaaaaugaacaaauacugaaagaauaauaauagcugaaguauguagaagugaauuguuuaauacaguagccacuagccauguguggcuauugaaaguuaaauuaauuaaaauaaaauaaaauuggccaggugugguggcucacgccuguaaucccagcacuauggaagaucgaggcggguggaucaugaggucaggaguucgagaccagccugaccaauaugaugaaaccccgucucuacuaaaaacacaaaaauuagcugggcgugguagcgcgcuccuguaaucccagcuacucaggaggcugaagcaggagaauggcuugaacacgggaggcggagguugcagugagccgagauagcaccacugcacuccagccuaggcaacagagugagacuccgucucaaaaauaaauaaauaaauaaauaaauaaauaaauaaaaauaaaauaaaauuaaaaagucacuuccucagcuguauuaaccgcauuucaaauuccaacagccauaaauggcuagcgacuaugauauuagacaauguagaauuauagauccuuuccaucauuggaaacuucauuguaggaaguucuauugaagggcacugauaucgaguauauuaaaggguuguuuauuagaacauacauguggguucaaccauaguuuacugaggaucauagaccaaguacuauauuagcacugggaaaacagagguaaaaagcacaauaccugaacucaaagacucucaguuuagugagaagacccagucaacaaaacaaaacaaacauaugcaaaaggagaaaagggugagaacacagaaaagaaaccugguaauuuuaaugguagcuauggcaguagguauccagguguuugcaguaaagcuguuguaacuuuucugcauuaaaaaaaauucauaaaauaucggggaauuggauuugcaguuggggcucucugacgccagcgccaccucuaguucgccgagcucugggcgaaggagaagggggaaaguaaggagguguccauaccacgguuccuacaaagcacacuacucgaaaauccaacccguggaaaagcauccgggaagaaacuggccacaaaagccauucacgagagugcgcccucuacuggcgggguggagaaaccucauuguuacaggccugggacugggguacuccgugaaauuaggcuuuauacgaaguccagugaacugauucgcaaacuucccuuccaauauguggugcaagaaauugcucaggacuuuaaaacagaucugagcuuccagagcgcagcuacuggugcuuugcaggagccaagugaggccuaucugguuggccuuuuugagggcacuaaccuguguguuauccauaucaaacguuuaacaauuaugccagaagacaucagcacacugcauacguagagaacgugcuuaggaguccacuaugaugggaaacauuucauucccacccacccccccgaaaaaaaauuucuucuuccuguuauugguaguucugaauauuagguauuuuuuucuaaugcagucaaaagguaccuagguauaugauugcaaguggaaaaauagaggacagaaauuagguauuggcaguuuuuccaucuucauuugcgugugaauuuuuaauauaaauguggggauguaaagcauuaaugcaaaucaaaauguuucagugaacaagguucaguaguucaacuuuauaauaauuauaaauaaaucuguuaaauuuuucuggacaaugcuagcauuuggauuuuuuuuuaauuuuuuauuuuugggggggacggugucuuacucugucauccagacuggagugcaguggcgcgaucucggcucacugcaaccuccgccuccccgguucaagcgauucuccugccucagccuccugagcagcugggacuacaggcgcgggcaccaccacgcccagcuaauuguuguauuuuuaguagagacgggguuucaccacauugaccagucuggucucgaauuccugaccuugugauccaccugccucggccucccaaagugcugggauuacaggugugagccaccaugccuggccuggauuuuuuuuuuaaauaaauuucuuuuuuuuuuuuuauuuuuuagacaggaucucccucuguugccuaggcuggaaugcaguggugcaaucccggcucacugcagccucaacauucccaggcuccgauuauccucccacccuagccucccgaguagcuaggacuacaggugcgugccaccacggccacauaauucuuuuuguagagacaggguucugccguguugccuaggcuggucucaagugccuaggcucaagugaucugccugccucgggccuccugaagugcuagaauuuccgguaugagucgccaugcaagccuaaaacaaguuucuuauugacaacuauguauauauguaaaaacaaucuauuuacugagcaucaugugucaaauacauugucuuauuuaaggcuuuaagacugaucuuaggcuuucaagggagguguuauggauucauuuuaaagauuagaaaaaaaccaaaacaaaaccuggagcucaagcuuccacagcagguacagugcacgaagaaugucuacccaaccucacuguaucacacugcaggguaccaugcuguauuucacugcaucacauguuagcgucuuacagauuuagaucugcuuccacuuagaacccacuacacgacuucuagcaagucacuucaauuuguccaccugucucuuuuuccucaaaauauauaauucagcaacaauuagauuucaaacaaaagaaacagguagaauacgguauaugaaaauucaaaauacagaauacauuccauuuaagacauauuugagcgggacacaguggcucacaccuguaauuccagcacuuugacacgccaaggcaagcagauugcuugagcccaggaguuuaagaccagccugggcaacaugguaaaacccucucucuccaaaaaccuagccaggugugaugacacacaccuguagucucagcuacaugggaggcugaggcgggaggauugcuucagcccagcagguugaggcugcagugagcugagaucauaccacugcacuccagccugggcaacagagcgagacccugucucaaaaaaauaaaaaauaagacauguuugaagucacugaaaugagagcauuaucugagaggccaauuagaugcacuaugauucauguaaguuucacuaaaugguaaugguuaacuuagguuugggauccucugcacacaauagauacuuaaaauaccuagcaaauaaacauuaauucgacuuuacuaucagaaaguuuucuuucuuccucuuugucuuuuacuuuuuugcuuuugguaguggaagacaaaauagcuccacuuaaugaagagacacucucuagcacaaacacuuagcacccaucuuuagauaaggguuaccaguaaacuagaguaacaugaaaagcccaguuucccaucucucaucuucuugugacucuucaguaaauaccagacuaauccuggucugaacccccugagcuacagcagugacuaggccagcguagacuucaacagcaaacaggauguaaaaacaaaagggcaaaagaguaaaauagccucauaguuugggcagaguuuccuccacaauguaaaagacugguuuauaguagagaaaauaauguaaucagaggaagcuaugcgaguuacaguucuuuaccucucuuuuuccuaccuuuccccuuaaccaaaacacucgaugguguuuuauucuugggauuauuagggcaugaaacauuuuucaggaauucuucacucagcugacaggaugacaacuccugaagcugaggacccccaagugaguaacagcacauggagccuagagaaaagccuuucaugggacuugaaaccacacucugccccuuacaauccguguuauucaccuucccugagccuccauuuccucaucuguaaaaugaagaugacaucucacuuauaggguugugaggauuaacugaaaaugauguauguugucauuagaguagcauuucauuaaacauggaaccaaccaaaaaacuaaaagccccacaacuguucuuuaauuuaaucauuuucagaagacaauacuuucuuucuuguuauagugcauauacgcuacgauuguuaugguggacauucuuugccuuucucucccaaacugaaagguaguuauugaaucugggcuggcccugugucugcuucaccagcagaauauagugaaagcgacuguauaccacucucugggucuagguuuuaagaggacugggagccucugcugccuccuuccuggaagguucacucucgaaacacucucucucggaauacugcugccaugcugugacaugcacaagucacaugcagauccccuagagcucucaccgacaaccaacauccaccaccagccaugagagugagacuuuuuggauugccagcccaauuuagccauggaugauucagccccagcugacagcaugcggagcagagggucugcccagcggagcccagcccauccacagaauaaugucauaauaaauuguuagaccaggaaguuuugggaugguuuguuacacaggaauaagucacagaaaucauagagaaauaagugauuuuuaaaaauccaauagaaucaaacccauccccaaggaacaugauuacuuaacacgcuccagaaacauccacaugaaagucuucaagaagcuaguuuggaaggugugcacuuauuccacuguguaagauagguuuagaacuccuuugugaacuacuuuuagagaugaucuaugaggccugcacacagaaaaacuucacgcccgcuccacugugacaaaaauguauaauccacuugaucacccaccauauaaaccagcugugguucuuggcaguucuuaguucuuuccauuaucaaucuuagguucaaagacauggggagauuuuuggguuuguuauaaggggguuaugugacaacgacuugugucacaaguucuucccauuauaucaugaguucagagggagaagggacagugucugauucaucuuggugucccccacagaucauaucaaggagccuggcacauggcagacacccaagagccauuugcugaauggcacguugcaaaaacuaauccaucaaugagcaauaaaaauguacugugccacgacagcaucuuugggcuaaguguauugugacaacuuugaaggugacaaugcucacuuguaaaagucaaucauuugcaagaaaucuggggaucugguaaauggaugccccugaaucagggcacagugcuaccugacaaacagaaaggacugccaccuagguuaugagcuauagaccgagggaucauuucaccaaagaaaagagauaccuaauuuagauaugaccaaaaaaaaaaaaaaaaaguuugcuuuuagcaaaggcacguaagccacaggugucaugccaaaaucagggcagaaggccuaccuggugacuuccauauguuuucaagacaagaauagaaucuuaauuuacaugaucucuaauccuucuacagauccugcaauguagacacuauuauucccauuucauagcuguagaaaccgauccugugucaaggcaggcuacuugcauuaucuuggaccaucaggccaugauggggaagcagagguggagagaugcauggaaggguaauucugagaggaccagggagaagcagcaguaaaacucuuggaaagggagaacuuuucacagcuucugcugagugcaagaaaauuauuauacccccuucucuagaaagccuuugagguacaggugauaggauaagcucuggaagaguauucacaacuucugccugaacuauaagcccaacauggguuucuggaaacucuugcccgagaagcagagagaugccuuguucaucugcaucccccaacuuucccugcaaauccaaaccuguucauccuaccucuaguuuguauuguuuccccugauaaggagggccccagugaacaauuaaagcuuucaauaaauaaucucuaagcacauucauuugauugacuguuauuugauacagcaguuaguuucaauggggcaguuaauauugaucacauaaaguacuccagacaaacaugaaacaguuccagaacuccauggauuauuacccuuuaucugccagucaucuggguuacuuguaauggucacggaauuuaaaaucaauaauaacaauuaguguucuguacaccaaaacggaugaaucaugugaaauggguuuucauauaaaaucaaagguaaagcaagccgauagcauggaaaaaaagcucucugaauuuccagugcacauuuggcaaggcacuuucacaugcaaauccucaaaacaggcagcaagagcgaaagaaaggugcucaggagaagauguggccauaaaaaagcauaugaaaccccugacgaucuuaauccaaaaagaugaagcguaaaagauaaaagugaucaaaaugaguucuaacaaauguaguaaaauuaauggaaccgguaauuuacuuccuuggagaugugucuagcuacauuuuucagcuuucaauuucuaggcauuaaucgugauuuuuuuuguaauaaaauggcaacaacgguauuuuaguagcuccauggcacgacuacuguaauauaauguauauauaauuaaaaugcaaagcaacagagaaauguuucaucauuaaacuguaaccagugcacuaugugaaaucauccauuccaaagacuuguuuuucaucaauuauuuguuguuuaucugauguaaauauaaaaaggacuaauuaaaauauaugccuuuuuauacagcuucuugucauuaaagccaaugaaagcauucugaggaccauaaugaaauaauuauguuugccuuuaagaauucucuucaauaacacauggcaguacugagcuaaauuaaaacaucaggaacugaauuucgcugccuccauuuccauuuuaguuaauuaaacccccaagcuuuccaauagaccagccccuaaaaaaaucuuuugaagcugaaauggccuucagaucaucggccuuuuuauaauuauggacuuugaugacaugacaaagguacuguagccguugaaagcuuuaauauuuuugagaagacaaauuuauuacaugaggucuucauuugcucuggaaaugggaaaaaaauugggaugugauccagaucuucucucccuaguuaaccgaugcacucaucuuauuuguucuuuuaccugcacauuauuuugaauuuagcuauuuuuuugacuugacaaaauuuuauucugugaugaauaguaauuuaucaacaacaacauagcaaacauuccacuaaauaugggucaaauuaggacagugauucuuugucaaacacugaaacuuaaaaaauaagaagcuaucuuuaagacagcaguggacugaggagaaucugugaauuuuaagaaauaaaauccuucuguuugacuuuucuccuccuccaaaucucaaaucagauacuuuggaaggcaaagaauaaaauaaaaugaaaauaaaucuggguuuaagagaaagggaagaaggaaaaaggggaggaaaacugcuaagugguuucagggcugguagcaaaugaaauggcuuuagcaauguugucaucugaugcagauggggaugggaacuuuguacuuucaaaaguaaauacaaggccgggcucgguggcucacgccuguaaucucagcacuuugggaggccgaggugggcagaucacgaggucaggagaucgagaccauccuggccaacauagugaaaccccaucucuacuaaaaauacaaaaauuagccaggugugguggcacacgccuguagucccagcuacucaggaggcugaggcaggagaaucacuugaaucugggagguggagguugcagugagcugagaucacaccacugcacuccagccugggcaacagggcgagacuccaucucaaaaaaaaaaaaagaaaaaaaaaaaaaaaaggaguaccaaggauuaacucugacaacgugaaaucccucacguuuuguucuauauggagaguuggcgagguuugugaguggaugauauuuggugaucgcuggauagacugucuaaugagacaucagcagugaauuguuaacagcuggaacacaaauaucuauucuaugacaauguaaaaugacaauuauaaucucagaauccacuuuuauuaaacgacuuucuuccucccaguuuuucuuuguucucuucaaagaaaucugcuuuuggaaaucagggacaucaucacccacuaucaccccuguaaaaaucagcuuucuucuuucucccuccccugagcugguucaguucuucagcugcugggggaagccuagagacuccuggaaucccugagcccugacuagaggaaaugcuuggccagguugagucgccuugcugacgucaguuccuguuauccucgccuuaucgcgcagggggcagagagucuuaucuuacuaaaugguccccuuguagcucccccacccuacagggccagagaaagagcaagucagcaguuccauugccuguuugacuucccaucuaagaagcucugaaagcucaagacaaaaugccaguagacuuaggcucuccugcuuccuagguagagagaacuuuugcaacuuuauuuuucauucauuuaaagggguuuggggagugggaugggacagagaucaugcuuuuuaaugaugggguaaggaagcugggaaugaaaagaggagaauucagagcaacauauugacugaugagguuguguuauuagaucuuacagauggggcagguuaucucaucuccuauuuaacaagagguacuuagaccaagccacuuacaagcaggauacugauaaaucugaaaccugaguuaacucuacucuucucccuccaucaccccagcuccaacuuuuuaagaggaagcuggcaagggcugauacagauuuguucauaacaauuuaauuuaauucuacucccuccuccccacccuguccacgcacacacaggugcuagagugagaaucacagcccaguccauuuugcaaggaaugccuucuauucacagaucuauaguuugcuacgaaaggaauucauguucauaagaaugacccagaaacacaaggcgaucuucagacauaaugaaaaaauuaagcugugagagcucuacuuauauugacuauagaauccaaacaaagacuuucugugccacuccuaggagauguuguaauauuaaauaucuggcauauuucaaugauuuaugugggaacugugcaggauauuugaaaguggguuauucuagaaaaucagagauacaugauugucauaacuacccuguaauuugaaaggcaagauucuaucuacauuaauaucuuuggaaagguuuucagccaagauuuuucugauuaaccuucaucaaaaacucccauuucugaaauaaucuauuuaauugauaguuaacugaauuuauauuagaacauuuaaaguauaaaaaugucauuuaaggauaaauguauggcacuuacacauaacucaaacuguauagaagauucuaagauguucuaaaaugaacauugcauuuauuguuaaaauccugugugacuugaacagaguuuuguauuuugcaucuugguuuuuacaucuccaucuucugcccaaagaguaacuuaaaauucucagcuuuuucuaaauuacugauuuaaaaaauuauaaauuccuugagaguagaauuuauaaucuuuguuauuuaucauguauuucccuucucagauagaguuuaaugauaucuguggaauguguaaaggagaaaacagguuuucuuucuuuuucagccaccucagagcuuaacauaugucgaagguaaauuauaaacaucugauauccagaagaacuuuuuuuuauucuuacgcuuuagagaaaagugcauaacaauacccucgguuguauauaucagcgccaggcuucuagaaaugagaaggaaacuucugauucaggucagcuagccuaucagaaauagccauucuggucauuuaucuauuaaggaaaaaagaccugcuucaaugcaagggcuuuacauuauuggcuggcaaaucaaauucuaacuaaagcuuccaagucaauuccauagcuuaaguuuaggcaaacagaugucuaccuuucuacuguuuaguuuuuugaauccauccuuuucuggcaauaaaauuuaaacacaugcuuuuucuuuucuaaguugcacaucaauacucacucccuugucaaauguaccaauuuauccaauauucacaauaugauuucuuuuuuucuacaaggaaggaaaacuuugugaaucuuucacuuguuuucgaacaacccacaacccugccuguacucucuuugcgauuuaaggaaaagucccucuuuuucucuucuuucugaugguauuaguuaccaccgucaugugcccgagaagcagaaaauuauguccuacuuuagaaaaacaauugggccuuuucacugaaauauuuauucaaaaccccauucaauucauacgguggcugucagucuuuauuuagucuuucuuucagaggguaucuuugauuuugccacuuugaccccaauuuauaucucacuaggagaggauuuagauacuguuuaauacuuaaaauuugggucccagggcuuugaaaagaggccuuuucucauucccuaaucaaacaucacuacugguuguuuuaaaaauaauuucuucucauuaaugggcaaaguccuauuucaaaaagaaaauauuuuuuucuuuuuccuuuugauguguugaguagggagaaaagacagggaaaaaggccaagaaguugucacacucguuauuucaccaaagcaacuauauuuagaccacaaaauauuaagauuuauccuauacccacugagcaauuaauguugaaaacaucuggagccgccuaaaaccaagauaauccuggagacaucugaacagaaauuuagugacuccuauaccuuccaggggcagucgucaaucguaauauuuagaccacauucccuuaguaguccccuaauccugacuuugaaugcuuauaagaagcaauucacagacacuacuacaaauggcagcuggcuggcauaucauuuuucugccuuuaaaauuaaaaagaaaauaaagggaauauuuuaacaccuuucaaagugagcuugugauggugugcuccauguucaaaggucuuacuuuauuuacuaugcauacacacacacaccauaaaaaaaacucaaagcagaaaauaguuuugguuggaauuuaguacuuuuucuucuuugcccacuguuuccucuguguuaaaagcaaaaacagaucugcuucucgucaaaauagccauuaaguaaaauggaaaagguugugguuauguucuuacuuacacaaauguagcccuaauauacuuuuauuucaauagcccuaacuagcuguaccacccugaaccaaacacugcauggcacaagacauuuguuagaaucucuaaaaaaaaaaaaaaaaaaaaguuuuaguuuuauuuaugcuaaaaaaaaaaaaaaaucguuggaacaacugaccaucauaaagugguuuaugaggguaaagcaacucugcaagggcacaagcaauauuuacauuuuauucauuuaaccuaaaguuggggugugggauucaaacucuugugaaacugaccacaauaagaacuaauugcccugcuuacaaaaauaagacacuggaauuucugaaaucccuuugucaaaugccuuuauuuacuuugucuaaugcaaguuucuuugauuagcuaaacuuugcuguuaucaacacuucuugcuuaucggguaguuuuaggcgaaugacacauucaccgcucgcucucccuagauaaagcaaaucccuuguuuaacuuguccaagaacaaacaaagcuuuucccccuacucuuacaacuuaauaggcaucuuuggaagguuaauuacaaaaggaagaaugucuacauguaaaaacucuauuaggucuaauaacuuuuggcgaggauccugagcauauuuuuuccuucuguuaaaaaacauguuucauuaccacuuucucuaacaagaaaaaguuucagagagccccaguucccugggauuccaacagaaauuguucauacuguuuuaauugcuacaaagaggacaggucugaaaagucucuucuuggauuagaaaauuauuuuguaacacuccaguuucuuugaguucuccagaaauaaaaugggcaccaaaaaagaaaaggcauuuggggagcagcugaagauuaaggcgccuucugaaaacgauauucuuuuugcccugcuuauggcucuacaaaauguuaagucagacagccaggcuguuggcaucaaaugguuauugauuuuucagcuacaaaccuguugauuucccggcccaagaagcaagucuuuauucuuaagaaaaaguuucagagagggcaauuuaaauccugucauuguccccucuccccuuuuucuucucucuuuagauaagccaccauguuauuaggaaaacucaauuucuuccaguuaaacuuugaccucuuugaaaacaaagauuuaaaaugucauuuucaggcuaaugcuccaaugaauugucaaauaaaguacuaaaaacauuuugauagauagcugagccauuuaucuaaaucacugucagggcggcgaagcauccugcaggcucccacuacagccacccgaaggugggauuuucugggacuccugaucauuucucaagccugcagccaggcuacuguugaccaggugcguaccucggcacugugucagcaucagauaacaaaauagucaauauuuuuuuuuuaaauugggcuaccccacuuauauuuccuuuccuuuaacugauguccacguuccgggcugaacugcaagauauggaaauaauggauggcucaguccaagggguguucauugccaguaguuuucuagcaaaacagcaacuucuuagaccaacaaagugacuuggaaagguggcagcagggucaaugcuaagaaauauugccuuuccuuagcaaggaaaacauuggaagcggcagcuugaacuggugguuuaugaacuucgggagcagcagccaccuuaauuaaacuaaauuccuuucaaggaaaaugucauauuuuaauuacuuuggacuguuggaauacacaagggguggggggaccuauacaacuaguagcuaauccaaagaacagcaaaguuaaauuccacucugcauacauuuuaguaaaaacugcaaaaugugucaaauugcccuacuugaagaauguuuuaaagucuuguggucacccucuacuccccaccccccacauuuuuaugcauauuuuaaaaacuguuuucaagagacuauaagguugguaaggagaggagcaugggggcgggagggguuauuugggaagaaaacaucuaacaggaaauuuucagcaaagggaaucaauaugcaugccagcauaucacaccccuucagcauuaaaucauuaaauccuuugucuugcuaccaaugcaguuuauuuccaacgucuuuauugcaugcaagagagacaauuuuuuuuuucuugguagaagaagggaaaaaaauaaaccuacauugagcagugugccgaugcugccauucgguuugggucaauccacugaagcaugcuuugagagcuuucuccuggagcaugcaggaagacggacucgcaguguagaaauccaggauuugcccaggacucacugacagaacauccauacagucaaacaugaucucccuugcacugaaugucugcaaaagugcuuauccucuagguguggaggcaaauggcauagaaaaguccacccaacuccaucaaacucugccccuuuuuuggcacguaggcuguuggucuuuuucccagccccgaaucaugaauuaugacagacaagccagcuaaaagccuguaauugauccaaaugaucauuua

SEQ ID NO: 21509 - RNA, 19968 nt, Homo sapiens
cagcgucuggaagcagacguuucggcuacagacccagagaggaggagcuggagaucaggaggcgugagccgccaagaguuugcagaaucuguggugugaaugaacugggggcaccugggcgcacagaucgccccccuucccccgccccgggccacaguugaguagugguacauuuuuuucacccucuugugaagaauuucuuuuuauuauuauuugucguaaggucuuuugcacaaucacgcccacauuugggguuggaaagcccuaauuaccgccgucgcugauggacguuggaaacggagcgccucuccguggaacaguugccugcgcgcccucgccggaccggcggcucccuaguugcgccccgaccaggcccugcccuugcugccggcucgcgcgcguccgcgcccccuccauuccugggcgcaucccagcucugccccaacucgggaguccaggcccgggcgccagugcccgcuucagcuccgguucacugcgcccgccggacgcgcgccggaggacuccgcagcccugcuccugaccguccccccaggcuuaacccggucgcuccgcucggauuccucggcugcgcucgcucggguggcgacuuccuccccgcgcccccucccccucgccaugaagguagguguucagugcgcugccacuuuuuuucuuuacuuccccccacccccuguuggaaguuaacugaguucccuucgccucuuccuaucccuccauuuccccaaccgccugaagaagcuggaacuccagcgucgcuggcaggaaccccuaccccuucgcccuccacgccgggcgcacugccucagugucccaggagaucacuucuggucgcaccacccguucugcaaacaauuuugauuuuugagaaaaaguggggaagagcgauaguagacaaacugagugcgguucacugacgacuuuccuuuugcucugagaacaucgaguguaauuuacuauguauauuucaguaacaggauaaugauucaauucaacaaauauuuaccaagcgcccacugcgcgggcaccgggacgguguguggccggggcucgggauggggaaagggacuccuugguugagagaacccgcagaggaacuaggggccaacuacuccagagcggcguacaccuuccccgacacccccccgcaccgacggaggccagauuguaggcuugccuuggccgaguaacucgagcgcuucaggccccuuugccuuuaagagugccuggcggggggccagcgcgcaccccggcgcggggagcggggucgcguuauuagcauuauuagccgccacugggugagcucaggcacuuugcagcaguggugggggcggggaguuguggugguaguggcuguaaucccguacuccgggacagcgcuccccggcccccugagcggaguccgccuuguccuuuagaaaacacuugggccuccgcuuugggagagcaggcgggggccaguuugcgaacucuuguuuguuuuaauugucaguuguauguuaaagccgaaucacacacuccgagggucacugagaguucacuuuuacgaaaaguuaacguuucuuccugcaacauaaguuuuuauuuucuaaacaauuuuucuuaucuguccuccaagcuucgauuccuauuuccauuuuucuggucuuucccauuuuaaguuucuuagaaaauaagguuagaauugaaauuaagauguuuccuggaagcaaauaaccccucuuccccccaaaaaguuaaaaaaaacaacaacaaaaaacuucaagucuggagaccccacggcccuguuugacuuucuaaucccugucugguaucgaggccccuucuccucucucgccucucuuuucucucuucucucuuuaaauggguaauucgcuguuuggaaguaacuugggccuugcggugaggucgcaccuccucagccccugcccuccccccagccaccuucgcacauucacugccgaaccagccagauuuaguuucuagacagacucugccaggggaguuucgagggggcaaugcggagagugcgcagcgaaccgcgggccgacaaauguguguguguccgaguguguggauccuuggcugcgugugugugcguguguguuuguguguguaggggaguuguucucggguccaggacguaguagccuucgucuccuccaccccccgacccucucaacggaagacccuccccaggaggcccggcccaagaguccccugucuucuccuccccucccccgugcgcuccggugcucaagggguuagcacuaugcgcgcagaacucggagccauccccgcggccuuuucuuccccgcggugcggugccggcugcccccuguuggccgccuugagguaggacuccugcgagccucgguuccuuggggcgggcgggcgggcagcugcuccccucucccucccaccccugcucccuucaucccucccgaccaccagaccccacucucccagcaggggcccucggaggcccccagaggaccaguuucgcugcgccgccggccgcugcaauacggaaggggccacggguccagcccagcaaaugggacucggccagcuggacacaggguugguaccucuucuucugggcuugggaaggagagugucgcccuaggaggccucgggucuggccucagcugccucccaacucucuaugaucgagaacaaguguugcuuucccgcuuuucgccucacuuuaaucgucuauuaaaaagugggagagaaacuaccuuuaaagaguggggguuggacuaucauuucauuuucuuccucuguccaaggacucugcuccaccucuggacaaaguugauccucugccgagagggcuagacauccuaugugagaaggugugagugguguguguguguguguguguguguguguguguguguguguguguguguauccuggggccuggaaagcccagucuaagggauggacgagggggcaggaaacagaggagaaccaggccagaccguucuuccccuggggccucucuauacccgaaccuggaaccugcugucaguguugaggccugggcggcucucuuuugucauacugauucuggcucaagguguaaccuccgccuucucuaucuggcaauucccuccuccccuaccccgcuccgcgcgcgccaacacacauauugcuguggacacaacccuugcgcccaggcgugaggcuuagggaguaguggcuccuuugucugcuccccuaaagcggaccuccuacccgccugggccggcccauucuuuagcuccucgcgccgcuccccgcauucuccagggcaggacgucccaaguuuuuggcugcaacugagugcucuccugcuaguuucugcaucucucuccuugcuuuagggagagaucagaguggggaaaacagcuuucuuuuuccaccaagaguggagauucuuuuuggaguuucccauccuccccuucgcugccauaagccugggucaaaugggcuucuuccgccuauuuggcgucccucaucguuucacucccagaaacuuggggccuaaacguagagagucuagcagaaggggaugccuagacugaauguggcagugccccggggccgaggggagaggaucuuugcuuggccuuuuuaucuauucucuuaagggacugccugcggaggaggaguuggguguugcgagacuuuaggugugcauccggcugcuccccgcgcccuccgaacguccucugaacaauuuugcuacugagguuuccucucccucaucccucaucacgccuggcccgcaccgugguugguaaagaaggaucaagaacaccuuuaauccgacgcgaaggcuuugagggauacauagaaagggagccacgucguugagcugcucuggauugaagaggaggacgcgggaacgcccuccuccaccucacuccucuggugcgcugagccccucaaacgcccccaguccuccuccccguggcacgcgaggaagauucucaguguccuuacagagucaucuucccugagccccgaaaguguuggaaaacauuuagccccuucuuugggaaacucaguuucugaucagaauuuuuguuuuaccccugggguugacagucuccccagaggucucauuucauacugucuuuucggaucugaucucuugguaaacaggcggggauguuuuacccuacagagccgauguaugugugaguucgcugugaguucuuugagugucucaaacuuguggggccuuuucucgguugcacugggauugaagagggaagagggccaagguguuuccgggcaagcggcgggguuaaguggagaugcgacucgugaggcucuccuuuccgaucccccuuugggacacccucugccuaccucuacccuggagccagggagacccaagucuuggugaccggaugggcccgcucucaguuggccugggcucugggaacugguggacucucccugggggcuucgggcugggaguggguucgguuuguguggcuucggcucuaacaaagagauccgcuguaauccgccgaaucuguuaucaauuucucugcugcuugagccccgccccacgcgccccgcucgccgcgaagcuuggaaagugcacgcggccagcaccaaucugggccgcugacucggaaacaugucgcagcgugugugucuaugcacgcgugugaguguguaaaugugcacgagugugaauguguaugaugugugugcacgcggcaucggcugcccuuggggagaguugacuuugcagccugggcugcgcgagaagcagacuuugcagcccacucccuccccuggaggaaauuugacacuuagggcggggguggggagauagccggagccuucucucuccuagcuggggaaaccccagauuuccauucuccaggaugcgccccccagcuuugcagcguuuuggggacaacugggccuuggguguggagcccugcuuagcaggcgcuggggaccacauaagcauuuccucuuugagaagccccgaagcguccaggccaaaggggcggcucacggagaaaaaccuuggcacgccccugagccccauagcuuuaccagggcugccuagguccccucugccccuuuuacggcacagguuccaagccaggcucuuccaccgccuuaaagaggcucaccuuucuuuucuuuucuguggaaggggcuccuucaggggcuaugggcgaugcagugcggcaggguuagacuuacguguaaggggauuuuuaaaacccgcuccucccacccgcacccgccaccuacucgcuccgccgccgccuacagguggagaagucaccaguggggaggaacggcagcggaagcuuccaaggccaacuccuaccccugaaauucuucaggaagggaaccuucgccgcugggggccucuuugcccuggaaucgaugcgcccagcugcggcucggaagccagcgccucuggccccgucuggacucaucugcaagggcucuggccucgccccgcacccccaccuuucggcacugaccgaaccaagucugaguugggcuggagaggcuagacuggaggcaggguggcagaguuccaacgacaggcucgcagugccgcgauggcaaaguggcccacaaccccagaucaggaccaagggaaacuggagucucucugggccucccaucuccucccucccuggcagcugccagguguggggugggagggagagugaaaaaucagaauuugggagaaagcuguggggagggcagggaagggaucuucuccccggggaagcgagacccagacucccuucuuuccucuaggguuccaucccuucucucaguccguggaagaggccacaggcgacgcgggcgaggguggcacucuuuuccaguuuccuugguugggagacccgaccucucucuccauuauccccuagggcccccaucuccuucuccccucccuagucuggcugaagaacguccuuaaggaaauccgggcugcucuuccccaucuggaaguggcuuuccccacaucggcucguaaacugauuaugaaacauacgauguuaauucggagcugcauuucccagcugggcacucucgcgcgcugguccccggggccucgccccccacccccugcccuucccucccgcguccugcccccauccuccaccccccgcgcuggccaccccgccuccuuggcagccucuggcggcagcgcgcuccacucgccuccgugcuccucucgcccauggaauuaauucuggcuccacuuguugcucggcccagguuggggagaggacggaggguggccgcagcggguuccugagugaauuacccaggagggacugagcacagcaccaacuagaggggggccagggggugcgggacucgagcgagcaggaaggaggcagcgccuggcaccagggcuuugacucaacagaauugagacacguuuguaaucgcuggcgugccccgcgcacaggaucccagcgaaaucagauuuccuggugagguugcguggguggauuaauuuggaaaaagaaacugccuauaucuugccaucaaaaaacucacggaggagaagcgcagucaaucaacaguaaacuuaagagaccccggaugcuuccguuguuuaaacuuguaugcuugaaaauuaucugagaggcaauaaacaucugcuccuuucuucccucuccagaaguccauuggaauauuaagcccaggaguugcuuuggggauggcuggaagugcaaugucuuccaaguucuuccuaguggcuuuggccauauuuuucuccuucgcccagguuguaauugaagccaauucuuggugguaaguucauucuaugugcguguucuuccucuucuuuuucuuuuuuuaagauuuguuuguaugaugcggcaauauuuaaugcuggauagugaguguggguguauuuauugcaagacauauguauacauuuuacuuauauauaguuuuaaaucagaauuuucuuuuaacuuguuaauauuguaaagcuuaucuucagcuccuagggaaugggaaacuauaaaucuaggccuguuucuaugaagcccuuguucagacgugugcuuguaguacaucaugcaauaaaaaagaacagaaauucacuuugcuaguaauuguaagccuaucuacaaaauuuacuuuuugccaccucuagguaguaaaagugaguuucagccuuuaucuucuguuacucgagauuauuauuaaccuacagaguuugaauuaggcagaguucuaggaggacagcuacacuccaagugcagaaguauuggggcuugaaauguaaucaaaaggagguuaacuugaaguagucaaauguccccaaguggggguuucuuucuggguaggggccuuguagauagacuguaauauauccagaggauuauuuuugacggcauucuggguauuuuuuucccuguaaaugaacagcauuuuucugacugucaaacaugacuucuguucacuggguacccugucuugggucccucacaaucacauaaggagcccuuuuaaaaugucaagaaacauggugaauuuucuccagucuguauacuugucccucuguucuuccaucagucaaaaggaacugcuaucuccuacccguaucuaauugugucuacuuucagcauucauaaguuuucaaggcagauugguccaauuuguggggcaaagugggucacuuucucuaaugucagaggccugucccucaaacugcuguuuccuccuuuucugaguggauuuuggaaauacugguucagguauauggugacaggggcuaggaagggagugaaaauacuaacugaggagccagauggcaggauggggacugcacaauaccuccguuuucugagugcaguuuaaacagaggaguuuuaugaagcccuucucauacuuugucaugaggacaagcaggagagaaaaaagcaucugugugcuuaaaacuauguauugcugacaugcuuucagggggcccaccucgagauuucacguaaaucuugaaugcacaucucccccccuugcaggucgcuagguaugaauaacccuguucagaugucagaaguauauauuauaggagcacagccucucugcagccaacuggcaggacuuucucaaggacagaagaaacugugccacuuguaucaggaccacaugcaguacaucggagaaggcgcgaagacaggcaucaaagaaugccaguaucaauuccgacaucgaagguggaacugcagcacuguggauaacaccucuguuuuuggcagggugaugcagauagguaggaaaacauuuaaaauauuuuuuuaaaacauuaacuuuuuuuccuagaagaaauccuuagcauuuacuucaugcuugauagaaagcaugaaggaggaugccuuccagcucgggugguggcuugggcauuuuugucauuauagcaaaugauguuaauuccugucccuacaccugaugauaaguuuuggauuuuaaucaaaucaggaggcaaguaucacagacaccuucauuuuugcaaacacuuaauuuuucuauaaagcauuuuguuuaaaauagaagcagaacacuuauuuugguuucuuaagaguaggugggggaagcaagucauguauaugcuuuuaaacgucgaaacucucuugccuguuaguuuuuuaagccacaauugaaacggcccgagcaucgaacuaaaaguugccgucuuuuagaauccuggauauauugaaagugaacaaaguuuuaauuuuccuaauagaacuauuuccugaggcuauaaagauauagacguuaaaagcuuuauuuuuagucccagaaagaauuuuaauuaaaagugauccaauuuauguuugugaugucagcaauugauauaauaaaagcacaugcuugggaugucaaccuaggaacuugaaaaaaaaauuaagaguauugcucacaguccgauucuucauuuuaaauacguuguugaaugucuuacuuccccauucaaagagauagcauuucaaaugggcuaaaggcaaagauuuuaaaaaaucuguuuguuugccucugcuuuuguuuaaauaguauaggauacuauuugacagaugugguccaauguauguuuucuagugugaauauuuuagguuucucuacuuuuaugcaaaaaagcccuuauaauuaauaugacugcagugacucccaaaguaagaagcaauuuaucaaggcaauuaacugucuauacugacugaagagaaaaguuggcuuaauguccaucacagauggauaaaaugcauuuuuuauuaaaaaaaaaaccccgaaaauuacauucauugagaacaaaaaagaguugucaggggauguuugagccaagugguuuuauaaacuaaaauaauacaagacuggaagcuguuccucugacugaaugggagaauggccuguagccucagccugcaaaguuucauggggcuuuguccuuucuguuaaugauuaaaaugugcuaauguauauacugggaucugaaucuaagaguuaagcuucaggaacacaggaguuuucccugacugugggcugucuuauguaguuaacugggagugugguagauuuauucucccguguguugauauuguaagggaacuuaaauacuuuugaaaaauucuaugaggaugguaacuuuucccccuucuucuauguuccuccuaaacugccuuccucucaaccuaugggacuacuuuuucacauguauaugaguuagcaaaaaucauacaccucugaugguaaccaggaaggaaaacagcaaucggaacuguuuaucuguguagucacuugaacacagcuuugauuuaagauccuccucucguuuucauacguagccuguuuugggccaaaauguucagaauaagcuaucauuugcuaagugaauuugaguucugcuggagauuuauuuuaaaugcgguccaagauucaaagagccugcuuccucagggaacaagcagaacccuugguacaaaagccuguauuuaauugucccuggaaaguaugcucucuggucuucagcugcacggcacuacugucugggucgaugggaaguggaugggagugguaccucuccacacccucugagacagcccuccuagauacuaucaucaagucagcugauguccugggaagaugagagcacauauggcauccuccccugcaaaaggucccccaagugccuagcgucucagagcugaaagcugcugcuggguggcuuguggugggacacugauggggccuucuguuuuuuacuuaauuaaaaaagagacaggagagaagagaaaacaauagauuuuuaugaaagaggaacauggauccaauuccaauaguuggaaaauuucuuugcuuucacuuuuccacuuaagaguguauuugaagagaaugagcuaagggaaaauuuaaaauaccuuugaugccaaaaggugugugugugugugcccaccccaaagcccucagcacaccaaggacauugagaauaauucuucuuugugagaauuugacccugugauggggccagugucugagaaauucaggccgccaccucugacccccuccucaacucauuuuucuaagaugccaguugccuuggaggcaccaugcacaauuacuucaugaagggcccacucuucauuuuggagaguuucucauuuuucaucaugcuacccuuuccuuccagcuuuuguccccaucugucucuucuuuguuuccaugcugugaaaagauauguaaggaaggcaccauuuguaaggggugugaggaucggaguagauguggguuucacaggaagggaaaccuaacugaaucagcaguauuccaaccaggaugacuguauccucaggcaauuagccaaagaauacuuuucaaacugacguuuacccugcagugaccaauuagcuuagagggaucucccagguuuguauucugcggcauaaaaggaaaugcucaagauagacuuaugaaaaaagaagcauuguuuguguuuuguauaaagccuucuuaugcucuguauacucaaaggacagugucuuauuuuccucuauccccagaggaucauuucaucuccucuucaucuccucuuccucuagcuacuuuguucuacaaaucccccauccagggccacagcauuuucuguacuaucaaauuacucccuagaagcuguauauuguccucauuccuuuccauuccccugaugugcucugccucucuaaucccgcuagauagguguaacgcaucacaggaacuuucuagauccuccugccaaccaccagcacacaccuucaagucauucauuuugaaaauaugggagggggaggauauaugguaaaucagaaccaucaccauucacaaauggcugugacuggcauggagcagaagaccaagaaugagguggccugcuggaugcuuaaacuggcaucgcuguccuccugcagaaugacccuucucguucagacugaguccuguugucagcuuuucuugugcuccucacuucccccucagaaaaaagauuguuagcaagcucucaaaguaaguauaggauaaacugauugcgguacaugaauuucagcaccagaagaggccccuuuccuugcauguauuucaguacccuuauuuugcaauugaggaaagugagccugccccccaaucccaccccuaccccacgcuucagcuggcuggaugauaacccuuucucucucagauuacaguacuuuuauuaacuagcucuuguuacaugcagaaaugucuccauguacaagcgaaguuuaggguacucuaugauagccuccaguuuucuccuuacaaauagggucccuguaacuauuauauggggagauauucuuuacuaguuuugggaagaagaaaacuucucccucccucuuuuccccauagguugugcuuuuuuccuucuugcugucauucuaacacuuuguggcaaaggcagugggggagugggcagggggugucugcagaaguggcauugaagaacaacaggcuguuuuaaaagcagacacucauucuugaaugagaaguaucaggccaaugagccugggauuuaagaauagcaagcuucauuuauaacucucuaugagcugauuuagaauuguccucugggaaaguaaagagacuuguccugagaaauacuuucugcugcaugaaggaagagggaggagagguuacaacugccagaggaggaggggacacaaggccaaaaugaguguggcagaaacuaguguggccgcuggcagugucucccuuagauucaaggccuagcaaauucuguaauccugccuuauauguaacucaaaugaaaauaauacuuaauauuaaaauaaguguaaggaagucuacccauauucugaguguuccuucaaugacuucuuucaugugcauuuuugcaaauagcaaguuuugacuauuuucaaaagaguugcagagaaaaucaauccagcacugcuuagaaucuggccugcagcucugaaauggcugagcagagauacuggggaucugcuacuccuuuguuaauuguugcuucuguguguuuugggggaucuugcuuggcuuccccucaagcugggcccagggccuggugcguguuaaggauggggcagcccgagcuuuuaccuuauugauccccuacccccuacccccccaucuccuacucccuacccucuaccccaaccuccccccagcccuaccugccccccaccuucuaccuccccacuauucuugcuuccccaccuccuacuuccccccaaccuccaaccucccccaccuccuaccuccccccucccuaccucgccccaaccccaccuccuaccuccccuccaucucuaccuugccccccaccuccuaccuccccaccauucccuaccuugcccccacccccacccccggcagcaucccggcccagcgcgugaggcaggcggccagugaucccuuguccucacccacaggcagccgcgagacggccuucacauacgcggugagcgcagcagggguggugaacgccaugagccgggcgugccgcgagggcgagcuguccaccugcggcugcagccgcgccgcgcgccccaaggaccugccgcgggacuggcucuggggcggcugcggcgacaacaucgacuauggcuaccgcuuugccaaggaguucguggacgcccgcgagcgggagcgcauccacgccaagggcuccuacgagagugcucgcauccucaugaaccugcacaacaacgaggccggccgcagggugagugccgcgucucgcccccgccccgcaucucugucuucucaccuugcccuccagccuccucgggucucucccuguagcuccguccucuccucugccacuccuuugcuauaugguccugucucuaucucucugcuucucuuucugucucucccuaucuuucucugucuuuccugucucuuuccuccucauccuguucccgucucacuuucuuucucccucuucccuuccuuuccuccuucccggucucucucuucucccccuuugucuaccucucuuuccuccaucugucuccauaguugccccugcacaucccagaagggccuccugggcggaucauccucccuuucgcccccagccaaggugaaccagcaguugccugaaaaagaccuuuccuugccuucuuaguuagucccugguaccuuuggcuacuggagcacagaaauaaaaaugggaauaacuuucucccuccugccuggacgaugucugugguuggcuuucaguuugggacagggauuuuucugucuucguaggugcccagaugggaaagcccucaccccagcuuugaggcucuuucccuccuuucuuucucccugccucucuuuaugucauuagguagcaggccugauggauggaggguuuuuuuaaaaaagggcuuuucuaggaaaaggacagcauuuuuagcagugugggauuuuauaggucugaccaucaggccaaucacaaaguagcucuggagagaagagagcagcagaaguacccagggaggaccaucuuugcaguccucacgagucuccugguucccgcucuuuccuuccccugguggggauaugaaaagcuacuucucaauaguuaaaaagacccuuuuuuuccugcgguuaaacacauggcacuuuauggcugcuuuaaaaugaaggggugaaaacuuuucuuaacuuuggcagcauugaaaaccagggccauuauuuuuucacagaacccaagguaggugccaggaacuuucuggucagagauuucacucuucuguauuuuggggugagggagaaggaaguuaaucacagaguaaacuguagaggacuggacagagccuuagaagacucuggccccacacucauuugaaagacuaggaaacugaggcccagaaaaccacuucaugaccauggaagaaaauuaaagaauggaaauauaagccuagguacguuuuuauugaauucaugcaucacagcuaagagaugaagagcuagcaguucgggaauuagagaaaucuggguuaaaaugcaguguugucuguucuuugcuuuuucugagccucaguuuucccauuuccacaucuguuaaauggccauggcaauuacaauuaccugagguuauugugaggccucagugagaucaucuaguagguugaaccaugugaaauugugaacacuugacucuuuuuuauuacaaaauaacaauuucauuugguuuaauuaaaggucuuaguuuaguguccgccaguaguaagugcuugauagaugauaacuucuaaaacauuauaggcaaaggacauagagaagucaaagaucguguagauaauuccagcuagcuuaucuucucaaauuuguuguuaaacauuuggguguuccggggaaggacuaaacucuacagaauuuugccuguacugccaugaggggucaaauaauugccacagacagaguguggccucuccuuucucaggccucucacugccauggugucugcagugugggaugccucuucugugguggacccagagccacaugaaaauuugggggggguggggucagccccauucucucuggaagcccauaaaaccuugcuaucacccucuucagggauguaucgcugggaucucuauauaugacaugcccagugccucagaucagaaaugccucaaaaagagagaugugucugacucuuaaaggccccuauccagggguaugcccauauuugauauucucauccaucuuugggacuuucuuagccuucucucauguccagaaaucaucagaggcuuggcaaccaagaagagcgggucaagggauuuccaaguggcaagagaggauuggggaaguuugaaaagcaccuauaauguuacacuucugcauuuuuuuaguagcgaguuuuuuugggguaaauuugaucauuggaguagugagcugaguuuggauuuuggugagugagguuacgaagaagacaguuuuuuuugcucugggaugguggggcuaggggauggaaauuugggcacugugccagaaaaucauauuagaauuuccaugggguguuagcuuuuuaauuuuccucaguggggagcaaagguuaaauacauuugcaaaacccuuccucagacuagcugagugccugaaacucuuuaugccaagagaguacacuuuggcccccuuuaaaagagccccugugaaucccuggaggaagaggguggcuguucucugcggaagaggccuucugaugcacccccagcuuccagguuccugacaggucuucuccagcacacucacaccacguggacucuggagggucacuggcacaaggaacugugggcagcagagucuauaaauaggcaaccaccaccucccagacugcugggcacaguguuauagggccagacccgugggcacugcuacugggaggcccaaggugacugggcaagggcccagaugccguguccucgucacucuggagaaagaccagauuuccugaguguguccguuguuacccuaaagaaagaccagauuuacugugucuuaagugccaagcacuuuccacaucuccccuaauuuuauccuuauaacagcacuuggagguuggugccaccacugcugccuucgcagauagaaaacagaggcccggaaaggugcagccuguugucugaauucaaggguagagucaggaacacaaucuauguugcuuggcuccagggugggugcucuuagccuagcgggguaguagaugggguagggacugugugggaaacaggagugaggauaccugaguuccaggcgcaguccccccacacuuuagcugugugaccugugcaggccacucagcaucacugugccaucauccaauccagcccaugucauaauguugcugggaugguuaaaugagaucaugaguguaaggacacuuauagugccuggugcacagcaauaauaguaguaauggguuaagauuugaacccugaucccacuggggcuggacucuucccaauucugcacuuaccggcuggauauccaugggcaagucacuaagcacgggcuuggaguccagcugccuggguucaaauccuggcaccuuuacuccccgggaguugggugaguggcucaucucucugggucucacuuuccuucucugugaaaugggaugauacuagcacuucucaccuagcugguacgggggauuaauucagguaaugcauugugaacaaccucugggaugaguguccacauguugcugcugcucuuucucugaaaaaaauacagcuggaacaauuuuuuuuuccuguuccuauuaaaaaaccacaguuguuguugauaaugauauaauaaugagugguuaagaacauauuuauuuggaagaauuuuuaaagaaggcaacauaagacuucugguaaugaaggaaauauaauacaguccuuaauucagcuggggaacauagcuccauggagaaggucgaggagaacuuuguuccuauagccugcaucuggcuccuccaugaauguguguauugauugcccccauuucccugcagacgguguacaaccuggcugauguggccugcaagugccaugggguguccggcucauguagccugaagacaugcuggcugcagcuggcagacuuccgcaaggugggugaugcccugaaggagaaguacgacagcgcggcggccaugcggcucaacagccggggcaaguugguacaggucaacagccgcuucaacucgcccaccacacaagaccuggucuacaucgaccccagcccugacuacugcgugcgcaaugagagcaccggcucgcugggcacgcagggccgccugugcaacaagacgucggagggcauggauggcugcgagcucaugugcugcggccguggcuacgaccaguucaagaccgugcagacggagcgcugccacugcaaguuccacuggugcugcuacgucaagugcaagaagugcacggagaucguggaccaguuugugugcaaguagugggugccacccagcacucagccccgcucccaggacccgcuuauuuauagaaaguacagugauucugguuuuugguuuuuagaaauauuuuuuauuuuuccccaagaauugcaaccggaaccauuuuuuuuccuguuaccaucuaagaacucugugguuuauuauuaauauuauaauuauuauuuggcaauaaugggggugggaaccaagaaaaauauuuauuuuguggaucuuugaaaagguaauacaagacuucuuuugauaguauagaaugaaggggaaauaacacauacccuaacuuagcuguguggacaugguacacauccagaagguaaagaaauacauuuucuuuuucucaaauaugccaucauaugggauggguagguuccaguugaaagagggugguagaaaucuauucacaauucagcuucuaugaccaaaaugaguuguaaauucucuggugcaagauaaaaggucuugggaaaacaaaacaaaacaaaacaaaccucccuuccccagcagggcugcuagcuugcuuucugcauuuucaaaaugauaauuuacaauggaaggacaagaaugucauauucucaaggaaaaaagguauaucacaugucucauucuccucaaauauuccauuugcagacagaccgucauauucuaauagcucaugaaauuugggcagcagggaggaaaguccccagaaauuaaaaaauuuaaaacucuuaugucaagauguugauuugaagcuguuauaagaauuaggauuccagauuguaaaaagauccccaaaugauucuggacacuagauuuuuuuguuuggggagguuggcuugaacauaaaugaaaauauccuguuauuuucuuagggauacuugguuaguaaauuauaauaguaaaaauaauacaugaaucccauucacagguucucagcccaagcaacaagguaauugcgugccauucagcacugcaccagagcagacaaccuauuugaggaaaaacagugaaauccaccuuccucuucacacugagcccucucugauuccuccguguugugaugugaugcuggccacguuuccaaacggcagcuccacuggguccccuuugguuguaggacaggaaaugaaacauuaggagcucugcuuggaaaacaguucacuacuuagggauuuuuguuuccuaaaacuuuuauuuugaggagcaguaguuuucuauguuuuaaugacagaacuuggcuaauggaauucacagagguguugcagcguaucacuguuaugauccuguguuuagauuauccacucaugcuucuccuauuguacugcagguguaccuuaaaacuguucccaguguacuugaacaguugcauuuauaaggggggaaaugugguuuaauggugccugauaucucaaagucuuuuguacauaacauauauauauauauacauauauauaaauauaaauauaaauauaucucauugcagccagugauuuagauuuacaguuuacucugggguuauuucucugucuagagcauuguuguccuucacugcaguccaguugggauuauuccaaaaguuuuuugagucuugagcuugggcuguggcccugcugugaucauaccuugagcacgacgaagcaaccuuguuucugaggaagcuugaguucugacucacugaaaugcguguuggguugaagauaucuuuuuucuuuucugccucaccccuuugucuccaaccuccauuucuguucacuuuguggagagggcauuacuuguucguuauagacauggacguuaagagauauucaaaacucagaagcaucagcaauguuucucuuuucuuaguucauucugcagaauggaaacccaugccuauuagaaaugacaguacuuauuaauugagucccuaaggaauauucagcccacuacauagauagcuuuuuuuuuuuuuuuuuuaauaaggacaccucuuuccaaacagugccaucaaauauguucuuaucucagacuuacguuguuuuaaaaguuuggaaagauacacaucuuucauaccccccuuaggcagguuggcuuucauaucaccucagccaacuguggcucuuaauuuauugcauaaugauauucacauccccucaguugcagugaauugugagcaaaagaucuugaaagcaaaaagcacuaauuaguuuaaaaugucacuuuuuugguuuuuauuauacaaaaaccaugaaguacuuuuuuuauuugcuaaaucagauuguuccuuuuuagugacucauguuuaugaagagaguugaguuuaacaauccuagcuuuuaaaagaaacuauuuaauguaaaauauucuacaugucauucagauauuauguauaucuucuagccuuuauucuguacuuuuaauguacauauuucugucuugcgugauuuguauauuucacuggu

SEQ ID NO: 21510 - RNA, 19968 nt, Homo sapiens
accagugaaauauacaaaucacgcaagacagaaauauguacauuaaaaguacagaauaaaggcuagaagauauacauaauaucugaaugacauguagaauauuuuacauuaaauaguuucuuuuaaaagcuaggauuguuaaacucaacucucuucauaaacaugagucacuaaaaaggaacaaucugauuuagcaaauaaaaaaaguacuucaugguuuuuguauaauaaaaaccaaaaaagugacauuuuaaacuaauuagugcuuuuugcuuucaagaucuuuugcucacaauucacugcaacugaggggaugugaauaucauuaugcaauaaauuaagagccacaguuggcugaggugauaugaaagccaaccugccuaagggggguaugaaagauguguaucuuuccaaacuuuuaaaacaacguaagucugagauaagaacauauuugauggcacuguuuggaaagagguguccuuauuaaaaaaaaaaaaaaaaaagcuaucuauguagugggcugaauauuccuuagggacucaauuaauaaguacugucauuucuaauaggcauggguuuccauucugcagaaugaacuaagaaaagagaaacauugcugaugcuucugaguuuugaauaucucuuaacguccaugucuauaacgaacaaguaaugcccucuccacaaagugaacagaaauggagguuggagacaaaggggugaggcagaaaagaaaaaagauaucuucaacccaacacgcauuucagugagucagaacucaagcuuccucagaaacaagguugcuucgucgugcucaagguaugaucacagcagggccacagcccaagcucaagacucaaaaaacuuuuggaauaaucccaacuggacugcagugaaggacaacaaugcucuagacagagaaauaaccccagaguaaacuguaaaucuaaaucacuggcugcaaugagauauauuuauauuuauauuuauauauauguauauauauauauauguuauguacaaaagacuuugagauaucaggcaccauuaaaccacauuuccccccuuauaaaugcaacuguucaaguacacugggaacaguuuuaagguacaccugcaguacaauaggagaagcaugaguggauaaucuaaacacaggaucauaacagugauacgcugcaacaccucugugaauuccauuagccaaguucugucauuaaaacauagaaaacuacugcuccucaaaauaaaaguuuuaggaaacaaaaaucccuaaguagugaacuguuuuccaagcagagcuccuaauguuucauuuccuguccuacaaccaaaggggacccaguggagcugccguuuggaaacguggccagcaucacaucacaacacggaggaaucagagagggcucagugugaagaggaagguggauuucacuguuuuuccucaaauagguugucugcucuggugcagugcugaauggcacgcaauuaccuuguugcuugggcugagaaccugugaaugggauucauguauuauuuuuacuauuauaauuuacuaaccaaguaucccuaagaaaauaacaggauauuuucauuuauguucaagccaaccuccccaaacaaaaaaaucuaguguccagaaucauuuggggaucuuuuuacaaucuggaauccuaauucuuauaacagcuucaaaucaacaucuugacauaagaguuuuaaauuuuuuaauuucuggggacuuuccucccugcugcccaaauuucaugagcuauuagaauaugacggucugucugcaaauggaauauuugaggagaaugagacaugugauauaccuuuuuuccuugagaauaugacauucuuguccuuccauuguaaauuaucauuuugaaaaugcagaaagcaagcuagcagcccugcuggggaagggagguuuguuuuguuuuguuuuguuuucccaagaccuuuuaucuugcaccagagaauuuacaacucauuuuggucauagaagcugaauugugaauagauuucuaccacccucuuucaacuggaaccuacccaucccauaugauggcauauuugagaaaaagaaaauguauuucuuuaccuucuggauguguaccauguccacacagcuaaguuaggguauguguuauuuccccuucauucuauacuaucaaaagaagucuuguauuaccuuuucaaagauccacaaaauaaauauuuuucuugguucccacccccauuauugccaaauaauaauuauaauauuaauaauaaaccacagaguucuuagaugguaacaggaaaaaaaaugguuccgguugcaauucuuggggaaaaauaaaaaauauuucuaaaaaccaaaaaccagaaucacuguacuuucuauaaauaagcggguccugggagcggggcugagugcuggguggcacccacuacuugcacacaaacugguccacgaucuccgugcacuucuugcacuugacguagcagcaccaguggaacuugcaguggcagcgcuccgucugcacggucuugaacuggucguagccacggccgcagcacaugagcucgcagccauccaugcccuccgacgucuuguugcacaggcggcccugcgugcccagcgagccggugcucucauugcgcacgcaguagucagggcuggggucgauguagaccaggucuuguguggugggcgaguugaagcggcuguugaccuguaccaacuugccccggcuguugagccgcauggccgccgcgcugucguacuucuccuucagggcaucacccaccuugcggaagucugccagcugcagccagcaugucuucaggcuacaugagccggacaccccauggcacuugcaggccacaucagccagguuguacaccgucugcagggaaaugggggcaaucaauacacacauucauggaggagccagaugcaggcuauaggaacaaaguucuccucgaccuucuccauggagcuauguuccccagcugaauuaaggacuguauuauauuuccuucauuaccagaagucuuauguugccuucuuuaaaaauucuuccaaauaaauauguucuuaaccacucauuauuauaucauuaucaacaacaacugugguuuuuuaauaggaacaggaaaaaaaaauuguuccagcuguauuuuuuucagagaaagagcagcagcaacauguggacacucaucccagagguuguucacaaugcauuaccugaauuaaucccccguaccagcuaggugagaagugcuaguaucaucccauuucacagagaaggaaagugagacccagagagaugagccacucacccaacucccggggaguaaaggugccaggauuugaacccaggcagcuggacuccaagcccgugcuuagugacuugcccauggauauccagccgguaagugcagaauugggaagaguccagccccagugggaucaggguucaaaucuuaacccauuacuacuauuauugcugugcaccaggcacuauaaguguccuuacacucaugaucucauuuaaccaucccagcaacauuaugacaugggcuggauuggaugauggcacagugaugcugaguggccugcacaggucacacagcuaaaguguggggggacugcgccuggaacucagguauccucacuccuguuucccacacagucccuaccccaucuacuaccccgcuaggcuaagagcacccacccuggagccaagcaacauagauuguguuccugacucuacccuugaauucagacaacaggcugcaccuuuccgggccucuguuuucuaucugcgaaggcagcagugguggcaccaaccuccaagugcuguuauaaggauaaaauuaggggagauguggaaagugcuuggcacuuaagacacaguaaaucuggucuuucuuuaggguaacaacggacacacucaggaaaucuggucuuucuccagagugacgaggacacggcaucugggcccuugcccagucaccuugggccucccaguagcagugcccacgggucuggcccuauaacacugugcccagcagucugggagguggugguugccuauuuauagacucugcugcccacaguuccuugugccagugacccuccagaguccacguggugugagugugcuggagaagaccugucaggaaccuggaagcugggggugcaucagaaggccucuuccgcagagaacagccacccucuuccuccagggauucacaggggcucuuuuaaagggggccaaaguguacucucuuggcauaaagaguuucaggcacucagcuagucugaggaaggguuuugcaaauguauuuaaccuuugcuccccacugaggaaaauuaaaaagcuaacaccccauggaaauucuaauaugauuuucuggcacagugcccaaauuuccauccccuagccccaccaucccagagcaaaaaaaacugucuucuucguaaccucacucaccaaaauccaaacucagcucacuacuccaaugaucaaauuuaccccaaaaaaacucgcuacuaaaaaaaugcagaaguguaacauuauaggugcuuuucaaacuuccccaauccucucuugccacuuggaaaucccuugacccgcucuucuugguugccaagccucugaugauuucuggacaugagagaaggcuaagaaagucccaaagauggaugagaauaucaaauaugggcauaccccuggauaggggccuuuaagagucagacacaucucucuuuuugaggcauuucugaucugaggcacugggcaugucauauauagagaucccagcgauacaucccugaagagggugauagcaagguuuuaugggcuuccagagagaauggggcugaccccaccccccccaaauuuucauguggcucuggguccaccacagaagaggcaucccacacugcagacaccauggcagugagaggccugagaaaggagaggccacacucugucuguggcaauuauuugaccccucauggcaguacaggcaaaauucuguagaguuuaguccuuccccggaacacccaaauguuuaacaacaaauuugagaagauaagcuagcuggaauuaucuacacgaucuuugacuucucuauguccuuugccuauaauguuuuagaaguuaucaucuaucaagcacuuacuacuggcggacacuaaacuaagaccuuuaauuaaaccaaaugaaauuguuauuuuguaauaaaaaagagucaaguguucacaauuucacaugguucaaccuacuagaugaucucacugaggccucacaauaaccucagguaauuguaauugccauggccauuuaacagauguggaaaugggaaaacugaggcucagaaaaagcaaagaacagacaacacugcauuuuaacccagauuucucuaauucccgaacugcuagcucuucaucucuuagcugugaugcaugaauucaauaaaaacguaccuaggcuuauauuuccauucuuuaauuuucuuccauggucaugaagugguuuucugggccucaguuuccuagucuuucaaaugaguguggggccagagucuucuaaggcucuguccaguccucuacaguuuacucugugauuaacuuccuucucccucaccccaaaauacagaagagugaaaucucugaccagaaaguuccuggcaccuaccuuggguucugugaaaaaauaauggcccugguuuucaaugcugccaaaguuaagaaaaguuuucaccccuucauuuuaaagcagccauaaagugccauguguuuaaccgcaggaaaaaaagggucuuuuuaacuauugagaaguagcuuuucauauccccaccaggggaaggaaagagcgggaaccaggagacucgugaggacugcaaagaugguccucccuggguacuucugcugcucucuucucuccagagcuacuuugugauuggccugauggucagaccuauaaaaucccacacugcuaaaaaugcuguccuuuuccuagaaaagcccuuuuuuaaaaaaacccuccauccaucaggccugcuaccuaaugacauaaagagaggcagggagaaagaaaggagggaaagagccucaaagcuggggugagggcuuucccaucugggcaccuacgaagacagaaaaaucccugucccaaacugaaagccaaccacagacaucguccaggcaggagggagaaaguuauucccauuuuuauuucugugcuccaguagccaaagguaccagggacuaacuaagaaggcaaggaaaggucuuuuucaggcaacugcugguucaccuuggcugggggcgaaagggaggaugauccgcccaggaggcccuucugggaugugcaggggcaacuauggagacagauggaggaaagagagguagacaaagggggagaagagagagaccgggaaggaggaaaggaagggaagagggagaaagaaagugagacgggaacaggaugaggaggaaagagacaggaaagacagagaaagauagggagagacagaaagagaagcagagagauagagacaggaccauauagcaaaggaguggcagaggagaggacggagcuacagggagagacccgaggaggcuggagggcaaggugagaagacagagaugcggggcgggggcgagacgcggcacucacccugcggccggccucguuguugugcagguucaugaggaugcgagcacucucguaggagcccuuggcguggaugcgcucccgcucgcgggcguccacgaacuccuuggcaaagcgguagccauagucgauguugucgccgcagccgccccagagccagucccgcggcagguccuuggggcgcgcggcgcggcugcagccgcagguggacagcucgcccucgcggcacgcccggcucauggcguucaccaccccugcugcgcucaccgcguaugugaaggccgucucgcggcugccugugggugaggacaagggaucacuggccgccugccucacgcgcugggccgggaugcugccgggggugggggugggggcaagguagggaaugguggggagguaggagguggggggcaagguagagauggaggggagguaggaggugggguuggggcgagguagggaggggggagguaggaggugggggagguuggagguuggggggaaguaggagguggggaagcaagaauaguggggagguagaagguggggggcagguagggcuggggggagguugggguagaggguagggaguaggagauggggggguaggggguaggggaucaauaagguaaaagcucgggcugccccauccuuaacacgcaccaggcccugggcccagcuugaggggaagccaagcaagaucccccaaaacacacagaagcaacaauuaacaaaggaguagcagauccccaguaucucugcucagccauuucagagcugcaggccagauucuaagcagugcuggauugauuuucucugcaacucuuuugaaaauagucaaaacuugcuauuugcaaaaaugcacaugaaagaagucauugaaggaacacucagaauauggguagacuuccuuacacuuauuuuaauauuaaguauuauuuucauuugaguuacauauaaggcaggauuacagaauuugcuaggccuugaaucuaagggagacacugccagcggccacacuaguuucugccacacucauuuuggccuuguguccccuccuccucuggcaguuguaaccucuccucccucuuccuucaugcagcagaaaguauuucucaggacaagucucuuuacuuucccagaggacaauucuaaaucagcucauagagaguuauaaaugaagcuugcuauucuuaaaucccaggcucauuggccugauacuucucauucaagaaugagugucugcuuuuaaaacagccuguuguucuucaaugccacuucugcagacacccccugcccacucccccacugccuuugccacaaaguguuagaaugacagcaagaaggaaaaaagcacaaccuauggggaaaagagggagggagaaguuuucuucuucccaaaacuaguaaagaauaucuccccauauaauaguuacagggacccuauuuguaaggagaaaacuggaggcuaucauagaguacccuaaacuucgcuuguacauggagacauuucugcauguaacaagagcuaguuaauaaaaguacuguaaucugagagagaaaggguuaucauccagccagcugaagcgugggguaggggugggauuggggggcaggcucacuuuccucaauugcaaaauaaggguacugaaauacaugcaaggaaaggggccucuucuggugcugaaauucauguaccgcaaucaguuuauccuauacuuacuuugagagcuugcuaacaaucuuuuuucugagggggaagugaggagcacaagaaaagcugacaacaggacucagucugaacgagaagggucauucugcaggaggacagcgaugccaguuuaagcauccagcaggccaccucauucuuggucuucugcuccaugccagucacagccauuugugaauggugaugguucugauuuaccauauauccucccccucccauauuuucaaaaugaaugacuugaaggugugugcuggugguuggcaggaggaucuagaaaguuccugugaugcguuacaccuaucuagcgggauuagagaggcagagcacaucaggggaauggaaaggaaugaggacaauauacagcuucuagggaguaauuugauaguacagaaaaugcuguggcccuggaugggggauuuguagaacaaaguagcuagaggaagaggagaugaagaggagaugaaaugauccucuggggauagaggaaaauaagacacuguccuuugaguauacagagcauaagaaggcuuuauacaaaacacaaacaaugcuucuuuuuucauaagucuaucuugagcauuuccuuuuaugccgcagaauacaaaccugggagaucccucuaagcuaauuggucacugcaggguaaacgucaguuugaaaaguauucuuuggcuaauugccugaggauacagucauccugguuggaauacugcugauucaguuagguuucccuuccugugaaacccacaucuacuccgauccucacaccccuuacaaauggugccuuccuuacauaucuuuucacagcauggaaacaaagaagagacagauggggacaaaagcuggaaggaaaggguagcaugaugaaaaaugagaaacucuccaaaaugaagagugggcccuucaugaaguaauugugcauggugccuccaaggcaacuggcaucuuagaaaaaugaguugaggagggggucagagguggcggccugaauuucucagacacuggccccaucacagggucaaauucucacaaagaagaauuauucucaauguccuuggugugcugagggcuuuggggugggcacacacacacacaccuuuuggcaucaaagguauuuuaaauuuucccuuagcucauucucuucaaauacacucuuaaguggaaaagugaaagcaaagaaauuuuccaacuauuggaauuggauccauguuccucuuucauaaaaaucuauuguuuucucuucucuccugucucuuuuuuaauuaaguaaaaaacagaaggccccaucagugucccaccacaagccacccagcagcagcuuucagcucugagacgcuaggcacuugggggaccuuuugcaggggaggaugccauaugugcucucaucuucccaggacaucagcugacuugaugauaguaucuaggagggcugucucagaggguguggagagguaccacucccauccacuucccaucgacccagacaguagugccgugcagcugaagaccagagagcauacuuuccagggacaauuaaauacaggcuuuuguaccaaggguucugcuuguucccugaggaagcaggcucuuugaaucuuggaccgcauuuaaaauaaaucuccagcagaacucaaauucacuuagcaaaugauagcuuauucugaacauuuuggcccaaaacaggcuacguaugaaaacgagaggaggaucuuaaaucaaagcuguguucaagugacuacacagauaaacaguuccgauugcuguuuuccuuccugguuaccaucagagguguaugauuuuugcuaacucauauacaugugaaaaaguagucccauagguugagaggaaggcaguuuaggaggaacauagaagaagggggaaaaguuaccauccucauagaauuuuucaaaaguauuuaaguucccuuacaauaucaacacacgggagaauaaaucuaccacacucccaguuaacuacauaagacagcccacagucagggaaaacuccuguguuccugaagcuuaacucuuagauucagaucccaguauauacauuagcacauuuuaaucauuaacagaaaggacaaagccccaugaaacuuugcaggcugaggcuacaggccauucucccauucagucagaggaacagcuuccagucuuguauuauuuuaguuuauaaaaccacuuggcucaaacauccccugacaacucuuuuuuguucucaaugaauguaauuuucgggguuuuuuuuuuaauaaaaaaugcauuuuauccaucugugauggacauuaagccaacuuuucucuucagucaguauagacaguuaauugccuugauaaauugcuucuuacuuugggagucacugcagucauauuaauuauaagggcuuuuuugcauaaaaguagagaaaccuaaaauauucacacuagaaaacauacauuggaccacaucugucaaauaguauccuauacuauuuaaacaaaagcagaggcaaacaaacagauuuuuuaaaaucuuugccuuuagcccauuugaaaugcuaucucuuugaauggggaaguaagacauucaacaacguauuuaaaaugaagaaucggacugugagcaauacucuuaauuuuuuuuucaaguuccuagguugacaucccaagcaugugcuuuuauuauaucaauugcugacaucacaaacauaaauuggaucacuuuuaauuaaaauucuuucugggacuaaaaauaaagcuuuuaacgucuauaucuuuauagccucaggaaauaguucuauuaggaaaauuaaaacuuuguucacuuucaauauauccaggauucuaaaagacggcaacuuuuaguucgaugcucgggccguuucaauuguggcuuaaaaaacuaacaggcaagagaguuucgacguuuaaaagcauauacaugacuugcuucccccaccuacucuuaagaaaccaaaauaaguguucugcuucuauuuuaaacaaaaugcuuuauagaaaaauuaaguguuugcaaaaaugaaggugucugugauacuugccuccugauuugauuaaaauccaaaacuuaucaucagguguagggacaggaauuaacaucauuugcuauaaugacaaaaaugcccaagccaccacccgagcuggaaggcauccuccuucaugcuuucuaucaagcaugaaguaaaugcuaaggauuucuucuaggaaaaaaaguuaauguuuuaaaaaaauauuuuaaauguuuuccuaccuaucugcaucacccugccaaaaacagagguguuauccacagugcugcaguuccaccuucgaugucggaauugauacuggcauucuuugaugccugucuucgcgccuucuccgauguacugcaugugguccugauacaaguggcacaguuucuucuguccuugagaaaguccugccaguuggcugcagagaggcugugcuccuauaauauauacuucugacaucugaacaggguuauucauaccuagcgaccugcaagggggggagaugugcauucaagauuuacgugaaaucucgaggugggcccccugaaagcaugucagcaauacauaguuuuaagcacacagaugcuuuuuucucuccugcuuguccucaugacaaaguaugagaagggcuucauaaaacuccucuguuuaaacugcacucagaaaacggagguauugugcaguccccauccugccaucuggcuccucaguuaguauuuucacucccuuccuagccccugucaccauauaccugaaccaguauuuccaaaauccacucagaaaaggaggaaacagcaguuugagggacaggccucugacauuagagaaagugacccacuuugccccacaaauuggaccaaucugccuugaaaacuuaugaaugcugaaaguagacacaauuagauacggguaggagauagcaguuccuuuugacugauggaagaacagagggacaaguauacagacuggagaaaauucaccauguuucuugacauuuuaaaagggcuccuuaugugauugugagggacccaagacaggguacccagugaacagaagucauguuugacagucagaaaaaugcuguucauuuacagggaaaaaaauacccagaaugccgucaaaaauaauccucuggauauauuacagucuaucuacaaggccccuacccagaaagaaacccccacuuggggacauuugacuacuucaaguuaaccuccuuuugauuacauuucaagccccaauacuucugcacuuggaguguagcuguccuccuagaacucugccuaauucaaacucuguagguuaauaauaaucucgaguaacagaagauaaaggcugaaacucacuuuuacuaccuagagguggcaaaaaguaaauuuuguagauaggcuuacaauuacuagcaaagugaauuucuguucuuuuuuauugcaugauguacuacaagcacacgucugaacaagggcuucauagaaacaggccuagauuuauaguuucccauucccuaggagcugaagauaagcuuuacaauauuaacaaguuaaaagaaaauucugauuuaaaacuauauauaaguaaaauguauacauaugucuugcaauaaauacacccacacucacuauccagcauuaaauauugccgcaucauacaaacaaaucuuaaaaaaagaaaaagaagaggaagaacacgcacauagaaugaacuuaccaccaagaauuggcuucaauuacaaccugggcgaaggagaaaaauauggccaaagccacuaggaagaacuuggaagacauugcacuuccagccauccccaaagcaacuccugggcuuaauauuccaauggacuucuggagagggaagaaaggagcagauguuuauugccucucagauaauuuucaagcauacaaguuuaaacaacggaagcauccggggucucuuaaguuuacuguugauugacugcgcuucuccuccgugaguuuuuugauggcaagauauaggcaguuucuuuuuccaaauuaauccacccacgcaaccucaccaggaaaucugauuucgcugggauccugugcgcggggcacgccagcgauuacaaacgugucucaauucuguugagucaaagcccuggugccaggcgcugccuccuuccugcucgcucgagucccgcacccccuggccccccucuaguuggugcugugcucagucccuccuggguaauucacucaggaacccgcugcggccacccuccguccucuccccaaccugggccgagcaacaaguggagccagaauuaauuccaugggcgagaggagcacggaggcgaguggagcgcgcugccgccagaggcugccaaggaggcgggguggccagcgcgggggguggaggaugggggcaggacgcgggagggaagggcaggggguggggggcgaggccccggggaccagcgcgcgagagugcccagcugggaaaugcagcuccgaauuaacaucguauguuucauaaucaguuuacgagccgauguggggaaagccacuuccagauggggaagagcagcccggauuuccuuaaggacguucuucagccagacuagggaggggagaaggagaugggggcccuaggggauaauggagagagaggucgggucucccaaccaaggaaacuggaaaagagugccacccucgcccgcgucgccuguggccucuuccacggacugagagaagggauggaacccuagaggaaagaagggagucugggucucgcuuccccggggagaagaucccuucccugcccuccccacagcuuucucccaaauucugauuuuucacucucccucccaccccacaccuggcagcugccagggagggaggagaugggaggcccagagagacuccaguuucccuugguccugaucugggguugugggccacuuugccaucgcggcacugcgagccugucguuggaacucugccacccugccuccagucuagccucuccagcccaacucagacuugguucggucagugccgaaaggugggggugcggggcgaggccagagcccuugcagaugaguccagacggggccagaggcgcuggcuuccgagccgcagcugggcgcaucgauuccagggcaaagaggcccccagcggcgaagguucccuuccugaagaauuucagggguaggaguuggccuuggaagcuuccgcugccguuccuccccacuggugacuucuccaccuguaggcggcggcggagcgaguagguggcgggugcgggugggaggagcggguuuuaaaaauccccuuacacguaagucuaacccugccgcacugcaucgcccauagccccugaaggagccccuuccacagaaaagaaaagaaaggugagccucuuuaaggcgguggaagagccuggcuuggaaccugugccguaaaaggggcagaggggaccuaggcagcccugguaaagcuauggggcucaggggcgugccaagguuuuucuccgugagccgccccuuuggccuggacgcuucggggcuucucaaagaggaaaugcuuaugugguccccagcgccugcuaagcagggcuccacacccaaggcccaguuguccccaaaacgcugcaaagcuggggggcgcauccuggagaauggaaaucugggguuuccccagcuaggagagagaaggcuccggcuaucuccccacccccgcccuaagugucaaauuuccuccaggggagggagugggcugcaaagucugcuucucgcgcagcccaggcugcaaagucaacucuccccaagggcagccgaugccgcgugcacacacaucauacacauucacacucgugcacauuuacacacucacacgcgugcauagacacacacgcugcgacauguuuccgagucagcggcccagauuggugcuggccgcgugcacuuuccaagcuucgcggcgagcggggcgcguggggcggggcucaagcagcagagaaauugauaacagauucggcggauuacagcggaucucuuuguuagagccgaagccacacaaaccgaacccacucccagcccgaagcccccagggagaguccaccaguucccagagcccaggccaacugagagcgggcccauccggucaccaagacuugggucucccuggcuccaggguagagguaggcagagggugucccaaagggggaucggaaaggagagccucacgagucgcaucuccacuuaaccccgccgcuugcccggaaacaccuuggcccucuucccucuucaaucccagugcaaccgagaaaaggccccacaaguuugagacacucaaagaacucacagcgaacucacacauacaucggcucuguaggguaaaacauccccgccuguuuaccaagagaucagauccgaaaagacaguaugaaaugagaccucuggggagacugucaaccccagggguaaaacaaaaauucugaucagaaacugaguuucccaaagaaggggcuaaauguuuuccaacacuuucggggcucagggaagaugacucuguaaggacacugagaaucuuccucgcgugccacggggaggaggacugggggcguuugaggggcucagcgcaccagaggagugagguggaggagggcguucccgcguccuccucuucaauccagagcagcucaacgacguggcucccuuucuauguaucccucaaagccuucgcgucggauuaaagguguucuugauccuucuuuaccaaccacggugcgggccaggcgugaugagggaugagggagaggaaaccucaguagcaaaauuguucagaggacguucggagggcgcggggagcagccggaugcacaccuaaagucucgcaacacccaacuccuccuccgcaggcagucccuuaagagaauagauaaaaaggccaagcaaagauccucuccccucggccccggggcacugccacauucagucuaggcauccccuucugcuagacucucuacguuuaggccccaaguuucugggagugaaacgaugagggacgccaaauaggcggaagaagcccauuugacccaggcuuauggcagcgaaggggaggaugggaaacuccaaaaagaaucuccacucuugguggaaaaagaaagcuguuuuccccacucugaucucucccuaaagcaaggagagagaugcagaaacuagcaggagagcacucaguugcagccaaaaacuugggacguccugcccuggagaaugcggggagcggcgcgaggagcuaaagaaugggccggcccaggcggguaggagguccgcuuuaggggagcagacaaaggagccacuacucccuaagccucacgccugggcgcaaggguuguguccacagcaauauguguguuggcgcgcgcggagcgggguaggggaggagggaauugccagauagagaaggcggagguuacaccuugagccagaaucaguaugacaaaagagagccgcccaggccucaacacugacagcagguuccagguucggguauagagaggccccaggggaagaacggucuggccugguucuccucuguuuccugcccccucguccaucccuuagacugggcuuuccaggccccaggauacacacacacacacacacacacacacacacacacacacacacacacaccacucacaccuucucacauaggaugucuagcccucucggcagaggaucaacuuuguccagagguggagcagaguccuuggacagaggaagaaaaugaaaugauaguccaacccccacucuuuaaagguaguuucucucccacuuuuuaauagacgauuaaagugaggcgaaaagcgggaaagcaacacuuguucucgaucauagagaguugggaggcagcugaggccagacccgaggccuccuagggcgacacucuccuucccaagcccagaagaagagguaccaacccuguguccagcuggccgagucccauuugcugggcuggacccguggccccuuccguauugcagcggccggcggcgcagcgaaacugguccucugggggccuccgagggccccugcugggagaguggggucugguggucgggagggaugaagggagcaggggugggagggagaggggagcagcugcccgcccgcccgccccaaggaaccgaggcucgcaggaguccuaccucaaggcggccaacagggggcagccggcaccgcaccgcggggaagaaaaggccgcggggauggcuccgaguucugcgcgcauagugcuaaccccuugagcaccggagcgcacgggggaggggaggagaagacaggggacucuugggccgggccuccuggggagggucuuccguugagagggucgggggguggaggagacgaaggcuacuacguccuggacccgagaacaacuccccuacacacacaaacacacacgcacacacacgcagccaaggauccacacacucggacacacacacauuugucggcccgcgguucgcugcgcacucuccgcauugcccccucgaaacuccccuggcagagucugucuagaaacuaaaucuggcugguucggcagugaaugugcgaagguggcuggggggagggcaggggcugaggaggugcgaccucaccgcaaggcccaaguuacuuccaaacagcgaauuacccauuuaaagagagaagagagaaaagagaggcgagagaggagaaggggccucgauaccagacagggauuagaaagucaaacagggccguggggucuccagacuugaaguuuuuuguuguuguuuuuuuuaacuuuuuggggggaagagggguuauuugcuuccaggaaacaucuuaauuucaauucuaaccuuauuuucuaagaaacuuaaaaugggaaagaccagaaaaauggaaauaggaaucgaagcuuggaggacagauaagaaaaauuguuuagaaaauaaaaacuuauguugcaggaagaaacguuaacuuuucguaaaagugaacucucagugacccucggagugugugauucggcuuuaacauacaacugacaauuaaaacaaacaagaguucgcaaacuggcccccgccugcucucccaaagcggaggcccaaguguuuucuaaaggacaaggcggacuccgcucagggggccggggagcgcugucccggaguacgggauuacagccacuaccaccacaacuccccgcccccaccacugcugcaaagugccugagcucacccaguggcggcuaauaaugcuaauaacgcgaccccgcuccccgcgccggggugcgcgcuggccccccgccaggcacucuuaaaggcaaaggggccugaagcgcucgaguuacucggccaaggcaagccuacaaucuggccuccgucggugcgggggggugucggggaagguguacgccgcucuggaguaguuggccccuaguuccucugcggguucucucaaccaaggagucccuuuccccaucccgagccccggccacacaccgucccggugcccgcgcagugggcgcuugguaaauauuuguugaauugaaucauuauccuguuacugaaauauacauaguaaauuacacucgauguucucagagcaaaaggaaagucgucagugaaccgcacucaguuugucuacuaucgcucuuccccacuuuuucucaaaaaucaaaauuguuugcagaacggguggugcgaccagaagugaucuccugggacacugaggcagugcgcccggcguggagggcgaagggguagggguuccugccagcgacgcuggaguuccagcuucuucaggcgguuggggaaauggagggauaggaagaggcgaagggaacucaguuaacuuccaacaggggguggggggaaguaaagaaaaaaaguggcagcgcacugaacaccuaccuucauggcgagggggagggggcgcggggaggaagucgccacccgagcgagcgcagccgaggaauccgagcggagcgaccggguuaagccuggggggacggucaggagcagggcugcggaguccuccggcgcgcguccggcgggcgcagugaaccggagcugaagcgggcacuggcgcccgggccuggacucccgaguuggggcagagcugggaugcgcccaggaauggagggggcgcggacgcgcgcgagccggcagcaagggcagggccuggucggggcgcaacuagggagccgccgguccggcgagggcgcgcaggcaacuguuccacggagaggcgcuccguuuccaacguccaucagcgacggcgguaauuagggcuuuccaaccccaaaugugggcgugauugugcaaaagaccuuacgacaaauaauaauaaaaagaaauucuucacaagagggugaaaaaaauguaccacuacucaacuguggcccggggcgggggaaggggggcgaucugugcgcccaggugcccccaguucauucacaccacagauucugcaaacucuuggcggcucacgccuccugaucuccagcuccuccucucugggucuguagccgaaacgucugcuuccagacgcug

SEQ ID NO: 21511 - RNA, 14291 nt, Homo sapiens
aggccccaccauggcgccguuccugcgcaucgccuucaacuccuaugagcugggcucccugcaggccgaggacgaggcgaaccagcccuucugugccgugaagaugaaggaggcgcucagcacagguaggccuggaggcuggacccuggagaggggcugggaaucugggcccagcuggaaggacuggagggggccuggccuuguucccugcaaccucugaaggauucugcucuuccucauccuugacucccugccccacucagcuaugaaggcagaggccacugagucgcuauagggcugcaaacacuggccaaauugagcccuccuuggaaggcuuggaguuucugguuccuccucccugguuguuuuacccagcaauuuuuacauguccauuugugccagggccugugcggggcacugaggauacugucaugcuccaggacuaaccuggcccugcccucaugggguucauagucagguggggaaaccaggcacgucaaaaagcagugaguccugcaauagggaagcccagagaaggcacccucugaaccugaggucagggaggacuuccuggaggaagcacauaccucacaucauucccucuugcuuuugcccuggccuggugaaccccuauuugucccucaggucucggcugaacuguuccuuccucuaggaaaucuucccugacccuuaggcuugacccuguagcacuaccagccuugcccucuucagucucaucacaacugugacuuaacaguuacuugaggaaggaguuggugcauucgccacccgggccuggggauccaggaggacaggcccuggauguagcuuuucuuucagcuguguucugcgccucgaauauuauggcuggcaugcaggagcugucagcccauguucccugcaugaaugcauaagggcaggcgacauuuaaauggagcuggagcaagaggaucagaggaagagggaacagcaggaacaaaggccuggagggaggaccuagcagggugcccaagguaguucugugcucuagaggacacuggggaaccacagcaggcccucaaggcaggagagucgggcagauucugccaggggaaggccguggaggucuacgagggagggacagaggggccauggcccaaccuucucugccuggccuuguugcagagcgugggaaaacacuggugcagaagaagccgaccauguauccugaguggaagucgacguucgaugcccacaucuaugaggggcgcgucauccagauugugcuaaugcgggcagcagaggagccagugucugaggugaccgugggugugucggugcuggccgagcgcugcaagaagaacaauggcaaggcugaguucuggguaaggggcgcacgagccgugccgugugugugugugugugugucugugugugugugcaugcgugcaugugugugcgugcacacacgcgggcuuggucagugagcacagcugaagagcaccgggcccugugcuggccaccaguccagcccuguggccaacauguccugggugugaauccuggcucugcaauucaccagauucccagccucucugagcuucugcuuccgcaucuguuaagggaaggcgcuacuaaaugugccuaccucagggucaguuguucaaaugaaaggagcagcuggauguacagggcuuauugcagaaccugacacauagcaggugcuaaagacggccaacuuccuuauugugacuacuuuuuccuuuuuaauuuuggaaaggcaggauaugcacauaguaaaacauuuuuaacugcaugaaagggugugucccugccccaacaccaggccaccaggccuccuucccagaggcacccauuaucccaguucuuuuuggaaucuucgcauauauucuaggccuuggcagccauugagggggcaacauagugaucuuuaacagcaaggaggugggagaaggggaggcugacggucucaucuacuuaccugcugaaauggagacucugcacaagcauguggccacuuggccaugugcagcuguguguucuggguggccacaggaugccagugcuggcagaaguccccugggguuacaugugggauguaaccaagaugucuccaccaggaaaggcccugugaccauuggaggcucugaucagccuccugcgaggggugagggggcugggaugggagagagguuaacacagggcuguacugacccuuggccagucaggcagggacacagaggggccucuggcugugcugucuccgcucccccaagggaggauaucagucaccaggucuaggucuugggggaggugaggggauagaggcucaggucccacccucgagacuguccaaucugcaugaggagcccucggcacagagggaggagcagcgugugugcacgaggaugagugugucugugugucugucucucuccgcaugugcacacggguaggggccuccauucuaagauccuugcuaagggagcugcagcggguagggguggggaauuucccuucccgcucuauuccccagcuaugugucugggcugggugugggcuggacccuuucacuucccuaaauguaauaauaccccuggguacaggguggggguggggcucaggaguggggcucaggcggggcccugcccacacugggcagacaagugucuggcuaggccuuggggggcugccuuggccuugggggaccagccauggggguggguucugaguuuggccuggcccaggcugcccucacugaccuuguucuccccuggccucuggcccccaacagcuggaccugcagccucaggccaagguguugaugucuguucaguauuuccuggaggacguggguaagaacucccuggggguggagggcucccuugccggguucagaggcagagccagcacugagguguagggaagcugcucccuucggcagagcuguccaggaccacccugggagggacuguaggggugccaccccuuccagauaccagggcugacuucccuacuccauggucaccagauugcaaacagucuaugcgcagugaggacgaggccaaguucccaacgaugaaccgccgcggagccaucaaacaggccaaaauccacuacaucaagaaccaugaguuuaucgccaccuucuuugggcaacccaccuucuguucugugugcaaagacuuugucuggugagaaccggccaugcccacuggugguggugcaggguagugggggccgaucccgguccccgcucacucacuuugccuggguuuugccuuucaggggccucaacaagcaaggcuacaaaugcaggcguaagugucuccacaggccaguuuguacguauguacccaugugugcucacgugugccagugccuguguguaugccagugccugugugcgcucagagaguguaugcacgugaguuuucccaguguagauacagcagcugaguucagugagugcuggggcuggcuugcugcugcucuggaaaaccaguucugcgcaucucuucccagcuccgcauucagugacggggaguugguggauggcaauugggcacaguagaguauucacgcagaaaccagcccaggccaugcaccaggccucuuuuccucggagaggcaaugauagguccuuuacuggcacauaguggcugcaugugcuucuguguagaugugggugucucugaguacacaggugugagcacacucugucccugaggguguauacacgaggcgccgcaggcuggagucagacugccuggguuugaaucccagcucuaccacuuccuagcuauagggccuuaggcaaaguuacuuaaccucucugugccucaguuuccucaucuauaauuuuuuuuuuuuugagacugagucucauucuguugcccaagcuagagugcaguugugcgaucucagcucacuguaaccucccucuccaagguucaagcgauucucuugccuuagccuccugaguagcugggauuacaggcgugcaccaccaugcccggcuaauuuuuguauuuuuaguagaauaggggcuuugucauguuggccaggcuggucucaaacuccugaccucaagugacucacccaccucagccucccaaagugcugggauuauaggcgugagccaucgugccuggcccucaucuauaaauuagauauaacuauaauguauaauagggucauugugaagaucaaauggaauaagauauguaaagcuguauuuuaagugccuuccacugguagccgcucuguguaagaagucuguuaucauuauuacacaugcuuuguguguauguacaggugucuguuuugaggcguguccaugugcauguguaagagagggcauuuaggagccguuugcuaucccagggcuuggaagaacugcccccgcuucucauauugcgaugcccugugcccgcuaacuucugcccaccucccugcccacuaggacuccuucuuucuaagccccugcagauuggccuguccucuccgccccguccucuccaggcuccuccuucgagggcuggcaggaggaagacucaagcgcugggccucugcggggugagggugugggcggucaggagaacgguggcuuuguguagagggcuagacuggucggcaggcaccagcucauagacucugccccucccggugcuuucccuucccccuccugggccugugccucuucaagaauguaacgcugccauccacaagaaaugcaucgacaagaucaucggcagaugcacuggcaccgcggccaacagccgggacacuauagugagccuggguccggggcagggcuggggaucuggggggcuuggccagaugggagggauuugcacccucuccccacccucccuggggagcuuacccucccuccccauuuuucuuagucuuuccuugccucucccaguggagcucucuugggauguuguugugcccaggguugggggagagcuagggguugaagaagaggcuggagcuggcacgugacccucagccugugauacccccaccuccaguuccagaaagaacgcuucaacaucgacaugccgcaccgcuucaagguucacaacuacaugagccccaccuucugugaccacugcggcagccugcucuggggacuggugaagcagggauuaaagugugaaggugcgugccaccccgccccugggcugcaggaggggcacucccagcuggugcugcugugaauuccagccaccucacgccacccucgccuccucaccuggagacgggcaccucauucagggaccugaugagggugaggccuugguggacccuccccacuggccugacuggcucugccacuuaccugcugugugaccacaggugggcggcuccaccccucugagccauuuggaggagaaaagcaggaccuagagagucccugugaggggccagugggcagagggugcugaagccaggccuggugcacaccgacaggcgcccagacaggccuccccugcccucugcuucacuuagagaugagacagaagacccuggagggaaagcggcuuaaguugaccagauguucuuuaaaggguuucgaauuaggucccugucuucugguuuuuccuuuuucuuuaaaucaugaaagauuggcugggcgcgguggcucacgucuguaaucccagcacuuugggaggccgaggcgggcggaucaugagguuaggagaucgagaccauccuggcuaacauggugaaacccugucucuacuaaaaaaauacaaaaaaauuagccuggcgugguggcgggcgccuguagucccagcugcucgggaggcugaggcaggagaauggcgugaacccaggaggcagagcuugcagugagccgaaaucaugucacuguacuccagccugggugacagagugagacuccgucucaacaacaacaacaacaacaacaacaacaacaacaaaaaucaugaaagauugaaaugcuuggccgggcgugguggcucacaccuguaaucccagcacuuugggaggccgaggcagguggaucaccugagguggggaguucgagaccagccuggcuaacauggaaaaaccccgucucuacuaaaaauacaaaauuagccggauaugguggcgcaugccuguaaucccagcuacucaggaggcugaggcaggagaaucccuugaacccaggaggcagagguugcggugagccgagauugcgccacugcacuccagccugggcaauaagagggaaacuccaucucaaaaaaaaaaaaaaaagagagagagagagagagaucgaaguauuuaugauggcuucagaucaauguuuuccuagaaacuggaacccagcagaccccacugaagcccuccuuucucuugcucuccugcgccucuccuacacugcccccugcccuuggcugagcucugagacugacagccccgcuucucccucaccccagacugcggcaugaaugugcaccauaaaugccgggagaagguggccaaccucugcggcaucaaccagaagcuuuuggcugaggccuugaaccaagucacccaggugggcaggugccauggggacccuggacacagggcaguggggucagggacagucaaggcuuacagccacugcuggggagccacagacagccaggauauauuuagacccaggacucuacuucgggaagaugcaacucaagaauuuaggcagcagagggaggggggcuuuuuuucauaagaaauucauuauucaggcaguucuuuacuugagggugaaccuggggaccacaggaguggguguuggaacacuuugaacuaagacuuuggguguggacguuuguauguggggggggcuugagggaugccacaaaaccuaaagguaaaauuuuagaaucaaucagaaaugaagcuaaauagucaaauaaaaucuaucgagugagugguugggaagguaggguuccguuuacaaaacuucuguuuguaaucagagccuuucagaccaccaaggcuucucugggcuccuggaagagugcguguguguacacgcagcccgaguagggggccugggcugugccccuguugucuccucuugguguuaaggguggaguuauaccugggagucuuccuucugggcugggaguucugauaauggucugaccaucuggccccccaccucugcucccuccccagagagccucccggagaucagacucagccuccucagagccuguugggauauaucaggguuucgagaagaagaccggaguugcuggggaggacaugcaaggugaagcuggguccauugccccauuacgguuuuuauucccccugaggccaaagaaaggggacuguccucccuuccauugucaagugagacauggaaggaaccaccgguccuggggagcgagccccuuccucucugaggccccuucccccagccuaccccaggccccgggggaggggaguuguguagacugagaccccgaucugaggaggugccaucucucgggcagacaacagugggaccuacggcaagaucugggagggcagcagcaagugcaacaucaacaacuucaucuuccacaagguccugggcaaaggcagcuucgggaaggugagggcugugagccgggcaccugcuucccaccccacccuggcuucuucccgcuuagguggcugaggugggagucugugaaucgggcuguggccccugccccguccucaccugcucagcacccgugucuccccaucaggugcugcuuggagagcugaagggcagaggagaguacuuugccaucaaggcccucaagaaggaugugguccugaucgacgacgacguggagugcaccaugguugagaagcgggugcugacacuugccgcagagaaucccuuucucacccaccucaucugcaccuuccagaccaaggugcccgggccuccugccgucaccaccccaugccacagccaugucccacagcuccucagccccccucagucagggcugugucuccccuucaggccacuuaaggcagggccaugcuuuccccccucaugccucccagggcagagucguccaccucagccagggccugucccugcuguuuccuguuggggcuuggccccaguggcccucagugagggagccuccugccuauuccucaccccugcucaccacccuucccaccccaggaccaccuguucuuugugauggaguuccucaacgggggggaccugauguaccacauccaggacaaaggccgcuuugaacucuaccgugccacguacguaagggccaugguggggaagggcccaguguggaggaagggcuacuggcucagagcccacuuccagucugcccuccaugccuucuucccucucccuagaaaagccagccugggcuagagcggcaacuggggagauguggggguagccugggucggcaccacacaggaagccauggguggcaagugaacugcggcugggugcgcagcgcaaauacucuggguccuggccgcuccgugggccacagccagggcagccuugcaaauggugguccugcaugacacaggacacaggacccuggugcguggcccccagaccugcuucuccccauucacaugccccuuaccccaaacuaaccguguaugugugugugugugugugcaugcaugcaaacacauauguacaugcauguaaaugcauacacucuuagagaauuggcucacugagagcuuucccuucagaacuuucugccugggcugccagcccccacuugccugauacaagauguacuugaucaugcucaggugguccauggaguuauuugcagcauuucuugcuccuggaagugggguugagggcccgaggagaagcagaggcugcucggcagagaucccggaacacuuuaucccucucucuugcccagguuuuaugccgcugagauaauguguggacugcaguuucuacacagcaagggcaucauuuacaggugcgggggugagggcagcgggggcucuugggaggggaggcuccagccccaucauaucuucugaaaugcuccaagcaggauccccccaacuccaguuccuucucugcuggaaaucaaucuuuagcuggguauuugccuaugccucccacccugguguuagcauuccuguggccaccauuugaggcuggcucagcuucaggaacuaggaacucacugcucauauuugacaccaucgccccacccauccuuggagccgucagucucgcucugaagccccaucgagucaucuaagcuucugccagaagggacuccuuccauaaagucucaucuaauaaguuaugauuccauccuauggugggaacuguacacccaccaaaaaggcugaggucaggcucuguauacugaugugggauaaugccaagauauguuguuaaguggaaaaacaaccugugggaaaguguauaucgaauauuagcauucagccuuuaaaacgugggagggagacugagcgcgauggcucacgccuguaaucccagcacuuugggaggccaaggugggcagaucacccgaggucaggaguucgagaccagccugaccaacauggugaaacccugucucuacuaaaaaauacaaaaguuagcugggcauggugguggaugccuguaaucucagcuacucaggaggcugaggcaggagaauugcuugaacccgggaggcggagguugcagugagcugagaucaugccacugcacuccagccugugugacagaaugagacugugucucaaaaaaaaaaaaaaaaaaaaaaaaaaaggugggagcgagcugcaugcugccauaugcuuguccacgccuagaauugcucuaaggagagccucaugauugagcucaguggaagguagacuuuguacuguuugccauuucuaguucccauaugcauuaaguauauacucaaaugacuaauuacuaaauauagacauggucucugccugugggaaguagacaaaccugaaccugggggucacuucugcugcugacugcuaggggacccugggcgagugacaucaccuguuugagccccauuugggcuucaggaaguagggcaguguaugcccagcguuuagcacacaguaggggacuugcaagaagcaccuguuuuuaggaucucuuucuccuucugcuuccuuuucuguuucucauucccuuguacccuuggggacaguccuggacuaauacggcugaaaauuaggacauggggggcaggguuggaaggagaagaaauguccccugcugacucuuaccuguccccuguccuuagggaccucaaacuggacaaugugcugcuggaccgggauggccacaucaagauugccgacuuugggaugugcaaagagaacauauucggggagagccgggccagcaccuucugcggcaccccugacuauaucgccccugaggugagccgauacccuuccagccccccgcucagucaggcaccuugccuccccacggugggccagggaaggauucccaagggcagugauguccaagccaaagcccauaggcugaggcggccuggcuaggcuucgugcccaggggccccucucagccucagcaccucagcuccugcugaccugcugcucuccccaccgccagauccuacagggccugaaguacacauucucuguggacugguggucuuucgggguccuucuguacgagaugcucauuggccagucccccuuccauggugaugaugaggaugaacucuucgaguccauccguguggacacgccacauuauccccgcuggaucaccaaggaguccaaggacauccuggagaagguggaggcccugggcugggcugggcuggucugggcugggcuggggcaggggcuggcagacacugggcuuugggugaggagcuuccugucucuggaauggcagccucaguggugcugcaguccuaacauacgggguauugcucucucaccauguucccaggaacuccugucugaguccugugcauagaaucagccugacauggugacuaagggcccagggucaggagacagacccgaggccaaaugcuggcucugccugggacuagcuggucacuuaaccucucagaguuugucuccuuaucuguaaaauggggcuaugagcagacuugacucacagaguuguugggaagaaaauagaaacauaugaugcucagcugugggccaggcagauaguaaauaauaaaaaguuccaccagcagagucgcagauguccagcccagagccugucaucuccgggggagcugggagcacugcaggccagaguggccucccucagccccaccguuccccaggcugacuggggcuggggcaagccuggcuuugcaucccugggccugcuggggauuugcugaagcuccaauuucccauggcccuugggugcuaaccagggucccugcuggguugcagcucuuugaaagggaaccaaccaagaggcugggagugaccggaaacaucaaaauccaccccuucuucaagaccauaaacuggacucugcuggaaaagcggagguuggagccaccuuucaggcccaaagugguaugugauccugcccugugcugccuucaggcugagcuacuccucuccugcccucccucucuccugcaucauucacacgcuuuccaccucucccuucuuccagcaaucuccauagcauguucagucacagccgcugcccuuguauucucauccucucccuccugacucagucauucagcacacacuggggacuguggaucccacuguaugcagaggacccuguuuugggaaauagaguuaagaccucacuuuaucgcuccauucaauccauuuuccaauacauauggggaauccugagucccuguugaaugcagagcacagugcugggcugcacagcaaagugggagaugcagucccagaaccggaggagcucucagcuaguuggagagauaagaaacuugcacaccuaugacaauuugugauacgagaugacaguauaagagaugccccaggacacaugauccguugcuauugagugggucugucagcaggaacccagguggcagagaagagggugggucugagaggccccguuggaagaagugagacaagggacagcugggaggcauuccagguggaagaggggcugguucacucacaggcccagaaucuacagggcuaccaaggaaccagccugagagcagaggcagguggggccacuaagaaauuuggggcuguguggccccucugugaccacaguucuuccuucccacuccccuucuguccuuugauuccccuccuccaccagggcacacaguucccacugggcagccuguguaaugcgccccacauuugugcuuugaggcuacagagcacuuccccuacaccagggaccucaaacucagacguguccuggcugagcauguaacugacaggcuaggccagcugcaagaaaaucacacagccugcuuucagucucacuuuugauagauuuccuucuccgcacuaagaaacacaaagcaggugugauguaccccuugucaguggggcaggggcuguccagggggcucuuagcaccaagagugggcaggaagugggcccagggcugcuuuaaucugccaguuuucaaaagaagcuggaaaucuggauuuuuagguugcauugcucaauuuuaaaauauaaguucaggccgggcacaguggcccacaccagcacuuugggaggcugaggcaggcagaucaccugaggucaggaguucgagaccagccuggccaacauggugaaaccccgucucuacuacaaaaaauacaaaaaaaauuagccggguacgguggugcacaccuguaaucccagcuacucaggaggcugaggcaggagaaucgcuugaacccaggagguggagguugcagugagccgagaucgugccacugcacuccagccugggcaagagagugagacuccaucucuaaaugaauaaauaaauaaaaauaaauaaauaaaauauagguucaaauuccauuaaaacccaguacaagccgaaaugauuguacuugccaguucaguuuggcugaagggccaccagcuugcggucuuucuauauuaccaucccaucauauccucaggagcagagaaucagcaaauuucuccuguaaacagccugauaguauauauuuuaggcuuuucaggcuugauggucucaaagcaggcauagacaguaugucaacaaaugggcaugguuguguauuacaaaagcuuuauuuauggaaagugaaauuugaauuucaccuaauuuucaugucaugaaauauuuuucuuuugauuuuuuuuccaaccauuuaaaaaugugaaagccauucuuagcuugugguccccacaaaaacaggugguaagugagccucccugggcugugauucgguggucucugagcaagaggcuaccaccucuccuaacccaggcccagagcucccuggucacuuuccucauccucuuggggaaauggcagccuccuucccauggggcuccuuucaggcugcuaggggaggcucugucuucuguucugggugaggacagcucuggccuggcccagcccugcagggacuccagccuggggugucuggagggccauucccuagguccuguucgcucaccccugcccucugcuuguagaagucacccagagacuacaguaacuuugaccaggaguuccugaacgagaaggcgcgccucuccuacagcgacaagaaccucaucgacuccauggaccagucugcauucgcuggcuucuccuuugugaaccccaaauucgagcaccuccuggaagauugagguuccuggacagaucaggcuagcccugcccuccacccacaccugcccgcuccccacgauaagcaccagugggacuguggugacuucugcugcuggccccgccccugcccccagagcguccuuggcugccgucuggccgggcucucaugguacuuccucugugaacugugugugaaucugcuuuuccucugccuucggagggaaauuguaaauccuguguuucauuacuugaauguaguuaucuauugaaaauauauauuauauacauagacauauauauauauauaauaggcuguauauauugcucaguagagaaaaaccaugggggacuggugauauguugaucuuuuucaaaaaaauauauauaugacaaaaaaaaaaaaaaaggagcacaagcuguuugaaccaccagguuuauuugugugucuaaauaaaca

SEQ ID NO: 21512 - RNA, 9004 nt, Homo sapiens
cgggugacgcgacugggcccguugucugugugugggacugaggggccccgggggcggugggggcucccggugggggcagcgguggggagggagggccuggacauggcgcugaggggccgccccgcgggaagaugaauaagggcuggcuggagcuggagagcgacccaggugaggaggggaccgggagggccaggggcuggggaggccggaugggcccgggacgcgccugccugaccaucacccccuccucuugucgccccacccaggccucuucacccugcucguggaagauuucgguaagagccuuuucucccugccggaccggggcuguggcggcccaccccugcgcccucacucaucaggggcuguccuucccuacugcuuuccuuuccucaucgcaggugucaagggggugcaaguggaggagaucuacgaccuucagagcaaaugucaggggugaguggcuguacaccagggcugccccuuacacccagagugcuggggaaggucccagagaacagggccccuuagggaagacagugccaggaacccuacguuguaaaaucucacagaaagcagcagccuugcucucugagugcccgcuccugaucaaacugauacuuucuuuucucccaaacuuuccuuagcgcuucccuuuuuguagcagcccccuccccaccccuaagcauccuuugguucagcugcuuuccuggccuugcagcgggaagaccccggucacacaaugucuuuugugcaguuguguaauguauuaauuuuagugugcccauguguccuuggcuuuaauccugacacaaagucauccuguauugauugguuggggugacaaggccccuccugggugcccacacuuagagucuuuucccagugguccugcagaauagauguguaagagaguagcaacaguagcaaccgugacugaaccaagaagucuacuuuaauuuccuggaacaaaagagacugguguggguguucauuugcuuuccugacugcauuggggcccacaagugagaaggagugccucaguuccucaucagaguuuuuguucuugucuuacuuuguguuccuacccugucccauccuuggcccucaguuccagcuuuucuucucuuacccagaacuauagacuucauaaggagacuggguggacuccuggagcaucacagucagaggcuuaugcuuugcucugccuguggcaggccuuuggugugugagggcacaaggccacuucagacacaguguugggaagaagccaggggagaggggggaucacagcaaggacaccugagugaugacgcagugcaaaggauuaaugggagaaagaagggaaugcugauugucuucuccccuuuggcugaucuggcucugccccuuacuucccccagcccuguauauggauuuaucuuccuguucaaauggaucgaagagcgccggucccggcgaaaggucucuaccuugguggaugauacguccgugauugaugaugauauugugaauaacauguucuuugcccaccaggucugcuggacucugugcuuuguuuggagggugggaugcugccauguuuuugcuugggaaguggaaauggaggaagacaggaggaggagauaggcagauucuaggggugguagcuacagaaauccucuggcagaacgaacugaacucuuaauucauuaaagggaacagcuuuagaguaggagggugucugaguccacucucuguguccucagauauccaguggguauuugguaggugcuuguuaaaugaauaaacauuaggcaaagaugaaaggagcugagaaggggaguuguccagauaugacugaccugcucuggauccccauucuugauguauaugggcuuggggcuugcagugaggggugcuguguaugggugacuauucuugguuucacagcugauacccaacucuugugcaacucaugccuugcugagcgugcuccugaacugcagcagcguggaccugggacccacccugagucgcaugaaggacuucaccaaggguuucagcccugagguaggcugcagugccuucauccuggcucacagccaacugggcagaucugacccugagggccacugggaaugcuaccacaugauauuggguacuauuaggcuguuucuuuuucaaaugauuguuuauguuacauuugacucuuaaauaaauuguguaaggccauuguuuuuagaugcaguugcggggaaaggacacaggccuagggagggaggagaguuuccuuaagucagaccaugucagaaccuucucugucaggacuuuuccucucaggccauguugcuuccuaguguccacuaauuaccaugcaaggccagcacaguccaucucuuuggggcuccagagcucuuuucugcccccaccagccuuuuaagaaaguucgucuguguuccuuccgauuccuggaaugccuccaggcugcucucugaagcuuugccuuccacccauaguccuaccugaggagaaauuauucugauacggccuuauuuucuuccccguagagcaaaggauaugcgauuggcaaugccccggaguuggccaaggcccauaauagccaugccaggugugugggagcugugggagcugauguggggugggaguagggggaguaucauuuuuugggcccugacucuguuuuuccccaggcccgagccacgccaccucccugagaagcagaauggccuuagugcagugcggaccauggaggcguuccacuuugucagcuaugugccuaucacaggccggcucuuugagcuggaugggcugaaggucuaccccauugaccaugguaggcaccaugagcuggaggccuguugggugucucugccuaccuccuagggagcuggggcucagggcccucugguaugugguacccaguggcagggguugucgguaccgacacccggcucuggcugggguuucacccuacaccauauugcccgaccagcuccugauucccuggcucaacugcucuucucugucuuccuucccacuccuggccugcccaaacucaggguuuccuucucgcugauuccuugucuuggucuccacuagggcccuggggggaggacgaggaguggacagacaaggcccggcgggucaucauggagcguaucggccucgccacugcaggguaagggcccugugccugcccuguucuacucucuggagcuguaccuacuuugggagggacagagaguauccaggugauuuguaaauugcaaggccauauggugaaucuggcaagaucaggcuuagaucauggguucucaacuuguugucuuauuuccugccugggcugccuguggccugcuccugggugggcugggggaggggcaggccucaguggagccuuaggcagcccaggucugcugguucacuuccagauaggccccucauacagcuuguuggaagguaccagcucaggugccuggcauguauggcuagucgcugccugccuguugggguggggccuauaccuacagcugcaggugugacugcagggagcccugccaggauaucugccucaaccugauggcggggccggggcgggagcugcucucacggcugcggcugugacugcagggagcccuaccacgacauccgcuucaaccugauggcaguggugcccgaccgcaggaucaaguaugaggccaggcugcaugugcugaaggugaaccgucagacaguacuagaggcucugcagcagguaggugcccuuucuuccuggccucugcccagcccaacccucccugcauuccuccucccuucccccacagcauuugucucugauucgugaacauacucucuuguagaucugggcuucagcuaaccacaucuuuucuuugcccccauugugggaaaggugggacuuggaguggggagggagaauagcuucuaaaaggaaguuuggguuuggguguuuuauuucccugugagugaauggguagagccaaggccauuauuccuuuagguccucagcccuuagcuauuuaagguagaagcccgggucuacccuuucuccucugagcccuggauucuguuguuagcugauaagaguaacacagccagagcugauucagacccacaagucucaagagucacagcugccugaggaguccaagucagccagcaacaaguccccgcuggugcuggaagcaaacagggccccugcagccucugagggcaaccacacagguacugggggguuugggaccucuuguggaccucagagccacccgcuaaugucugacaugggaggccuaaacagggaaagucuuuuucuggggauguccuugggcaguguucuucccccgucagaagguagagggagagcaguccuucccuaaagaaaggcaccuguaaagggccgcuguuaccacaggccccugggcccuucucuguaauguacacucccuuucuuguuuucucuagaggcgguuuuuuuuuuuuuuuuuuuuuuuuuuuuucuuccugcuucuuuuuucccaucucauucuuugcccugucucauugcgggaucaugacuuagagcuugcugacucccauugcaccagcuggcugggcuguucuucucugggaagugcugguucacagggccggggagacugugagcuuuucuuggagauccuacuggagguccugccuguguucuugcccugucucagauggugcagaggaggcggcugguucaugcgcacaagccccaucccacagcccucccaacaaacccaagcuaguggugaagccuccaggcagcagccucaaugggguucaccccaaccccacucccauuguccagcggcugccggccuuucuagacaaucacaauuaugccaagucccccaugcagguaagcugggagcacccuugcaggauucucuacuugauucucuugagaggcugcaacaggcaauuuucccaugugguuccuugguguucauccuuggcauggcugggucaagcugccugggccuggguugcuagguuccucugccugauaugaaaaggcccccacaacagcaggagcuuagggaggcagggagagcuccuuugaauuuaaucuaguuacguggcugugggauuaaauguuuaggucacgcuccuugguacaacuucauggguuggguuuuacuggcaaaauaaaggcauguguuucagggcacucuguuucucuuaaaaccccuccgugggguucuauccaguguaaguggguggcagccuccccacaagccaaggacaggccauggaacagcuggagggguuccgcugacucagucuggaaaaccauguuggcuuucucucuggcugugagugucuaggcucagccugggccgagcagcacuuguuuguaacugcccuggucuuugucccaggaggaagaagaccuggcggcaggugugggccgcagccgaguuccaguccgcccaccccagcaguacucagaugaugaggaugacuaugaggaugacgaggaggaugacgugcagaacaccaacucugcccuuaggucagcccagcuuucuaaggcuaccagguucuaggugcuucggaucccauccugaauaucucagucugugucugagaaugcccugcagcagauaauguugagcaccugcggaguuuggggcccugggggaggcuggcaugauggggcugaccccagguccccaggaaguuuuuggugggcugggggguaaggcugagcacguaagcuuauaucauguccuauuggaaguggccuuuuagccaggccuugaaggauugguuggggcagggauggaggagaugugggugguggggaggcagcuuugcuggaacacagggcauuggcaaaaggccaggagugggauggcuggaauagaggaagugucuuuugaggacacuuggcugcagcugucagaacuugaugccaggcuuagcauggcuaguucaaguugcuuggaccaaguauaaggaguuuuagggucagccccuggaggucgggauguauuuaagccauucuggguacugcuggguauggucaccuggcccguucccuugcuucacaucuucucgggccccacagguauaaggggaagggaacagggaagccaggggcauugagcgguucugcugaugggcaacugucagugcugcagcccaacaccaucaacgucuuggcugagaagcucaaagagucccagaaggaccucucaauuccucuguccaucaagacuagcagcggggcugggaguccggcuguggcagugcccacacacucgcagcccucacccacccccagcaaugagaguacagacacggccucugagaucggcagugcuuucaacucgccacugcgcucgccuauccgcucagccaacccgacgcggcccuccagcccugucaccucccacaucuccaaggugcuuuuuggagaggaugacagccugcugcguguugacugcauacgcuacaaccgugcuguccgugaucuggguccugucaucagcacaggccugcugcaccuggcugaggauggggugcugaguccccuggcgcugacaggugggccuuggacuggcucacuggccacuuggugcacccaggagggaggagggaaguggccaagugaccacaaaguguccugcacucugaugauuuucuugugaccucucuucccagagggugggaaggguuccucgcccuccaucagaccaauccaaggcagccagggguccagcagcccaguggagaaggaggucguggaagccacggacagcagagagaagacggggauggugaggccuggcgagcccuugaguggggagaaauacucacccaaggugagccuccguugugguuuucuccuuuaauccuggcagaggguaaggccugagcuccuccugcccaggugccaaguucuugauuggaacuuuggugugaagauugguggcuggagccaugugccagaagacuuucuggguugggugguggcaggggccuugauaggcauggacucgcugcucauccuugccucuagcugccuauugcucguggggcuuuguugcuggcccgccccgaucagaggugcaaugcuggguuuuggcaggagcugcuggcacugcugaaguguguggaggcugagauugcaaacuaugaggcgugccucaaggaggagguagagaagaggaagaaguucaaggugggugauuucuccaguugccugaucuggccucucccgagguccacugguggcugcucuggcaagauuggcuccagugcucucagucuucuucucuccuacagauugaugaccagagaaggacccacaacuacgaugaguucaucugcaccuuuaucuccaugcuggcucaggaaggugaggggaugcgcugcugucuuaacuggaaugcccugcugagggccguguccuucagcuccccuccccuggccucuccugaggcuugagcagaccuuggggcacagggagggccaugagagccucagcuccuggccugaggcagccagcaccugcucaagggucucuaccucuucgcaggcaugcuggccaaccuaguggagcagaacaucuccgugcggcggcgccaaggggucagcaucggccggcuccacaagcagcggaagccugaccggcggaaacgcucucgccccuacaaggccaagcgccagugaggacugcuggcccugacucugcagcccacucuugccguguggcccucaccaggguccuucccugccccacuuccccuuuucccaguauuacugaauagucccagcuggagaguccaggcccugggaaugggaggaaccaggccacauuccuuccaucgugcccugaggccugacacggcagaucagccccauagugcucaggaggcagcaucuggaguuggggcacagcgagguacugcagcuuccuccacagccggcuguggagcagcaggaccuggcccuucugccugggcagcagaauauauauuuuaccuaucagagacaucuauuuuucugggcuccaacccaacaugccaccauguugacauaaguuccuaccugacuaugcuuucucuccuaggagcuguccuggugggcccagguccuuguaucaugccacggucccaacuacaggguccuagcugggggccugggugggcccugggcucugggcccugcugcucuagccccagccaccagccugucccuguuguaaggaagccaggucuucucucuucauuccucuuaggagagugccaaacucagggacccagcacugggcuggguugggaguagggugucccagugggguuggggugagcaggcugcugggaucccauggccugagcagagcaugugggaacuguucaguggccugugaacugucuuccuuguucuagccaggcuguucaagacugcucuccauagcaagguucuagggcucuucgccuucaguguuguggcccuagcuaugggccuaaauugggcucuaggucucugucccuggcgcuugaggcucagaagagccucuguccagccccucaguauuaccaugucucccucucagggguagcagagacaggguugcuuauaggaagcuggcaccacucagcucuuccugcuacuccaguuuccucagccucugcaaggcacucagggugggggacagcaggaucaagacaacccguuggagccccuguguuccagaggaccugaugccaagggguaaugggcccagcagugccucuggagcccaggccccaacacagccccauggccucugccagauggcuuugaaaaaggugauccaagcaggccccuuuaucuguacauagugacugaguggggggugcuggcaaguguggcagcugccucugggcugagcacagcuugaccccucuagccccuguaaauacuggaucaaugaaugaauaaaacucuccuaagaaucuccugagaaaug

SEQ ID NO: 21513 - RNA, 8285 nt, Homo sapiens
acucagauuccucuacaguuuauuguuauagcagaaguugugggagacgggagggcacccuccacacauacuacaguguggucagagccccaggguagcccuuuccacccuaugccaagccccaagcagcccagcccaagcuuagcucccuccccagucccacucuagaugcacacugagcuaccaaaguuagugcagccaaacggccccaggccccuuccuguugccccagcaccaauccuuccccacacucguucacugcccgccaacucccauuccaacuuccuuuuuacacuggauguuucuaucacauccugaggaccacuaacccaccagcaagucucccccugacacacauucacguagguccauacccuucagaguccuaaaggguuaaugagaagccaccucagcuuuggugaauggagccccagccccaaauccccuccccuugcaaauaugggacaaguagggagagucugauggaggcaccaggacaacuacaacaaccucuuaccccucagcuauagacaccuagaucaggacagaggaugcauaugcccucuccaccuuaacaucaaaaugggggaggaggagaauuuaggggucugggucccuaagagauauuaggacaucucuuccaggagcuggggggaaucacggguuaaaggucaagguuaggguagcaaucaaagaucaaggucaucuccccgcaugaucugcccuuuuucccuugcuuacgguggcccaaugccccuucagcaccucccagguuagcucugggggaggugagggcugggucccacucuagggcaacaagggccauucaacaggagaccuccauggugugccccgggggccccgaagaaagaguuccagacucgcugcucugggacagggugcgagagcgggaccgguugccaucaacggaugcugcacuggucagagaggcuguacgagaccgggacaggcgagucaugcaggaugaggccacuguggagacagcacgaugcacaagcagucagagaggaaguggggaaggggggcuggcgacucagggugugguccuuggauuauggacuaguuauaacuaagccaggggaucaacgagcucgauugggcagauagcggugaguccaggcauucaccuaaaacgguuccaccccgucagugccuaucucuccucuagugcagcaagcucuugucccgauacucacuguagcccaugccuugcaggaaguacuugaaggccucggucagcuugccuggcugcggaaguaagaagaggcgagggagacggugagaugagguuagaggaagagcuggagccugaggcugcggcacuguggggccggguguguggcaaagggcagagcccagugccaccgguauccuaugucccuuccccaucccauggacggcagcggcacucaccugagucagcuggggcugaccuccggagucagccaucuguucaggagagcaccacccagaaaaagugaaacacacauaaaugagccaugcagagagguggaaagggucucucuucccuagcuucuucacucuagccccuuuguuuuguucuucguucaccccauuugcucccaugccgggcccuggaggcuuagcagcugcauguagagaggauauaugacuguggacgggggcccaggaacagguuacugaccuugaggaacgaggucugggugggguccaguuuugaguuacauuccaccuggaguaagcaggaggcugaaugaaugaggucacgcccacuguggcgccucccccguaagggacccaggaacccagaccccagucccuuuucuaucagcucccuacccaguuccuccuuaccaggaaucaaauucuuagugccccaaaguugaucucccugugccaaacaggacauccccuuggcaagauacucuucugaccaccacuuuaggaccccaacccuccucccucacucaccccaaaauucccuacuaaccacugcaucuucaugaggugcuuggucuccuaccaccagcaucacaggacaccuaaagacacaguguuggggagaaggcagugagccccuggcacucccucacuggccucugccuaggagugcagcuggaaaaauaucuggcuccaaagaggaaagacacuucugugucucccugcugaugccaccaagaggauucaaagggggaagaccuagagggaagugauuuaccaaauaggauggggugggacaugacaaggaaguucccuggcaaaagauucuccuucuucuaagggacacaagcuccuagggaagauccagggagacaggcaaugcauuaucucuuaaagucuuaccugagggugauaucaccuccacgcucaaaguucaggucucggcggcuagaaagggguuaaaagaguaggaauuuuaggugggcaaugcuaucuaaccagauauaagcuaucucucccaugauggaacuaucuuugucuaaaaauuacggucaaaucuugguuauuaaagguggaaaccaaaggagaaaggggcaggcaggccccaagcacagccccuauagucacuugugcccuagaucccuggucagagggcaacaaaaggggaggaaggacacaggacacaagaucaucuuacuucugggaguccaauaauccaaaggagguaaacaagagaagggggacagccccuugcaauccuucccacugacucuguccugaagcugcccccauugcacacuaaaugcugcauuccuugcacauugcacacuacccagacuucccucuccuccucugugccucccccaugacgcccaauuacugcuucugcauuucucucacaugcauacacacacagcccacccacuuguuguagcuguuccaguacaauucaauguuauccagguugggugcauguguaaugauauuucuguacuuuuguaucaacucagaauuuccagagagcucuuccugaaggagagaacaaggagaaaaauuagggauggaaagagaaaacaacaauuacuggaggaaaagagguaagccuucuuccuuccccaaauccugucccagcuaaggaaguuagcccaagcauucaaguucccugcugcucccgucgacucuucuacaucuccuacacccacuuaccuggcugaaaagauguccaaggaucaucuccggaauggaagaggugaggccuguuagcuaugaggagaaggcaggugagaaaguucaggguauuggccaggcacaguggcucacgucuguaaucccagcacuuugggaggccgaggcggguggaucacgaggucaggaguucaagaccacccuggccaagauggugaaaccccaucucuacuaauaauacaaauauuagccaggcgugguggcgggugccuguaaucccagcuacuugggaggcugaggcaggagaaucacuugaacccaggaagcagagguugcagugagccaagaucaagccacugcacuccagccuuggcaacagagugagacaccaucucaaaaaaaaaaaaaaaaagaaaaagaaaaagaaaguucaggauauuauaagagacucaggcaaagugacagcuucacuuuccugccccuuuacucccuccuugaaguucagaguccauccaguuaggcuaucuaccagagccuaacuggauccauacgaggggauccccaaccguaggucucagcacacaggccccuccaaaccuugugggcugcccaauccauccaacccuuggcauugggaucaauguugaugaggacaagaccuucaacaguguccgggugguuaagcugagggacagcagaaggaaggaaaugagaaacagggcauggccuuauccccuccccgcuaagcucgacccacuccuggacucccacagggccugacuccccaccuagugcccacuuccucccccaaacagcacuaauaaacaguauucuccuaaucagucuggacccuccuuucccuccucugggcuuuuuauuucuuacagcauaucucgccaggauguaggcuccagcuccaacaccaacuccaauuauuguagagaaacugugaaagggaaagaaauauacgccucaugggaucugcuguccaaaaccugccacagcccaucucuucaaacucuucacccucccuccugaguccacgggcacaaagaaaggcagacacggaccuuucuuuggaggacgcgaaaaagaagggcccaagaagccaaagguuggcacggguagucaggguagauaccugaagucuauccccagcuuucugcuggagagcuagugucuuaaaaacaaacacccauccaccagccaaccaacacacuguuuucccauauagauagcucuuuguccauucucaauuuucaagagccaguucaacuuguucugcuuuaguuccugguuccucuagaggaacgggaagaauggaacuuaaagcaaaugugaaaacagacacaauuuuagugaacaauggagagaaugaggaaaagaguggcaaaguggugaaccagagcugcugagcccuggugccuaggagaagcuuagcuaagaacagcacccaggggccagcaccucccucugaauaccaaagacacuuggucugguguucucuuccuuccccaacucucucucacccgcagagcuccccauccaccaggugugggcaugaaggagaggggagugggagagaaagagacaggucuaucugguuccucagggauuaugucacccccuuucauuccucccugacuuucugaucagagaaggcccuccuuagccugaggcagggccaagcauagacccuuuuccuucccuccacccauuagggcuauucuguugacucuggccaauuuuccaaacccaccaccuuuucucaauaaucaaggcgggagcaugaaggaagaagauauauugaguucagaagcugaaacuggcucaggaaccacggugaaccuggaaguucuaagggucuccuugugcuggaaagagaacucugguuuggagggguucccaggccucucacuuuagguacugcaggacgcaagggaucaugucugcaagcugguccagagauggguacugauaucuggaaaagagaggcauguuaaggaagauaccaaccugcccucacaccccccaccucaggauguccuacucauucucucccagaauaaccacugcccucccuuuccuccuccccagucgaaccuuucccgcaccuguccuguuccucacagucuggugaagcaguaacgaccuaacucuuaccccaaagggaacacaggggcucccucuuccauuccaggggcauccacaugaacccgcacaaaguucugaaugauuuccugcauguccucgaacugaaacaguggcuggaagcaagauuuaucuaaagagaacccacaucaccucaacaauagaaucagacagggacucgugucccccagucagaacucacccuuccuuucaugccacagucagaccaggagagaacuucuccuucccacacugaccccuccccucccucuggguuucauuucuacccuucccccacagccucuucccagacaggagugggagaugaaugaagguccuuacaguugagucccacaucgugguagguaaggaucgcugggcguuuggguuugggggugccauagacagugaaagugacagagccguauggugucuccacagagugagucugcaggaaaacagggcaccaagagcuaggcucagaggagacgaggccagaaaaggagcaacaccaaggucagggagcugggagugggugggcaagagggaaaagggaacaaagaauuaaaaacaggaucagcaagaauugaggaaaacaugauaccggaagaugaguuugaggauaagaaagaauaaugaagauuagagagagaagaggaggggaaggaaggagaggggagagauagggaagggaaaggacuagaauagaaggaaagaaagcaaagagagaagagagggccaagcagaggccauccuucuacuggggaagaggacagccccuccucccaccuugggacugcccccacacuguuaccugucccugguccaggaggauucgggcagcuaacucagccuccuggagagacacacacggauucacacagaaacacaugaccauguggcgucccagauggagagacaaacagacaaagagaggcaaguaaagacagaccaacaaaugaccaaagacagaaagagauugacaaagagagacacggaaaggaugaagguuaguguagugacgagacaagggccugacucccaauuauaguguauggggagagagacuaggguaguggugaagcaguggugugaguuagaauaagaucaguacgcuugggaaguuagaaggcaagggggaugcuuagaggucuggaauuugggcaugggagucaaacggucucuaauaaccuuggccgccucaggcgucuguccuggcaacaguggcuucuccucugugaucugcaccuccugcagcuccgccaugguggccuggcaggaugaggaaaugagacugggaaguugucucuacauccccacaucgccucaaacaccaggcuuccucucucagcacaggaagaugcagggaacagagggacccagggguugaagacuacucuagaacacacagagggccuuuccugcccccagcuccguuuccaggcugaucgguggaagcuuuggaagaggaaucaggacagcccuucucuugauacucaccauccccacugccacccucaacaccacaccuccagaccccucccuccucugcccuggaccaaaauaccaggguggggcagaaguguagcucagauuucucgggcuauauuuaggggccaccccacacucucagguagggagugaaacuuguagcucagugacugaguauucuaaaggacaggguaccaaaagacgggacugugagaguucacaauugaccaugaccuucaauuaaagccccaaagucggcagcucaaagggggcuaaaaaugaccaaagcaacaugaccaaugggggagguggggaaaacaacauaaaagggacaucuguccaaccaacccaaugccucccuuccucccaagacccuuccucccaacucugaauaaacuccgcaaguucaacauuagugggugaggagcagagcaccuggacagaccugcacaggaaggagccugcagccugcgggguggggucacuuacugggcuccuauuggcuggaugcagugggauuaggggucaggguucucacuccuucugacucuggggucugagaaaacacagcaacgaggugaaugacaugggagacagaccuggggucuuucagggacggaaagccucagccaagacccagacucccagggucaucaaccuccucgggucacuaacccuccccagugucugucuaccccuaaguccagagaacacguccucucuaggcucgagccggaaucaauauaggcuacaagggcaucaguucaggcugcgcggaggagagaaggaagugcugauguggagguaagaggguggcccugucagaaccuccggauucgaaucccggcucugccacucccagugugaccuugccccaguuaguuacuacauuuggccucaauuuucuaucugcagggggacuaaacgcgggggaauaggggauccccaaaauuuuugacagcucuccaguaagaggaggguagcagagcauggcuguuucccuccacaauuuaaaaacaaacacaaagauuggugccgucgcuucucuccucuacucagucuccguguaggucccacgaguggagaaagggagaggagagcggucccacaaucuucucccguucucccccgacggcccgcgaaggcaagcgccaucgggaagggauggguaggacagaggagaccggccgggcccagcacccggaacccgucccuacgagucccuacgcagcccguccgcguggagacugacacccuugcguggccggugccaagcgccccggaccuugcacacaaccucgcgcgcaccccaaacacgcccugcagcucuuggagccucagccuuugugcgcagcaaccgagcgcccgcuccgugcuggcccuuucccccgagccuccagcuccaggggacgcggaucaaucacaccgcccgccggcccggcuggcgccuuccaggcccuacggccccucgccugccccucccccuaccugcugccgccgcggccgcuuccacc

SEQ ID NO: 21514 - RNA, 8285 nt, Homo sapiens
gguggaagcggccgcggcggcagcagguagggggaggggcaggcgaggggccguagggccuggaaggcgccagccgggccggcgggcggugugauugauccgcguccccuggagcuggaggcucgggggaaagggccagcacggagcgggcgcucgguugcugcgcacaaaggcugaggcuccaagagcugcagggcguguuuggggugcgcgcgagguugugugcaagguccggggcgcuuggcaccggccacgcaagggugucagucuccacgcggacgggcugcguagggacucguagggacggguuccgggugcugggcccggccggucuccucuguccuacccaucccuucccgauggcgcuugccuucgcgggccgucgggggagaacgggagaagauugugggaccgcucuccucucccuuucuccacucgugggaccuacacggagacugaguagaggagagaagcgacggcaccaaucuuuguguuuguuuuuaaauuguggagggaaacagccaugcucugcuacccuccucuuacuggagagcugucaaaaauuuuggggauccccuauucccccgcguuuagucccccugcagauagaaaauugaggccaaauguaguaacuaacuggggcaaggucacacugggaguggcagagccgggauucgaauccggagguucugacagggccacccucuuaccuccacaucagcacuuccuucucuccuccgcgcagccugaacugaugcccuuguagccuauauugauuccggcucgagccuagagaggacguguucucuggacuuagggguagacagacacuggggaggguuagugacccgaggagguugaugacccugggagucugggucuuggcugaggcuuuccgucccugaaagaccccaggucugucucccaugucauucaccucguugcuguguuuucucagaccccagagucagaaggagugagaacccugaccccuaaucccacugcauccagccaauaggagcccaguaagugaccccaccccgcaggcugcaggcuccuuccugugcaggucuguccaggugcucugcuccucacccacuaauguugaacuugcggaguuuauucagaguugggaggaagggucuugggaggaagggaggcauuggguugguuggacagaugucccuuuuauguuguuuuccccaccucccccauuggucauguugcuuuggucauuuuuagcccccuuugagcugccgacuuuggggcuuuaauugaaggucauggucaauugugaacucucacagucccgucuuuugguacccuguccuuuagaauacucagucacugagcuacaaguuucacucccuaccugagagugugggguggccccuaaauauagcccgagaaaucugagcuacacuucugccccacccugguauuuugguccagggcagaggagggaggggucuggaggugugguguugaggguggcaguggggauggugaguaucaagagaagggcuguccugauuccucuuccaaagcuuccaccgaucagccuggaaacggagcugggggcaggaaaggcccucuguguguucuagaguagucuucaaccccugggucccucuguucccugcaucuuccugugcugagagaggaagccugguguuugaggcgauguggggauguagagacaacuucccagucucauuuccucauccugccaggccaccauggcggagcugcaggaggugcagaucacagaggagaagccacuguugccaggacagacgccugaggcggccaagguuauuagagaccguuugacucccaugcccaaauuccagaccucuaagcaucccccuugccuucuaacuucccaagcguacugaucuuauucuaacucacaccacugcuucaccacuacccuagucucucuccccauacacuauaauugggagucaggcccuugucucgucacuacacuaaccuucauccuuuccgugucucucuuugucaaucucuuucugucuuuggucauuuguuggucugucuuuacuugccucucuuugucuguuugucucuccaucugggacgccacauggucauguguuucugugugaauccgugugugucucuccaggaggcugaguuagcugcccgaauccuccuggaccagggacagguaacagugugggggcagucccaaggugggaggaggggcuguccucuuccccaguagaaggauggccucugcuuggcccucucuucucucuuugcuuucuuuccuucuauucuaguccuuucccuucccuaucucuccccucuccuuccuuccccuccucuucucucucuaaucuucauuauucuuucuuauccucaaacucaucuuccgguaucauguuuuccucaauucuugcugauccuguuuuuaauucuuuguucccuuuucccucuugcccacccacucccagcucccugaccuugguguugcuccuuuucuggccucgucuccucugagccuagcucuuggugcccuguuuuccugcagacucacucuguggagacaccauacggcucugucacuuucacugucuauggcacccccaaacccaaacgcccagcgauccuuaccuaccacgaugugggacucaacuguaaggaccuucauucaucucccacuccugucugggaagaggcugugggggaaggguagaaaugaaacccagagggaggggaggggucagugugggaaggagaaguucucuccuggucugacuguggcaugaaaggaagggugaguucugacugggggacacgagucccugucugauucuauuguugaggugauguggguucucuuuagauaaaucuugcuuccagccacuguuucaguucgaggacaugcaggaaaucauucagaacuuugugcggguucauguggaugccccuggaauggaagagggagccccuguguucccuuugggguaagaguuaggucguuacugcuucaccagacugugaggaacaggacaggugcgggaaagguucgacuggggaggaggaaagggagggcagugguuauucugggagagaaugaguaggacauccugagguggggggugugagggcagguugguaucuuccuuaacaugccucucuuuuccagauaucaguacccaucucuggaccagcuugcagacaugaucccuugcguccugcaguaccuaaagugagaggccugggaaccccuccaaaccagaguucucuuuccagcacaaggagacccuuagaacuuccagguucaccgugguuccugagccaguuucagcuucugaacucaauauaucuucuuccuucaugcucccgccuugauuauugagaaaaggugguggguuuggaaaauuggccagagucaacagaauagcccuaauggguggagggaaggaaaagggucuaugcuuggcccugccucaggcuaaggagggccuucucugaucagaaagucagggaggaaugaaagggggugacauaaucccugaggaaccagauagaccugucucuuucucucccacuccccucuccuucaugcccacaccugguggauggggagcucugcgggugagagagaguuggggaaggaagagaacaccagaccaagugucuuugguauucagagggaggugcuggccccugggugcuguucuuagcuaagcuucuccuaggcaccagggcucagcagcucugguucaccacuuugccacucuuuuccucauucucuccauuguucacuaaaauugugucuguuuucacauuugcuuuaaguuccauucuucccguuccucuagaggaaccaggaacuaaagcagaacaaguugaacuggcucuugaaaauugagaauggacaaagagcuaucuauaugggaaaacaguguguugguuggcugguggauggguguuuguuuuuaagacacuagcucuccagcagaaagcuggggauagacuucagguaucuacccugacuacccgugccaaccuuuggcuucuugggcccuucuuuuucgcguccuccaaagaaagguccgugucugccuuucuuugugcccguggacucaggagggagggugaagaguuugaagagaugggcuguggcagguuuuggacagcagaucccaugaggcguauauuucuuucccuuucacaguuucucuacaauaauuggaguugguguuggagcuggagccuacauccuggcgagauaugcuguaagaaauaaaaagcccagaggagggaaaggaggguccagacugauuaggagaauacuguuuauuagugcuguuugggggaggaagugggcacuagguggggagucaggcccugugggaguccaggagugggucgagcuuagcggggaggggauaaggccaugcccuguuucucauuuccuuccuucugcugucccucagcuuaaccacccggacacuguugaaggucuuguccucaucaacauugaucccaaugccaaggguuggauggauugggcagcccacaagguuuggaggggccugugugcugagaccuacgguuggggauccccucguauggauccaguuaggcucugguagauagccuaacuggauggacucugaacuucaaggagggaguaaaggggcaggaaagugaagcugucacuuugccugagucucuuauaauauccugaacuuucuuuuucuuuuucuuuuuuuuuuuuuuuuugagauggugucucacucuguugccaaggcuggagugcaguggcuugaucuuggcucacugcaaccucugcuuccuggguucaagugauucuccugccucagccucccaaguagcugggauuacaggcacccgccaccacgccuggcuaauauuuguauuauuaguagagaugggguuucaccaucuuggccaggguggucuugaacuccugaccucgugauccacccgccucggccucccaaagugcugggauuacagacgugagccacugugccuggccaauacccugaacuuucucaccugccuucuccucauagcuaacaggccucaccucuuccauuccggagaugauccuuggacaucuuuucagccagguaaguggguguaggagauguagaagagucgacgggagcagcagggaacuugaaugcuugggcuaacuuccuuagcugggacaggauuuggggaaggaagaaggcuuaccucuuuuccuccaguaauuguuguuuucucuuuccaucccuaauuuuucuccuuguucucuccuucaggaagagcucucuggaaauucugaguugauacaaaaguacagaaauaucauuacacaugcacccaaccuggauaacauugaauuguacuggaacagcuacaacaagugggugggcuguguguguaugcaugugagagaaaugcagaagcaguaauugggcgucaugggggaggcacagaggaggagagggaagucuggguagugugcaaugugcaaggaaugcagcauuuagugugcaaugggggcagcuucaggacagagucagugggaaggauugcaaggggcugucccccuucucuuguuuaccuccuuuggauuauuggacucccagaaguaagaugaucuuguguccuguguccuuccuccccuuuuguugcccucugaccagggaucuagggcacaagugacuauaggggcugugcuuggggccugccugccccuuucuccuuugguuuccaccuuuaauaaccaagauuugaccguaauuuuuagacaaagauaguuccaucaugggagagauagcuuauaucugguuagauagcauugcccaccuaaaauuccuacucuuuuaaccccuuucuagccgccgagaccugaacuuugagcguggaggugauaucacccucagguaagacuuuaagagauaaugcauugccugucucccuggaucuucccuaggagcuugugucccuuagaagaaggagaaucuuuugccagggaacuuccuugucaugucccaccccauccuauuugguaaaucacuucccucuaggucuucccccuuugaauccucuugguggcaucagcagggagacacagaagugucuuuccucuuuggagccagauauuuuuccagcugcacuccuaggcagaggccagugagggagugccaggggcucacugccuucuccccaacacugugucuuuagguguccugugaugcuggugguaggagaccaagcaccucaugaagaugcagugguuaguagggaauuuuggggugagugagggaggaggguugggguccuaaagugguggucagaagaguaucuugccaaggggauguccuguuuggcacagggagaucaacuuuggggcacuaagaauuugauuccugguaaggaggaacuggguagggagcugauagaaaagggacuggggucuggguuccugggucccuuacgggggaggcgccacagugggcgugaccucauucauucagccuccugcuuacuccagguggaauguaacucaaaacuggaccccacccagaccucguuccucaaggucaguaaccuguuccugggcccccguccacagucauauauccucucuacaugcagcugcuaagccuccagggcccggcaugggagcaaauggggugaacgaagaacaaaacaaaggggcuagagugaagaagcuagggaagagagacccuuuccaccucucugcauggcucauuuauguguguuucacuuuuucuggguggugcucuccugaacagauggcugacuccggaggucagccccagcugacucaggugagugccgcugccguccaugggauggggaagggacauaggauaccgguggcacugggcucugcccuuugccacacacccggccccacagugccgcagccucaggcuccagcucuuccucuaaccucaucucaccgucucccucgccucuucuuacuuccgcagccaggcaagcugaccgaggccuucaaguacuuccugcaaggcaugggcuacagugaguaucgggacaagagcuugcugcacuagaggagagauaggcacugacgggguggaaccguuuuaggugaaugccuggacucaccgcuaucugcccaaucgagcucguugauccccuggcuuaguuauaacuaguccauaauccaaggaccacacccugagucgccagccccccuuccccacuuccucucugacugcuugugcaucgugcugucuccacaguggccucauccugcaugacucgccugucccggucucguacagccucucugaccagugcagcauccguugauggcaaccggucccgcucucgcacccugucccagagcagcgagucuggaacucuuucuucggggcccccggggcacaccauggaggucuccuguugaauggcccuuguugcccuagagugggacccagcccucaccucccccagagcuaaccugggaggugcugaaggggcauugggccaccguaagcaagggaaaaagggcagaucaugcggggagaugaccuugaucuuugauugcuacccuaaccuugaccuuuaacccgugauuccccccagcuccuggaagagauguccuaauaucucuuagggacccagaccccuaaauucuccuccucccccauuuugauguuaagguggagagggcauaugcauccucuguccugaucuaggugucuauagcugagggguaagagguuguuguaguuguccuggugccuccaucagacucucccuacuugucccauauuugcaaggggaggggauuuggggcuggggcuccauucaccaaagcugagguggcuucucauuaacccuuuaggacucugaaggguauggaccuacgugaaugugugucagggggagacuugcugguggguuagugguccucaggaugugauagaaacauccaguguaaaaaggaaguuggaaugggaguuggcgggcagugaacgaguguggggaaggauuggugcuggggcaacaggaaggggccuggggccguuuggcugcacuaacuuugguagcucagugugcaucuagagugggacuggggagggagcuaagcuugggcugggcugcuuggggcuuggcauaggguggaaagggcuacccuggggcucugaccacacuguaguauguguggagggugcccucccgucucccacaacuucugcuauaacaauaaacuguagaggaaucugagu

SEQ ID NO: 21515 - RNA, 3710 nt, Homo sapiens
cuagggcugagggaggggccgugacaccagccccgccccccagccaccugggaaaaggaagcacaaaaaggagaagcagcaacggcugcucugcuuccuucccaucucgcucuugggucaugccuggccagcagaaagcagcuccauaggggaggagagccacgcaggaucucacagcugcagucuaauaguaacacagagguaauuuuaacuuuuuacuuuucuacccuugggaguagggaugaguagaggcuuaccuccuuccagaggcagcucauauccccccacccccauucccggaaguugagaugucucuucucuguuccacgcaggcaucgucuaaguugggaacaggucuuaugucuuaaaauuugggauucuuuaaaaacauauguggcugggcacaguggcucacgccuguaaucccagcacuuugggaggccgggcagguggauaauuugaggucaggaguucaauaccagccaggccaacauggugaaaccucgucucuaauauaaauacaaaaaguagcugggugguaguaguagcuguaaucccagguacucgggaggcugaggcaggagaaucccuugaaccuaggaggcggagguugcagggaggcagagguugugaugagccaagauugcaccacugcacuccagucugggugacacagugagacccugucucaaaacaacaacaaaaaugugugauggcacaugcccauagucccagcuacuggggaggcugaggugggaggauggcuugagccugggaagucgaggcugcagugagcugugaucaugccacugcaguccagccugggcgacagagugagacccugucucaaaacaaaacaaaacaaaacaaaacaaaaaaacccaaaaacaaacaaaaaagcacauguggaguguuguagaagucauugaccuugguaagacaguggaggaaacugcuuugcucugacucauaaauuugcccccaguaaacaguauuuauaaauagccccagucaggcacugcaugaagacauuucagucaacgacagaccacauauacaacgguggucccauaagauuauaacagagcugaaaaauuccuauuuuucagcuuaguguuguggugcaaccacuaccuuuucuauguuuagauacacgaauacuuagcacuguguuacaauagccuacaguacccauuacaggaaugcuguaccgguguguagcccaggagcaaugggccauaccauauagccuagguguggaguagacuagaccauccacguuuguguaauuacaaucuaugauuuuguaaaaugaugaaauugccuaaugaagcauuucucagaauguguccccgucauuaagugacaccucacuguguuuccaagacauaguacugguccuugggaagcucuaaagagaggucaccgugagcugaaccauccuucucacucugugcauggaacccagcuuagcuuccauuucagcauuuaggcuuauaggaggagaagagguuagaagccacagaccagcaagaauugaagacaucguucuguaauuucuacugaaccagcucugucugacuggaacuucauuuugccucuuugcuuuaacuccucaggaaugucuuccaggaggccccugaucuucucugcucagggaccacucuuaucugacccagagacagguuagcugauggugacucacacauccucacuuccuucaaagcccaggcaucuguuuaaaaucugacccugugaagacuuuuccuguuuuggaaaaacucuuccguuguuugccugcacagauuugugcuccauuuuuaauuucaauuuuuguagagaaggcggguccuugcuuuguugccucggcuuguuugaaacuccugggcucaagugauccuccugccuuggccucccacagugcugggauuacaggugugagccacugcaccaggauggauuugucuuccuucagaagacaguagcugaugugugcccuggccuuucuccccuaggauucagcaguggccaccauggguucugugaauuccagaggucacaaggcggaagcccagguggugaugaugggccuggacucggcgggcaagaccacgcuccuuuacaagcugaagggccaccagcugguggagacccugcccacuguugguuucaacguggagccucugaaagcuccugggcacgugucacugacucucugggacguuggggggcaggccccgcucagagccagcuggaaggacuaucuggaaggcacagauauccucguguacgugcuggacagcacagaugaagcccgcuuacccgagucggcggcugagcucacagaaguccugaacgaccccaacauggcuggcguccccuucuuggugcuggccaacaagcaggaggcaccugaugcacuuccgcugcuuaagaucagaaacaggcugagucuagagagauuccaggaccacugcugggagcuccggggcugcagugcccucacuggggaggggcugcccgaggcccugcagagccuguggagccuccugaaaucucgcagcugcaugugucugcaggcgagagcccauggggcugagcgcggagacagcaagagaucuugauccagacagagcagcauaucuuugcucauacaaacuagaagaaccagcugauccuugagaaauuuacgcuuagucuaucaaacaagaaaugcuggcuuggcccgguggcucaugccuguaaucccagcacugugggagaccacggugggggaaucccuugagcccaggaguuggagagcaacaucacaacaccccauuucuacuaauaaucaaaaaauuggccgggcaugguggcaugugccuguagucccagcuacuugggaggcugaggcaggagaaucgcuugagcccaagagguagagguugcagugagccaagaucgcgccacugcacuccagucugggcaacagagugagacccugucucaauaauaauaauaauaauaaugaugauacucuaagaaaaaaaucucaacauacuucauuuaauagcucguuaccaagugugaaugaagcaauaugucauaauagaguagccacugguugcauaauaauagagaccuaaauucucaaauagggaaagagguuuuaaaaucaaauuugaggccaggugcaguggcucaugggcggaggagggcagauuacuugaggcuaggaguucaagaccagccuggccaacauggugaaaccccaucucuacugaaaauacaaaaauuaggcauaguggugcacgccugcagucccagcuacucaggagguugaggcagaagaaucgcuugaacccaggaaguggagguugcagugagccgagauugugcugcugcacuccagccugggugaaaaagacaggcugugucuccaaaaagaaaaaaaaaagucaaauucaaauaucaucuggacaugucacaauggaucgcggauccuuaugagugauuuuccccaguggccccuggggaugugccacugucacucagaagggcaagcuaggcagggcccauacaacagcaggggucugcagguuagacguucccugcccugggacgcucaccccugggcaagaggcuggaaguucacaccauccaaaauuuauccuuguuuuuuuucugaugcuaauuagccucucccgauuuuaugacaucuuguguug

SEQ ID NO: 21516 - RNA, 16770 nt, Homo sapiens
cugcgggggggcuuugggcgggcgcaggacucuggaagggagaaaagcccgcagcccggcccuccccgucccaggcggcccgcgcggguggacggcgggagcaggcggcgguuggagacgccggaaggaacgcggucucaccacccggcucccuccgccaaggcgaggcgcggccggggaggcgggacacaggcgaagcgggacggggaggcggggccggaggugcaggcggaggcgggcgacggggaagggagggggagggggaggggaaagggagggggagggggaggggaaagggagggggaggggggaagggacgggaggggagggggaagggacgggaggggagggggaagggacgggaggggaaggggaagcgggagagggaagggggcggagcuagccggagccgcgaguccauuuuggggcugugcuuggcgcguaccgugcggucccuguaguuggaggacgggcggucgcgcggccuuucccacuagccggaggucggagauaaguacccgccgcccggcuccucucgggaaagcggggugguccucgaaccuucagcgaggguggggaguugcccaggucagcagggaucugcguggguugggggggcuggcgaaggccgucugagcuccaguccggcagcgcggcagaaaccagcggggcacugucaugggccuggggaggagcggccugcggagggcgccggggcagugugucugugguccagaaaaccugcuccguccggagccuuccuggccccgcuaccagcgucuccacauccccuagaaaagaaaagacgggugugggccuuagguuacagcgcgccgccagcguuugguugcauggcgccgggggagggcgcccuaaccgagaagcugcuuaauacaaagagcuccaggcuccuggcgguucaccaggucuaaacagccgggcuuuauuugugggggcgauugaaaaaauugagggucaagauuggggugcugugcaaauaaaugcguuaauacuguucuuuuucuucuuucuuugcaguagccucuaguucguuagucaaaacgugaaaaaaaagaccugcuuugcccugggaaauaguaacccugccaaauacaucagcuuguaggagacagagguaaacuacaauaauuuuccuguguuaucuuuuuuuuuuaaacacccaauuucaauaggcccuagaaccuuccaaaauggaacuguguguagaauacguauguucccauccacuuucauugguggucuuuguucuuugcauauuuuguuaaaacuuagaaaaacagaauucacguuuagcaauuauuuaugugguauuuaucuuaaauauagccaaacauucauauuacaaaggaagaaaggggcuuccacacuuuuuuccuacuuuuuuuucccuucuccuaugcuuagugaauugucaggcugcuagggcuuguagaacagggcuugaguuuucuagagaccuuuauauaauaggcacuuuaaaagcagaauuucauuuacauaggcacuccuucuaguagaacuugauggagcuguuaaccggcuauacuuccuucuugcacaaugggagcgucccuaucccucccuaaaaauacguuuuuuuuccuuucucccagcuggcuuacuaaaccucccugggaaguccuuuccuaaaaccgggcuguucuguucauucuauacauuuaugauagguuaucuggccuuaauucugucacagcuuuuguucagauaugcucauuuucaugacacugcuuuguaccugauaccuuauguaauauuuguuuugccuugccuugaaaucacaguucaaguuuagaaccuuuucuugcuugauacacugaugcuccaaaauaacaccuuaaauguguagaguuugccauauguaauuaaaccuuauuuauguuuguauaguuucguaguuuauggaauucucacacaucacacaggaguugagaaauuacuuuuaggcagcuagaaaggguaaaagaguucucgguggaauuuuccuuuaauaaaaagcagcuccuggccggugacuuugggaggcugagguggguggaucacuugaggucaggaguucaagaccagccugaccaauauggugaaaucccaucuuuacuaacaauacaaaaauuagcugggcgugggggugcgugcaccuguaaucccagcuacucgggaggcugaggcagaagaaccacuugaaccgggacgcagagguugcagugagccaagaucgcgccacugcacuccagacugggcaacagagcgagacucuaccaaaaaaaaaaaaaaagcccccaaaccauuuauuuucuaacagaaagccugaaaagucaagcugcaagcaaaaauaugcaggcuagaagcuuuuauauguaaauguagccugcuguaucuggaagccagguacauucaauaugggguuucucacucccuuuuccuugucacccuaugugggcgucugggccgcucccuuuuccuugucacccuaugugggcgucuuggcgaucacuagguaaaaccacgggugcaggugucauggcggccccagguagaagcuacauuugcauaacaaaaaauuagggugggagggccagucuuuagacgggcuauguaaaugauucaccuggucaaaccaguccccugggcccuauguaaaucaccaccuccucaagccucuguacaaaaucgauugcguuucaccccaaacccggagacccucucuugggugauauuucucagcgugaggaaccuuucccuauuaaauuuuccgcuccuaaacccacuccuuguguguguccauguccugaauucuuucuuggcucgagacaaccacggguguaucccccaggcaauggagccauuucauuaugagguaaauacuauaaaaaucauuuuuaaauuuuuuuccaagagaugggauucucaacuguguuccccaggcuggucuugaacugggcucaagugauccuccugcuucagccuucagaguagcugggacuacaaguguguggcaccauucccagauauaaaaauccuaauuuuaugaaggauaaaacuggugcuugaacacagguacucaaaagcagguucugugcuuuccccuucacuagagagccuguuaaaccuaguuuguaaaaacugcaaaauuuuagaagggauuuuagagagcuuaugauuaaaccccuucauuuuaugaauaagaauacugaguucuugagucccuuucuagauauugcuaaggucuaagaauuagaaaacucaggcugugaugccuaguuugcuguguacaacugaugagucuccacuucuugagugcugggggugucuuaguuuuuuugacuccuaaaauuagguguuuagaugauuucuaagaugcuuuuaagcccaguauuucuauuccuaccccauaacuuuuauuaccauuuauugccuauacauauauauugguaagacacagaugcagacuaauguuaacugccuuaaacuuuuauauuuuaaacucggguagguaugguaacaagugugucuuauuguuuuuuacuaaguccuauaaaacuaugguuuuauuuaagguuaggaacugcauagagagguggaccacucuaauacaucauugguuagaguucauaaagugauauaaacccuuucuagagagaaaccuagucaucuuuucaacagccuuaaaaauguccuuacuguuugacccagaaguacauuuaaaggaauugucuaaggaaguaauuagagcuguggagcaagacuuuucucuauaagguguuuaccuaaauguuacaauaccaaaaaaacacaacaacccacaaacaaaacaacacagcaacaagaacaaacccauaaaugagcaauaagaaagcauauccacaacauggacugucauguuuuucuagaacauaucaugaugggggaaaggcauguaauaaaauaaggggauaggauacaaaauuguauuaugcuaccaguucuguuaaaaugugugcacaugcacggacacaugggauuggaauaaagacaccaaaauaauaguaguggugauuucuugcugaugugauuauggguggcuuuuucucucuauuuucugaauuuucuauaauaaaaacuaauuuuauaauuuaagaagacacaaaagcuaguugcauggauaacuucgguuucaguauggugucaauauuuuaugguuuuaauugugguaagaacauuuaacaugagaccuauccucuacacagauuucuaaguguacaguacagugguguuaacuauagacaugagcagaucucugaaacuuacuuuuaugugucuuuuauaaacuauuuaucauaccuucuagaauaacagcaccuggccgggugcaguggcucaggccuguaaucgcagcacuuugggaggcugaggugggcggaucaccugaggucaggagcucgagaccagccuggccaaaaugguaaaacccugucucuacuaaaaauacaaaaaauuagcugggcaugguggcaagugccuguaauaccagcuacuugggaggcuaaggcaggagaaucacuugaacccaggaggcggagguuccagugagccaagaucacaccauugcacuccagccugggugacaagagcaaaacucugucccaaaaaaaaaaaaaaaaaaggcaggaaagaguccaggcuaaacuaugguauggagaagagaaugaaggaaaaggaaaaaguuuuucuuagugcucugaacuagcgagguaaugagugaccugguuuauauuucugagaauuucaccuuagucugacaacccuuugugaacuuucugaguaagugaacuuaccaagcuagugaacauucuguacuagcucuauuuugccuugucaggaucucugcuagaaauaucuuggaaauuuuaacuacuguuuauucuaggauaaugccagaaaagguugguuacuuacugucuuauauggacacauagguaacuuuuauauuguuugcaagagccacauaacaauuauuuuagauacuauauguaauauauuaauuuucauuuuuagagguauugaaaucugauauuucuuacuuuguccuguuuugaucauauauaugccagaggugcuauguguaauacauuaauuuucauuuuuagagauuauaucugaaaucugaucucuguaucuuacuuuguccuguuuugaucauauaagucaccgggacagucucuaaaagaaugaagaguaauaacacauugauacagaguauuuaaaauaaaaacuuuguaaauacuuuucauauaccuuuuaaaauagcuauacaaaugaggagagaaacuaguauguauaagugguuugucagagguuacagacugagagccagacaaguaugucagucuccucacaggucuggauucagagacuuccaguaauacauuaaaaaaaaaaauuuaugaaagaugaaaccauaggcugggcaugauggcuuaugcuuguaaucccagcacuuugggaggccaaggcaggaagauacuuguggccaggaguuugaguccagccuggccaacauggcgaaaccccgucucuauuaaaaacauaaaaaugagccugacgugguggcaggcaccuguaaucucagcuacuugggaggaugaggcaggagaauugcuugaacccaggaagaggaggcugcagugagacgagaucgcaccauugcacuccagccugggugacagagcaagacugucucaaaaaaacaaaaacaaaaacaaaccauacuacagcagauuaaacuucuuaugaggcuuauauuuagcuaauguuuucaaaguuuuacuuucuaaacucaauaugguuuuuuaauaauuggcucuuuaguuuuuccacccauuuuauugugaaaauguucaaacagagaaaacucaagaagaauauuaaaguauucuuacauccucuaccuagauuuuaauaguuguuaauuagacccuuacuuaguuucaagaaaacauuuauuaauggaucucucuuuuuuuuuuuucuuuuugagauggagucucacucugucaucuaggcuggagugcaguggugcgaucuugacucacugcaaccucugccgccuggguucaagugauuuuccugccucagccucccgaguagcugggauuacaggugucugccacugcucccggcuaauuuuuguauuuuuaguagagacaggguuucaccaucuuggccaggcugaucuugaacuccugaccucaugauccaccuggcucagccuuccaaagugcugggauuacaugcaugagccaaugcaccuggccuaauggaucucauacuacaguauaguaaggugcaguggcucaugccuguagucccagcuacucuggaggcugagaugggagaauauaguacacuauuugaaaauaagauuaacuagugugcugagaggaaaugauuuuuuuuaaugagccauuuuauuauaggaauuauuucaaaguaacauuuguggcugucucaguucaguaaagcuuagcauaauuuaaugucuaugaagugaguuucaauguuugcugucuagccaccugauagauacuuagguacuguuuugaaauucuugccuucaaagaugccucaaaacaggauggaaauuugaguuaaauccuuaagauaaaagcgugauauauuuauuggcuuuucuuuuuguucccuaaugggaaaugaaaaaaaacaaaaaacauggguaauauuuugaacaacuuuauauugcuaacagccaguggaauuuaaaaccuuaguaggaaaguuucuuuuacuaauagguuuuauaaggagaaaaugaacuuuuguuucagagugaaugaaugaguacuuucugcaguauaaucauuuuggguugaucucuuaaaagaauucuagaaggaagaaguccaauacauauauauaaacucuauuaugacacguuuacuuuguaaguauuggcuuuuccauuuuuauuauuuuagugguuguguuaugguucucauuuauagaagcuguuguugccagauacuaauugagguaggauucauaaagcacuuuuuguaauccuucuucuuuguggauagcuugacaauuuguucaaaaaaauaaacucauaguggugguaugcaacuuuguuaaaaauaaaacuguaaaucaaaaagugaauuucauuguauguaaauuuaaaaguauguuagaaaacaucaauauggcaggagaacaaguuugacuuuuuuccgcaacuagugucuacuaccaccuuucuggauacuuuaaaaaguugucagcuuuuaaaauuguugguauaaaacauuugggaaguuuuuaauugguauuugugcuucaaaauuuaagacuuuucuaaguauucagaaauauucaaaggaagagaugaauuuuggaaaacuuguuugccuuuaugugcuuaaucugacuuuaaguugaaauuugaacagugaauaauaauuuuguuuacauaaaguuuuuugacuucuauauuaggaaaaaaacuagcuugaggccaagugcaguggcucuugccuguauaaucagcacuuugggaggcugagucccgacugcuugagcucaggaguuugagaccagccugggcaacaugcugaaacaucaucuauacaaaaaaaguacaaaaauuaacugggaaugguagcauguaccuguaguaccuuacagcuacucaugaggcugaggugggaggaucaccugagccuggggaggucaaagcuacagugagcuguguuagggucacugcauuccagccugggcaacagagugauacucccucaaaaaaaacaacaaaacagacugggcacacuggcucacgccuguaaucccagcacuuuaggaggcugaggcaggugaaucauuugaggugaggaguucaagaccagcccggccaacauaaugaaacccugucucuacuaaaaacacaaaaauuagccaggugguaguggugcaugccuguaauccgagcuacacgggaggcugacgcaagagaauugcuugagccuaggaggcagagguugcugguggggagguugccagugagccaagauggcgccacugcacuucagucugggugacagcccgagacccugucuuaaaaaaaaaaaaagggccaggugcgguggcucacgccuguaaucccaacacuuagggaggccaaggagggcggauuaccugaggucaggaguuugagaccagccugaccaacauggugaaacccugucucuacuaaaaauacaaaaauuagccgggugugguggcgggcaccuguaaucccagcuacucaggaggcugaggcaggagaaucgcuugaacccaggaggcagagguugcagugagccgagauggugccauugcacuccagccuggguaacaagagcgagacucccucucaaaagaaaaaaaaacaaccagaaaccccgaaaaagagguggaggggauguauccuuuuuuguucaugucaaaggaguaagcuggguugauuacuucagauuuuguguuagccauacuuuaagauuuuguaaguuauuuugcugugaagaguaccuuuuauuuaugauauuaaaggcuuuaacuuaaauuauccuucaaaacuuuggaggcaacaaagaugucuaccaugguuucuuggaucagguauuagucacuuguggaaguggucacauaguuuugucuuagagaaaguuuugauuauaaagagaaggcauaggcagggcaugguggcucacaacuauaaucccagaacuuugggaggccgaggcggguggaucaccugaggucaggaguucgagaucagccuggccaacauggcgaaacccugucucuacuaaaaauacaaaaauuagccuggcaugguuguaggcgcguguaaucccagcuacucggggagacuaaggcaggagaaucacuugaacccaggaggcggagguugcagugaguugugauuacaccacugcacuccagcaugggcaacagugcaagacuccaucucuaaaaaaaaaagagagaaggcauaaaacuaaaggaagaaaggaagaagagaaaaggaaauauuuaguuuuuuuuuuuuuuuugugauggaguuucacucuugugcgaucauggcucacggcaaccucuggccucacggguucaagcgauucuccugccucugccuccugaguagcugggauuacaggcaugcgccaccacgccuggcuaauuuuguauuuuuaguagagacgggguuucuccaugugggccaggcuggucucgaacucccgaccucaucugcccaccucggcggccucccaaagugcugggauuacaggcguaaaccaccgcgcuuggccagaaauauguagauuuuaaagugaaugaaaauaagaaucuuuaaauuaucaaccaaaauuuguaaguuaagucacuaaaaaugaaauuagaggaucuauuguaauuuugaugcaauuuuuuugaagauacuuuccaaauaguauuuuuuccccucugguucauuuuaagagcuguauguugaucaugaccuugggaugacuguuuauuauuucuaaguuuuccugugugugacauuuuccuuuucacuuuugaucacauuuguuugccugaaaauucuucuuggccccugucguuguauccucaauuuucuucauaguuucucuuugccuuuggugcccuuuuucuccuccucaucccacccaaucacuugguauauucuuuguuuucuucuuauuuaauaugcuuggauaguauucucuggaaguauuaacauugcaaggaugaguaaauuagguuucuuuuauugaguguugcccuuaccacuuuccuguuucuauugccuucucaaaaaucuggccuuuguguagaauucuuaggcaaaagaugauaguaauggaagugaaaaguguggagcaggacugggguuggcagaucaucaaaaguuugacuucauuguucugaaaguuugugugucuuacagcugugugguaaucucuuucagaagacaaacuaaguugagucuuuauagccauucucuuuccaaugcuuuucagagguuauaugauuugucauaucacaaaggauuuuucagaaaaaucagcuaauuacaccuuuuuuugcaauaugacacuaaauuugagacagaauaaucuuugcuuuaguucucccuauguuauguauuauaaauacauguaucuuacaaucuacuauaaaaccauaaacuggcugggcgugguggcucacaccuguaaucccagcacucugggaggcugaggugggcggaucacccgaggucaggagguugagaccagccugggcaacauggugaaacccugucuccagcaaaaaauacaaaaguuagcugggcaugguggugggcgccuguaguucccagcuacucaggaggcugaggcagaggaaccgcuugaacccgggaggcagagguugcagugagccgagauugugccacugcacuccagccugggugacgaagugagacucugucucaaaaaaaaaaaaacccaaaaaaauagggcccagcgugguggcucacgccuauaaucccagcacuuugggaggcugaggcagguggaucaugaggucaggaguucaagaccagccuguccaagauggugaaaccccgugucuauuaaaaauacaacaaaauuagccgggcgugguggccggugccuguaaucccagcuacucgggaggcugaggcaggagaauugcuugaaccugggcagcagagauugcagugagccgagauugcaccacugcaccccagccugggcaacagugagacucugucucaaaaaaaaaaaaaaaacgccaggcacgguggcucaccccuguaaucccagcaguuugggaggcggguggauugccuggggucaggaguuugagaccagcuuggccaacauggugaaaccccguuucuacuaaaaauacaaaaauuagcugggcgugguggcaggugccuguaaaucccagcuacucuggaggcugaggcaggagaauugcuugaacccgggaggcggagguugcagugagccaagaucacaccauugcacuccagccugggugacaagagugagacuuagucucaaaaaaaaaaaaaaaagccauaaacuaauuaacccugcaagcucagcuuguccuuuaaauacuguuuaccuucuagauauaguccagucauguauggcuguugaaauuacuguuaaaaaaguauucgcuuuuuuuuuuuugagacagaguauugcuguguugcccaggcuggagugcaguggcgcugucucggcuaacugcaagcucugccuccuggggucacaccauucuccugccucagccucccaaguagcuggaacuacaggugccugccaccacgcccagcuaauuuuuuuguauuuuuaguagagacgggguuuuacuguguuagccaggauggucuugaucuccugaccucgugauccgccugccucggccucccaaagugcugggauuacaggcaugagccacccgugcccggccaaguauucacuuuuuaucauagauggccuaccgauuaagucauauguuauuguugauaaugugauauuguugauaaugugauaugugcauauaucccugaguaaacugaauguagaaauauguaguacucuuugguuuuacaacuauagagaugaauguauauuuaaaauaaacuuguggccugaugcaguggcucacaccugugaucucagugcuuugcgaggcugaggcaggaggauugcuugaggccagcuaguaagaccuggucucuacaaaaaaaaaaguagccaggcgugguggugcaugccuguagucuuagcuacuuaggaaucugaggcaggaggauugcuugagcccagaaguuugaggcugcaguaagcuauaauuaggccacuguaguccagccuggacaacagagcaagacccugucucucaaaauaagaauuaaaaauaauaaaccugcauugagaaaugguauugccuguauuagggaucucaaauauuuuggucuuaggacacuuuuacacucuuaaaaauugagaauccuggccuguaaucucaguguuuuggcagucugaggugggaggaucacuugagcccagcaauuugagacuagccuaggcaauauggugagaccucaucucuacaaaaaaaaacuacaaagaaaaaaaaaauuagcugagugugauggugcgugccuguagucccagcuacuuggagguugaggcaggaggauggcuugaguccaagaggcagaaguugcaggggacugagauugcacugcuguacuccagccugggugaaaaagcugucucaaaaaaaaaaaaaaaaaaaaaaagagaaucccaagaacuuuauguuuguacugucgauauuuacucuauuagaaauuaaaacaauuuuuaaaaaauacucacguaaaauaacaaugauaaacccauuacaaguuaacaaauaauuuaggaaaauaacuauuuuccaaaacaaaauuaagagaagcauggcauugcaauagaggccuguaaugaauggcuauuuaauagaagacagcuggagucuuuugucugcuucuguauuuaaccuguuggaauauauuauuuugguugaaauaaacgaagaaggcugggugugguggcucaugccuguaauuccagcacuuugggagguggaggugggacgauugccugagggcuggauuucuagaccugccugggcaacauagugagacccugucuauaaaaaaauccacggccaggcgcgguggcucacgccuguaaucccagcacuuugggaggcugaggcggauggaucaccugaggucaggaguucaagaccagccuggccaacguggugaaaccccguuucuacuaaaaauacaaaaauuaccugcguguggugguaugugccuguaggcccagcuacuugggaggcugaggcaggagaaucacuugaacucgggagguggagguugcagugagccaagauagcaccacugcacuccagccugggugacagagucagacuccgucucaaaaaaaaaaaaaaaaaaaaaacaacaacaacaaaaaacacuaaaacuaaaaauuagcaaggcaugguggugcacaccugcagucuguaguuacuugggaggaucucacuugagcccaguauuucaaggcugcagugagcuaugaucaugccagugcacuccagcuugggugacagagugagacaccccaucucuuaagaaaaaaagaaaagaaaaggaaauacacaaaaaucuaggcuuacacagauauguaguugguaaaggaaggaauauuauuuaaauagccuuuucagguaauuuaaucuuuuuuuuuuuuuuuuuuuuuuuccugaggcaaggucucucucuguugcccaggcuggagugcaguggugcuaucucggcucacugcagccucugccuccugggcucaagggauucucauaccucagccucccgaguaguugggacuacaggcgcaugccaccauggcuggcuaauuuuuuugguauuuuuuuuguagagguggaguuuugcuauguugcccguacuggucgugaacuccugaggucaagcgguccacucucugcagccuuccagaguguuaggauuacaggcgugagccacugcucccagccugaaucuucuugugauacuauacaaaaacucagcaagugcuaguuucuuuguuggaguauggaaucugaaauuguuuaugaaccuguuggucuuucgugaacuucaaauggaucuuuuacccaugccugauuuguaacaugcauuagugacuugaaauaguauucacuguguuuugcagaucuccaaauauugacacauuucauuauacaguacuccuuuccccucagaaaauccucacauucauuaauaucacugcccaucucaucauaaaagucuuuaauuaaugggaagcugucaggcucauaaauaucaaauguuuuccaaaauucuaauuuuuacauaaaacccagccuuuucauuagcaagagauacugucaauuguuuucuuugaaguagcaagcucauuuuuuuuccccagaaaaugucagguagcuaagucugaauagccauaguuuaucauuuguucuuucagaagguaaaaaugguguuccaugaaaaaaagcagcugguuuaacuugccgcucuucacuuaagugcuuuuucuccagacaacaucugccgguaugcagaagugcuuugugcguacugccuauuuugucacgcaauauauuaaaaaacuguacacaggcucaagacuuaauaaaaugaauaauuuuuacugcugcaucaagaacauucuuaagugaaaccgguacuccaaccccaauuuggguggugaugaagaauacaauucagcgcuucuuacagcuuugcucgaucccuccuaaggcuucagcagugucuacacaccauugcuuuuacaccauugguacaaauguugacauggugcaaaaagcaaguaacaucuuagugucauuacgaaaauaguuuugaucucacagaugcccugaaagagggacauccagguuucugcccaccacauugugaaaauugaugauucuagauaauacaaaauggcuucuguuacuguucuggugguuuaaaaacaacaaaaaaccucauuuaguucucuaccuagaagagugaauugcaacucucaucuugugcuuuuaccugugauuuuaaaaauuguaaucuugccuuugaaacaaaaauaugccaauucauaauaaagucuacaugagaguacauguuuggauuuauauuucugugcuucuuucuuuuauauaacauaccauuucauauuugugggcccagaguaaagagcucauucuguuacagacacugaauagccuuguuuuugucaguagucagcucuguuuuaaaacaauugcuuggguccugcuggcucaacuugcaguuguccuaguccugagucuugucuuagccaaagacuguuguuggaaagcccacacaaaggccuuguguauaggaugcccuacuauuaaaggagcauguucuagucucaguggauuaaauuugcuuuggugugcauucccuuaccaaauuucucacuacuuuguuuggcugguuauuucagugaaaaaucauuuuaacgugaaggcagauuucuucuaauuauuacauaguccuaguggugacgguuauuggaguaaaauaauuuuuuuuuuuucugguaggaugugauggagcugcuugaagaagaucucacaugcccuauuuguuguagucuguuugaugauccacggguuuugccuugcucccacaacuucugcaaaaaaugcuuagaagguaucuuagaagggagugugcggaauuccuuguggagaccagcuccauucaaguguccuacaugccguaaggaaacuucagcuacuggaauuaauagccugcagguuaauuacucccugaaggguauuguggaaaaguauaacaagaucaagaucucucccaaaaugccaguaugcaaaggacacuuggggcagccucucaacauuuucugccugacugauaugcagcugauuugugggaucugugcuacucguggggagcacaccaaacaugucuucuguucuauugaagaugccuaugcucaggaaagggaugccuuugagucccucuuccagagcuuugagaccuggcgucggggagaugcucuuucucgcuuggauaccuuggaaacuaguaagaggaaaucccuacaguuacugacuaaagauucagauaaagugaaggaauuuuuugagaaguuacaacacacacuggaucaaaagaagaaugaaauucugucugacuuugagaccaugaaacuugcuguuaugcaagcauaugacccagagaucaacaaacucaacaccaucuugcaggagcaacggauggccuuuaacauugcugaggcuuucaaagaugugucagaacccauuguauuucugcaacagaugcaggaguuuagagagaaaaucaaaguaaucaaggaaacuccuuuaccucccucuaauuugccugcaagcccuuuaaugaagaacuuugauaccagucagugggaagacauaaaacuagucgauguggauaaacuuucuuugccucaagacacuggcacauucauuagcaagauucccuggagcuuuuauaaguuauuuuugcuaauccuucugcuuggccuugucauugucuuugguccuaccauguuccuagaauggucauuauuugaugaccuggcaacuuggaaaggcugucuuucaaacuucaguuccuaucugacuaaaacagccgauuucauagaacaaucaguuuuuuacugggaacaggugacagauggguuuuucauuuucaaugaaagauucaagaauuuuacuuuggugguacugaacaauguggcagaauuugugugcaaauauaaacuauuauaaaaucuguuucaaguaugcaguuuucuuuuguuagaaauuguuagagaauagagagugguaauucagauuuggucaacgauucuagucacauauuuuccuccaaaaguauuccuuccaaaaauaaucuauacauguucaaauuagguagcauaaagauaaaagugaaauuuaguaguauaggccugaaccuuuuuuuguuuaaaagagugcuuuugaaauaagcauccaccccaa

SEQ ID NO: 21517 - RNA, 16770 nt, Homo sapiens
uugggguggaugcuuauuucaaaagcacucuuuuaaacaaaaaaagguucaggccuauacuacuaaauuucacuuuuaucuuuaugcuaccuaauuugaacauguauagauuauuuuuggaaggaauacuuuuggaggaaaauaugugacuagaaucguugaccaaaucugaauuaccacucucuauucucuaacaauuucuaacaaaagaaaacugcauacuugaaacagauuuuauaauaguuuauauuugcacacaaauucugccacauuguucaguaccaccaaaguaaaauucuugaaucuuucauugaaaaugaaaaacccaucugucaccuguucccaguaaaaaacugauuguucuaugaaaucggcuguuuuagucagauaggaacugaaguuugaaagacagccuuuccaaguugccaggucaucaaauaaugaccauucuaggaacaugguaggaccaaagacaaugacaaggccaagcagaaggauuagcaaaaauaacuuauaaaagcuccagggaaucuugcuaaugaaugugccagugucuugaggcaaagaaaguuuauccacaucgacuaguuuuaugucuucccacugacugguaucaaaguucuucauuaaagggcuugcaggcaaauuagagggagguaaaggaguuuccuugauuacuuugauuuucucucuaaacuccugcaucuguugcagaaauacaauggguucugacacaucuuugaaagccucagcaauguuaaaggccauccguugcuccugcaagaugguguugaguuuguugaucucugggucauaugcuugcauaacagcaaguuucauggucucaaagucagacagaauuucauucuucuuuugauccaguguguguuguaacuucucaaaaaauuccuucacuuuaucugaaucuuuagucaguaacuguagggauuuccucuuacuaguuuccaagguauccaagcgagaaagagcaucuccccgacgccaggucucaaagcucuggaagagggacucaaaggcaucccuuuccugagcauaggcaucuucaauagaacagaagacauguuuggugugcuccccacgaguagcacagaucccacaaaucagcugcauaucagucaggcagaaaauguugagaggcugccccaaguguccuuugcauacuggcauuuugggagagaucuugaucuuguuauacuuuuccacaauacccuucagggaguaauuaaccugcaggcuauuaauuccaguagcugaaguuuccuuacggcauguaggacacuugaauggagcuggucuccacaaggaauuccgcacacucccuucuaagauaccuucuaagcauuuuuugcagaaguugugggagcaaggcaaaacccguggaucaucaaacagacuacaacaaauagggcaugugagaucuucuucaagcagcuccaucacauccuaccagaaaaaaaaaaaauuauuuuacuccaauaaccgucaccacuaggacuauguaauaauuagaagaaaucugccuucacguuaaaaugauuuuucacugaaauaaccagccaaacaaaguagugagaaauuugguaagggaaugcacaccaaagcaaauuuaauccacugagacuagaacaugcuccuuuaauaguagggcauccuauacacaaggccuuugugugggcuuuccaacaacagucuuuggcuaagacaagacucaggacuaggacaacugcaaguugagccagcaggacccaagcaauuguuuuaaaacagagcugacuacugacaaaaacaaggcuauucagugucuguaacagaaugagcucuuuacucugggcccacaaauaugaaaugguauguuauauaaaagaaagaagcacagaaauauaaauccaaacauguacucucauguagacuuuauuaugaauuggcauauuuuuguuucaaaggcaagauuacaauuuuuaaaaucacagguaaaagcacaagaugagaguugcaauucacucuucuagguagagaacuaaaugagguuuuuuguuguuuuuaaaccaccagaacaguaacagaagccauuuuguauuaucuagaaucaucaauuuucacaauguggugggcagaaaccuggaugucccucuuucagggcaucugugagaucaaaacuauuuucguaaugacacuaagauguuacuugcuuuuugcaccaugucaacauuuguaccaaugguguaaaagcaaugguguguagacacugcugaagccuuaggagggaucgagcaaagcuguaagaagcgcugaauuguauucuucaucaccacccaaauugggguuggaguaccgguuucacuuaagaauguucuugaugcagcaguaaaaauuauucauuuuauuaagucuugagccuguguacaguuuuuuaauauauugcgugacaaaauaggcaguacgcacaaagcacuucugcauaccggcagauguugucuggagaaaaagcacuuaagugaagagcggcaaguuaaaccagcugcuuuuuuucauggaacaccauuuuuaccuucugaaagaacaaaugauaaacuauggcuauucagacuuagcuaccugacauuuucuggggaaaaaaaaugagcuugcuacuucaaagaaaacaauugacaguaucucuugcuaaugaaaaggcuggguuuuauguaaaaauuagaauuuuggaaaacauuugauauuuaugagccugacagcuucccauuaauuaaagacuuuuaugaugagaugggcagugauauuaaugaaugugaggauuuucugaggggaaaggaguacuguauaaugaaaugugucaauauuuggagaucugcaaaacacagugaauacuauuucaagucacuaaugcauguuacaaaucaggcauggguaaaagauccauuugaaguucacgaaagaccaacagguucauaaacaauuucagauuccauacuccaacaaagaaacuagcacuugcugaguuuuuguauaguaucacaagaagauucaggcugggagcaguggcucacgccuguaauccuaacacucuggaaggcugcagagaguggaccgcuugaccucaggaguucacgaccaguacgggcaacauagcaaaacuccaccucuacaaaaaaaauaccaaaaaaauuagccagccaugguggcaugcgccuguagucccaacuacucgggaggcugagguaugagaaucccuugagcccaggaggcagaggcugcagugagccgagauagcaccacugcacuccagccugggcaacagagagagaccuugccucaggaaaaaaaaaaaaaaaaaaaaaaagauuaaauuaccugaaaaggcuauuuaaauaauauuccuuccuuuaccaacuacauaucuguguaagccuagauuuuuguguauuuccuuuucuuuucuuuuuuucuuaagagauggggugucucacucugucacccaagcuggagugcacuggcaugaucauagcucacugcagccuugaaauacugggcucaagugagauccucccaaguaacuacagacugcaggugugcaccaccaugccuugcuaauuuuuaguuuuaguguuuuuuguuguuguuguuuuuuuuuuuuuuuuuuuuuugagacggagucugacucugucacccaggcuggagugcaguggugcuaucuuggcucacugcaaccuccaccucccgaguucaagugauucuccugccucagccucccaaguagcugggccuacaggcacauaccaccacacgcagguaauuuuuguauuuuuaguagaaacgggguuucaccacguuggccaggcuggucuugaacuccugaccucaggugauccauccgccucagccucccaaagugcugggauuacaggcgugagccaccgcgccuggccguggauuuuuuuauagacagggucucacuauguugcccaggcaggucuagaaauccagcccucaggcaaucgucccaccuccaccucccaaagugcuggaauuacaggcaugagccaccacacccagccuucuucguuuauuucaaccaaaauaauauauuccaacagguuaaauacagaagcagacaaaagacuccagcugucuucuauuaaauagccauucauuacaggccucuauugcaaugccaugcuucucuuaauuuuguuuuggaaaauaguuauuuuccuaaauuauuuguuaacuuguaauggguuuaucauuguuauuuuacgugaguauuuuuuaaaaauuguuuuaauuucuaauagaguaaauaucgacaguacaaacauaaaguucuugggauucucuuuuuuuuuuuuuuuuuuuuuuugagacagcuuuuucacccaggcuggaguacagcagugcaaucucaguccccugcaacuucugccucuuggacucaagccauccuccugccucaaccuccaaguagcugggacuacaggcacgcaccaucacacucagcuaauuuuuuuuuucuuuguaguuuuuuuuuguagagaugaggucucaccauauugccuaggcuagucucaaauugcugggcucaagugauccucccaccucagacugccaaaacacugagauuacaggccaggauucucaauuuuuaagaguguaaaaguguccuaagaccaaaauauuugagaucccuaauacaggcaauaccauuucucaaugcagguuuauuauuuuuaauucuuauuuugagagacagggucuugcucuguuguccaggcuggacuacaguggccuaauuauagcuuacugcagccucaaacuucugggcucaagcaauccuccugccucagauuccuaaguagcuaagacuacaggcaugcaccaccacgccuggcuacuuuuuuuuuuguagagaccaggucuuacuagcuggccucaagcaauccuccugccucagccucgcaaagcacugagaucacaggugugagccacugcaucaggccacaaguuuauuuuaaauauacauucaucucuauaguuguaaaaccaaagaguacuacauauuucuacauucaguuuacucagggauauaugcacauaucacauuaucaacaauaucacauuaucaacaauaacauaugacuuaaucgguaggccaucuaugauaaaaagugaauacuuggccgggcacggguggcucaugccuguaaucccagcacuuugggaggccgaggcaggcggaucacgaggucaggagaucaagaccauccuggcuaacacaguaaaaccccgucucuacuaaaaauacaaaaaaauuagcugggcgugguggcaggcaccuguaguuccagcuacuugggaggcugaggcaggagaauggugugaccccaggaggcagagcuugcaguuagccgagacagcgccacugcacuccagccugggcaacacagcaauacucugucucaaaaaaaaaaaagcgaauacuuuuuuaacaguaauuucaacagccauacaugacuggacuauaucuagaagguaaacaguauuuaaaggacaagcugagcuugcaggguuaauuaguuuauggcuuuuuuuuuuuuuuuugagacuaagucucacucuugucacccaggcuggagugcaauggugugaucuuggcucacugcaaccuccgccucccggguucaagcaauucuccugccucagccuccagaguagcugggauuuacaggcaccugccaccacgcccagcuaauuuuuguauuuuuaguagaaacgggguuucaccauguuggccaagcuggucucaaacuccugaccccaggcaauccacccgccucccaaacugcugggauuacaggggugagccaccgugccuggcguuuuuuuuuuuuuuuugagacagagucucacuguugcccaggcuggggugcaguggugcaaucucggcucacugcaaucucugcugcccagguucaagcaauucuccugccucagccucccgaguagcugggauuacaggcaccggccaccacgcccggcuaauuuuguuguauuuuuaauagacacgggguuucaccaucuuggacaggcuggucuugaacuccugaccucaugauccaccugccucagccucccaaagugcugggauuauaggcgugagccaccacgcugggcccuauuuuuuuggguuuuuuuuuuuuugagacagagucucacuucgucacccaggcuggagugcaguggcacaaucucggcucacugcaaccucugccucccggguucaagcgguuccucugccucagccuccugaguagcugggaacuacaggcgcccaccaccaugcccagcuaacuuuuguauuuuuugcuggagacaggguuucaccauguugcccaggcuggucucaaccuccugaccucgggugauccgcccaccucagccucccagagugcugggauuacaggugugagccaccacgcccagccaguuuaugguuuuauaguagauuguaagauacauguauuuauaauacauaacauagggagaacuaaagcaaagauuauucugucucaaauuuagugucauauugcaaaaaaagguguaauuagcugauuuuucugaaaaauccuuugugauaugacaaaucauauaaccucugaaaagcauuggaaagagaauggcuauaaagacucaacuuaguuugucuucugaaagagauuaccacacagcuguaagacacacaaacuuucagaacaaugaagucaaacuuuugaugaucugccaaccccaguccugcuccacacuuuucacuuccauuacuaucaucuuuugccuaagaauucuacacaaaggccagauuuuugagaaggcaauagaaacaggaaagugguaagggcaacacucaauaaaagaaaccuaauuuacucauccuugcaauguuaauacuuccagagaauacuauccaagcauauuaaauaagaagaaaacaaagaauauaccaagugauugggugggaugaggaggagaaaaagggcaccaaaggcaaagagaaacuaugaagaaaauugaggauacaacgacaggggccaagaagaauuuucaggcaaacaaaugugaucaaaagugaaaaggaaaaugucacacacaggaaaacuuagaaauaauaaacagucaucccaaggucaugaucaacauacagcucuuaaaaugaaccagaggggaaaaaauacuauuuggaaaguaucuucaaaaaaauugcaucaaaauuacaauagauccucuaauuucauuuuuagugacuuaacuuacaaauuuugguugauaauuuaaagauucuuauuuucauucacuuuaaaaucuacauauuucuggccaagcgcggugguuuacgccuguaaucccagcacuuugggaggccgccgaggugggcagaugaggucgggaguucgagaccagccuggcccacauggagaaaccccgucucuacuaaaaauacaaaauuagccaggcgugguggcgcaugccuguaaucccagcuacucaggaggcagaggcaggagaaucgcuugaacccgugaggccagagguugccgugagccaugaucgcacaagagugaaacuccaucacaaaaaaaaaaaaaaaacuaaauauuuccuuuucucuucuuccuuucuuccuuuaguuuuaugccuucucucuuuuuuuuuuagagauggagucuugcacuguugcccaugcuggagugcagugguguaaucacaacucacugcaaccuccgccuccuggguucaagugauucuccugccuuagucuccccgaguagcugggauuacacgcgccuacaaccaugccaggcuaauuuuuguauuuuuaguagagacaggguuucgccauguuggccaggcugaucucgaacuccugaccucaggugauccacccgccucggccucccaaaguucugggauuauaguugugagccaccaugcccugccuaugccuucucuuuauaaucaaaacuuucucuaagacaaaacuaugugaccacuuccacaagugacuaauaccugauccaagaaaccaugguagacaucuuuguugccuccaaaguuuugaaggauaauuuaaguuaaagccuuuaauaucauaaauaaaagguacucuucacagcaaaauaacuuacaaaaucuuaaaguauggcuaacacaaaaucugaaguaaucaacccagcuuacuccuuugacaugaacaaaaaaggauacauccccuccaccucuuuuucgggguuucugguuguuuuuuuuucuuuugagagggagucucgcucuuguuacccaggcuggagugcaauggcaccaucucggcucacugcaaccucugccuccuggguucaagcgauucuccugccucagccuccugaguagcugggauuacaggugcccgccaccacacccggcuaauuuuuguauuuuuaguagagacaggguuucaccauguuggucaggcuggucucaaacuccugaccucagguaauccgcccuccuuggccucccuaaguguugggauuacaggcgugagccaccgcaccuggcccuuuuuuuuuuuuuaagacagggucucgggcugucacccagacugaagugcaguggcgccaucuuggcucacuggcaaccuccccaccagcaaccucugccuccuaggcucaagcaauucucuugcgucagccucccguguagcucggauuacaggcaugcaccacuaccaccuggcuaauuuuuguguuuuuaguagagacaggguuucauuauguuggccgggcuggucuugaacuccucaccucaaaugauucaccugccucagccuccuaaagugcugggauuacaggcgugagccagugugcccagucuguuuuguuguuuuuuuugagggaguaucacucuguugcccaggcuggaaugcagugacccuaacacagcucacuguagcuuugaccuccccaggcucaggugauccucccaccucagccucaugaguagcuguaagguacuacagguacaugcuaccauucccaguuaauuuuuguacuuuuuuuguauagaugauguuucagcauguugcccaggcuggucucaaacuccugagcucaagcagucgggacucagccucccaaagugcugauuauacaggcaagagccacugcacuuggccucaagcuaguuuuuuuccuaauauagaagucaaaaaacuuuauguaaacaaaauuauuauucacuguucaaauuucaacuuaaagucagauuaagcacauaaaggcaaacaaguuuuccaaaauucaucucuuccuuugaauauuucugaauacuuagaaaagucuuaaauuuugaagcacaaauaccaauuaaaaacuucccaaauguuuuauaccaacaauuuuaaaagcugacaacuuuuuaaaguauccagaaaggugguaguagacacuaguugcggaaaaaagucaaacuuguucuccugccauauugauguuuucuaacauacuuuuaaauuuacauacaaugaaauucacuuuuugauuuacaguuuuauuuuuaacaaaguugcauaccaccacuaugaguuuauuuuuuugaacaaauugucaagcuauccacaaagaagaaggauuacaaaaagugcuuuaugaauccuaccucaauuaguaucuggcaacaacagcuucuauaaaugagaaccauaacacaaccacuaaaauaauaaaaauggaaaagccaauacuuacaaaguaaacgugucauaauagaguuuauauauauguauuggacuucuuccuucuagaauucuuuuaagagaucaacccaaaaugauuauacugcagaaaguacucauucauucacucugaaacaaaaguucauuuucuccuuauaaaaccuauuaguaaaagaaacuuuccuacuaagguuuuaaauuccacuggcuguuagcaauauaaaguuguucaaaauauuacccauguuuuuuguuuuuuuucauuucccauuagggaacaaaaagaaaagccaauaaauauaucacgcuuuuaucuuaaggauuuaacucaaauuuccauccuguuuugaggcaucuuugaaggcaagaauuucaaaacaguaccuaaguaucuaucagguggcuagacagcaaacauugaaacucacuucauagacauuaaauuaugcuaagcuuuacugaacugagacagccacaaauguuacuuugaaauaauuccuauaauaaaauggcucauuaaaaaaaaucauuuccucucagcacacuaguuaaucuuauuuucaaauaguguacuauauucucccaucucagccuccagaguagcugggacuacaggcaugagccacugcaccuuacuauacuguaguaugagauccauuaggccaggugcauuggcucaugcauguaaucccagcacuuuggaaggcugagccagguggaucaugaggucaggaguucaagaucagccuggccaagauggugaaacccugucucuacuaaaaauacaaaaauuagccgggagcaguggcagacaccuguaaucccagcuacucgggaggcugaggcaggaaaaucacuugaacccaggcggcagagguugcagugagucaagaucgcaccacugcacuccagccuagaugacagagugagacuccaucucaaaaagaaaaaaaaaaaagagagauccauuaauaaauguuuucuugaaacuaaguaagggucuaauuaacaacuauuaaaaucuagguagaggauguaagaauacuuuaauauucuucuugaguuuucucuguuugaacauuuucacaauaaaauggguggaaaaacuaaagagccaauuauuaaaaaaccauauugaguuuagaaaguaaaacuuugaaaacauuagcuaaauauaagccucauaagaaguuuaaucugcuguaguaugguuuguuuuuguuuuuguuuuuuugagacagucuugcucugucacccaggcuggagugcaauggugcgaucucgucucacugcagccuccucuuccuggguucaagcaauucuccugccucauccucccaaguagcugagauuacaggugccugccaccacgucaggcucauuuuuauguuuuuaauagagacgggguuucgccauguuggccaggcuggacucaaacuccuggccacaaguaucuuccugccuuggccucccaaagugcugggauuacaagcauaagccaucaugcccagccuaugguuucaucuuucauaaauuuuuuuuuuuaauguauuacuggaagucucugaauccagaccugugaggagacugacauacuugucuggcucucagucuguaaccucugacaaaccacuuauacauacuaguuucucuccucauuuguauagcuauuuuaaaagguauaugaaaaguauuuacaaaguuuuuauuuuaaauacucuguaucaauguguuauuacucuucauucuuuuagagacugucccggugacuuauaugaucaaaacaggacaaaguaagauacagagaucagauuucagauauaaucucuaaaaaugaaaauuaauguauuacacauagcaccucuggcauauauaugaucaaaacaggacaaaguaagaaauaucagauuucaauaccucuaaaaaugaaaauuaauauauuacauauaguaucuaaaauaauuguuauguggcucuugcaaacaauauaaaaguuaccuauguguccauauaagacaguaaguaaccaaccuuuucuggcauuauccuagaauaaacaguaguuaaaauuuccaagauauuucuagcagagauccugacaaggcaaaauagagcuaguacagaauguucacuagcuugguaaguucacuuacucagaaaguucacaaaggguugucagacuaaggugaaauucucagaaauauaaaccaggucacucauuaccucgcuaguucagagcacuaagaaaaacuuuuuccuuuuccuucauucucuucuccauaccauaguuuagccuggacucuuuccugccuuuuuuuuuuuuuuuuuugggacagaguuuugcucuugucacccaggcuggagugcaauggugugaucuuggcucacuggaaccuccgccuccuggguucaagugauucuccugccuuagccucccaaguagcugguauuacaggcacuugccaccaugcccagcuaauuuuuuguauuuuuaguagagacaggguuuuaccauuuuggccaggcuggucucgagcuccugaccucaggugauccgcccaccucagccucccaaagugcugcgauuacaggccugagccacugcacccggccaggugcuguuauucuagaagguaugauaaauaguuuauaaaagacacauaaaaguaaguuucagagaucugcucaugucuauaguuaacaccacuguacuguacacuuagaaaucuguguagaggauaggucucauguuaaauguucuuaccacaauuaaaaccauaaaauauugacaccauacugaaaccgaaguuauccaugcaacuagcuuuugugucuucuuaaauuauaaaauuaguuuuuauuauagaaaauucagaaaauagagagaaaaagccacccauaaucacaucagcaagaaaucaccacuacuauuauuuuggugucuuuauuccaaucccauguguccgugcaugugcacacauuuuaacagaacugguagcauaauacaauuuuguauccuauccccuuauuuuauuacaugccuuucccccaucaugauauguucuagaaaaacaugacaguccauguuguggauaugcuuucuuauugcucauuuauggguuuguucuuguugcuguguuguuuuguuuguggguuguuguguuuuuuugguauuguaacauuuagguaaacaccuuauagagaaaagucuugcuccacagcucuaauuacuuccuuagacaauuccuuuaaauguacuucugggucaaacaguaaggacauuuuuaaggcuguugaaaagaugacuagguuucucucuagaaaggguuuauaucacuuuaugaacucuaaccaaugauguauuagagugguccaccucucuaugcaguuccuaaccuuaaauaaaaccauaguuuuauaggacuuaguaaaaaacaauaagacacacuuguuaccauaccuacccgaguuuaaaauauaaaaguuuaaggcaguuaacauuagucugcaucugugucuuaccaauauauauguauaggcaauaaaugguaauaaaaguuaugggguaggaauagaaauacugggcuuaaaagcaucuuagaaaucaucuaaacaccuaauuuuaggagucaaaaaaacuaagacacccccagcacucaagaaguggagacucaucaguuguacacagcaaacuaggcaucacagccugaguuuucuaauucuuagaccuuagcaauaucuagaaagggacucaagaacucaguauucuuauucauaaaaugaagggguuuaaucauaagcucucuaaaaucccuucuaaaauuuugcaguuuuuacaaacuagguuuaacaggcucucuagugaaggggaaagcacagaaccugcuuuugaguaccuguguucaagcaccaguuuuauccuucauaaaauuaggauuuuuauaucugggaauggugccacacacuuguagucccagcuacucugaaggcugaagcaggaggaucacuugagcccaguucaagaccagccuggggaacacaguugagaaucccaucucuuggaaaaaaauuuaaaaaugauuuuuauaguauuuaccucauaaugaaauggcuccauugccugggggauacacccgugguugucucgagccaagaaagaauucaggacauggacacacacaaggaguggguuuaggagcggaaaauuuaauagggaaagguuccucacgcugagaaauaucacccaagagagggucuccggguuuggggugaaacgcaaucgauuuuguacagaggcuugaggagguggugauuuacauagggcccaggggacugguuugaccaggugaaucauuuacauagcccgucuaaagacuggcccucccacccuaauuuuuuguuaugcaaauguagcuucuaccuggggccgccaugacaccugcacccgugguuuuaccuagugaucgccaagacgcccacauagggugacaaggaaaagggagcggcccagacgcccacauagggugacaaggaaaagggagugagaaaccccauauugaauguaccuggcuuccagauacagcaggcuacauuuacauauaaaagcuucuagccugcauauuuuugcuugcagcuugacuuuucaggcuuucuguuagaaaauaaaugguuugggggcuuuuuuuuuuuuuuugguagagucucgcucuguugcccagucuggagugcaguggcgcgaucuuggcucacugcaaccucugcgucccgguucaagugguucuucugccucagccucccgaguagcugggauuacaggugcacgcacccccacgcccagcuaauuuuuguauuguuaguaaagaugggauuucaccauauuggucaggcuggucuugaacuccugaccucaagugauccacccaccucagccucccaaagucaccggccaggagcugcuuuuuauuaaaggaaaauuccaccgagaacucuuuuacccuuucuagcugccuaaaaguaauuucucaacuccugugugaugugugagaauuccauaaacuacgaaacuauacaaacauaaauaagguuuaauuacauauggcaaacucuacacauuuaagguguuauuuuggagcaucaguguaucaagcaagaaaagguucuaaacuugaacugugauuucaaggcaaggcaaaacaaauauuacauaagguaucagguacaaagcagugucaugaaaaugagcauaucugaacaaaagcugugacagaauuaaggccagauaaccuaucauaaauguauagaaugaacagaacagcccgguuuuaggaaaggacuucccagggagguuuaguaagccagcugggagaaaggaaaaaaaacguauuuuuagggagggauagggacgcucccauugugcaagaaggaaguauagccgguuaacagcuccaucaaguucuacuagaaggagugccuauguaaaugaaauucugcuuuuaaagugccuauuauauaaaggucucuagaaaacucaagcccuguucuacaagcccuagcagccugacaauucacuaagcauaggagaagggaaaaaaaaguaggaaaaaaguguggaagccccuuucuuccuuuguaauaugaauguuuggcuauauuuaagauaaauaccacauaaauaauugcuaaacgugaauucuguuuuucuaaguuuuaacaaaauaugcaaagaacaaagaccaccaaugaaaguggaugggaacauacguauucuacacacaguuccauuuuggaagguucuagggccuauugaaauuggguguuuaaaaaaaaaagauaacacaggaaaauuauuguaguuuaccucugucuccuacaagcugauguauuuggcaggguuacuauuucccagggcaaagcaggucuuuuuuuucacguuuugacuaacgaacuagaggcuacugcaaagaaagaagaaaaagaacaguauuaacgcauuuauuugcacagcaccccaaucuugacccucaauuuuuucaaucgcccccacaaauaaagcccggcuguuuagaccuggugaaccgccaggagccuggagcucuuuguauuaagcagcuucucgguuagggcgcccucccccggcgccaugcaaccaaacgcuggcggcgcgcuguaaccuaaggcccacacccgucuuuucuuuucuaggggauguggagacgcugguagcggggccaggaaggcuccggacggagcagguuuucuggaccacagacacacugccccggcgcccuccgcaggccgcuccuccccaggcccaugacagugccccgcugguuucugccgcgcugccggacuggagcucagacggccuucgccagcccccccaacccacgcagaucccugcugaccugggcaacuccccacccucgcugaagguucgaggaccaccccgcuuucccgagaggagccgggcggcggguacuuaucuccgaccuccggcuagugggaaaggccgcgcgaccgcccguccuccaacuacagggaccgcacgguacgcgccaagcacagccccaaaauggacucgcggcuccggcuagcuccgcccccuucccucucccgcuuccccuuccccucccgucccuucccccuccccucccgucccuucccccuccccucccgucccuuccccccucccccucccuuuccccucccccucccccucccuuuccccucccccucccccucccuuccccgucgcccgccuccgccugcaccuccggccccgccuccccgucccgcuucgccugugucccgccuccccggccgcgccucgccuuggcggagggagccggguggugagaccgcguuccuuccggcgucuccaaccgccgccugcucccgccguccacccgcgcgggccgccugggacggggagggccgggcugcgggcuuuucucccuuccagaguccugcgcccgcccaaagcccccccgcag

SEQ ID NO: 21518 - RNA, 5209 nt, Homo sapiens
ccaaagcaccaaguacauggaguugucuagagagcagcaggcauuauggcuuaagcacaguuggggccugguugcccagagacggcauggcagcagaugaagccaagaguuaggcugaguguagauuuggcuaacauguaugcccuaaauacguaaugaaacaagaaaaauggcaauuucucuuuaaaagaggauagacaacuucauuucuuuaucugagauugcucugguaugaugauagucucugguuuugguguuucauucgugaugagcacuucagggcuuuuuauccuuucaaagcuauagcauucaguuuugucuucagaagauacuguucuagugcugaccaaaugaaagccuuccuuuaauaaagugucaaucaguaagccgaggacauuuguuccguuggccaauuuucgguuaucagguuuuauagaaacauaccuaggacacacaaaaagaagcuuaauuauaaagcaucccuuuaauaacuagcaaaacuauacacauaaauuugacuuacaaccucaaaggcaucauaccuucucaagacagauuuuuuuuuugaaauuucauuuacuuuacaaauccaaaugagugauuuuuuuuuuuuuucuuuugagauggagucuuacucugucacccagacugguguguaguggugugaucuuggcucucagcaaccucugccucccagguuuaggcuauucucuugccucagccuccuaagcaggugggauuacaggcgcacaccaccaugcccggcuaauuuuuguauuuuuaguaaagauugaguuucaccauguuggccaggcuggucucaaacuccugaccucaagugauccacccaucucggccucccaaagugcugggauuacaugcaugagccaccgugcuaggcuaccaaaucaguaaucaggugcugaaaaucgagaccuugcugugauucugaaagucauuucaauuccauauuuagaaguaaaccaacacucaucaauuuuugagagaucacuuucuaaagaaaacauuugaucaaacaaauuguauuaauuuuuauauaacuauuuccaauuuuguuuugaauuugcuauuaauuaguugauugaaucaaauauuuuaaugaaugcugugcacuuacaauuuccccuccagaucuaaucuuaucaauuauuagcacugacauuauggauuuuccuuugcgacuuacuccuaugaaauuuaccuuuuuuuaagugaaauuuugcagauaugaaaugucaagauuuuauugucacuuuuuacgcaauaacucuccauugucaaagagcacaacuuggggucaaaagccucuggagaguggaaagggcaaaaucuucuauucacugaggugcuccacagaacaaaugcaguacacagaaccaauucaagaaaaaugcacaugaggaggcggagcuugcagugagccaagauggcgccauugcacuccagccugggugacagagcgagacuccgucucaaaaaaaaaaacaaaagaaaaaaagaaaaaaaugcacaugaacuuuucagauuagcuaucuguuggcuuuaauaaugucagcauaggcugggcguagugccucaugccuguaaucccagcauuuugggaagccgaggcugguggaucaccugagcucgggaguuugagaccagccugaccaacauggugaaacuccgucucuacuaaaaauacaaaaauuagcuaggugugguggugcauaccuguaaucccagcuacucgggaggcugaggcaggagaaucacuugaaccccagaggcggagguuguggugagccgagaucacgccauugcauaccagccugggcaacaagagugaaacuccaucucaauaauaacaauaaugucagcauaacacaucugcauggauacagcuuuaugacuccguccuuaucugccaucaaaaauguuuucauaaagcucuuuguguccucccaccauuaguuuaugagaugugaagaaaaagcuaacuuagauuaguucaggcagaaaccuaaacuaucuguaguuuuaagggauaaaaugaugcuuggggacaucccuaaccuucuucuaaugaucaugcuugaaguagagugguuuuuguaguucacauuuagaaacucauucuaagcaaagaaaccaauaguaaaaucuaagaauuaccaaacuacaaagcacaucucaaaaaaaguuuauuauguuugauacaacagauucucaauauuagcaaaucauuccacuuacccccaagcgccagaucuugacuguacagucuaaaaacauuugucaaagugagaaaaauguuacagaacaucucauaaaagaauuaagauacaaauaguauauacagauaguagauuguaacaaaguggaacguacuugcaagacaucaccuagcuaaaauacuugauucccuaugaggacaaacugaaaaauaaaauauuucaagcacacaaagaaaggacaaaauaggggaaaccaaugggaaauauaaaguuuaaacuuauuuuuaacauuuaaaagcaacuacacuuuuccauuugagccaguucaaaaaggagaagucaaauaaagacuuuagaauccugugaccaacuauaauuugagcuugauaacaugaauggcaucugaaagaugcaagccaaguauuucuaguacugugaccuugagagauaauaacugagcaaccugcuagguuaaccuugagggguaaaucauauugauagaacaaacugaauaaagugaaugauacaccagacaauuaggcaccaauuaggcucacuucuccauuuuccaaaccuaccaaaaaauaucugaauagacagauagauucagaccagggagugagcaaaaaauaaaaaugauugcuaauuaggcaauuauauacuaaaaguggaccuuuuaaggccagaguuuucaucccaaucaccagagauccccauaauuucaccguauucagauuggcuaucucuacuuuuaaauuggcacugucuaaaaauucacaaacauuuauggaaugguaaaaauuuugagcuucaaacaauugaauaccauuuggugaugcaagaaaaugcuaauuuuaaaaauagcuucugauuuuggaauuauggaagucuaaauauaauguuuucucacuuuaaaauggaaaaaacuuucgugcuguuucuaaaacacaacauaaaaagggaaaaccauuuggcacuguguacacacaggaacaucccaguuuuaguuuuuaaucauguuuuucaaggaaacaauuacuuucuccaaaugcaugguuuuuaaagaguacuucauauuuccaggacaucuucuuuugaccuaguguguuucuucuuaaaaaucaaugacaguuuugucucuagguuucugacuuuuugaagcaugauccccaaagaggucauaaucacucauauuuuaaaaaccaaaaaaaauuucauuuuuguuaaaguaucccaucaaugaaaauaaaguuguacagagguuugagauaaagauaagguauuagauuuucuucacaaucagccuacuagcuugacuggcucucuuuucccaaaaugacauuucaaacucuuuugaaggacaggaaguuauaaaauguaaacaauuaagaauugucauacucgguuauucuaccuaguguccuccaguugguaagcaagaccaaggagugugucgcuaagagagagagacacugguauccuuccuguuggcuacugcucaaguuaagaaaauaucuuaaaauacgccuaccuuuaccaaaaaaaaaaaaaaaaguauauuuuaaaugauaccaauaaagaacacaugcaggcuuuucuuuuccuccuaaaaauuaaagccagcuuucacaguugguaaaauaaugguaggacagcauuaagacauuuuacggggggaaaaauguuugugacagcagaguggaaaucagcguuaggauccagccaagaacaacagagggaguaagugaagaauugacucaggagcaacuauccuuaacauacugacagccuaucccaauauuuugaguuguuuaagagccaaggcuguaacaggauaccaaauuugccaugagauauaucugucuuuaaggguguuuaaaaauaaagucagcugaaggaaaaacaguaguugaaucauaaaacugaaagaacaacuuauauaguguguaaggaacucaagagaaaccagugagcgagccuuuaugugaaccacugaaacaaucucuuaaaaauaaggcaauucuuuucuaagucaaauucauuagcaauggaacauaaucuacaaaauuauuuucucccaugauuugaauguccauagucucaguuuuuucugggcagucuucauuuauuccuuuugucccaccuaauaauagccccuuucacucuaaaaaguaucccaguuuggaaaauaauuauuuggucauucuacccaacuccacugguuaccccaaaacauuauuuugaauaaucaucuuuuccagaaguuacaggccugaggaacuucaaguuuuuagagaaaacaucacaaacugguauacaagagaaauacugcaaaguacaaaauaccugacuccaguuugguuaucaguagugcugucagaaccacacuggaaaaccaggucaugguaagaaggucuuuguggaggcaguggaaguaaggucaucugaggagggaaaaaguuaccauuccaggucggcgcugaagguuguucuguaaacacuguaauccucccuguuagcaucucaauuguuuugcugcaagagccaaacacccugaaaaaagcuugaguguuccggcuuaggaaauguaccuccacaagagcaggucuuggcuguagcagguauggguuuaagagaucaacuagagaacgaaguucauagaaaagagccucucucugaagccuaagauagucugaaaauucaguggguaauaaaagcuggugaguucucaaaaaaucuaagaugaaacuaaacaaaucaccaucucugucuacaaaaaucuggccaccaaccaucuugaauucuuggucucugccaucuaacaugcgugccaaacgagaagcaggaaacugcuuuaucguagaaaaccuugucgugaauaucuucccucccacauucaaagugaccaguuccugacuacucauucuucccucacuucaaacuagaggcuaccaucagccacacuuagg

SEQ ID NO: 21519 - RNA, 103134 nt, Homo sapiens
aguggugacaccgccggggugcggagggagucccugaaacuucucccaacagccccagggccaaucuucccucagcccacuccccucuucgccagcucccagguccccacuccuguaccgggggugggguggggagccaggcccgucucccgcugggacacacacaggggccgggagcggggacgggacccccgaggcgggggggacgaaccgacagacagacggcugggcgcccgccccagcgggcaggcaggcaggaggaggcggaggcggggguacgacggggagcacugggucuggggaguuuccucucaacuaucgggggagaaacuccccgcagccggaggaaagacccagacaguguuuuccucccgggggccgugcucccccgccccgcguagcggcggucgccgccaccggcgccuccaccucuaccaucuccucuuucuccaccaccucgggccccgguguccccggccagcacuaugcccaucuuacuguuccugauagacacgucugccucuaugaaccagcgcagccaucugggcaccaccuaccuggacacggccaaaggcgcgguagagaccuucaugaagguaccgacugaccgagcccgggcggcgaccccggcccggcggcccgcgggcggcagggugggggagggcggccggggcgggggugucggggaccugacugcgggagcugccgggcucggggacccccucccccaccgcgcgggcgggcgggcgcugcgagccggguucggccggggcccgggcuccggccccgggcgguguguggggagcgaucugugugugggggacggcguggagggguggccgcugcgugugcgguacugugggggcggcggggccgcugggcgccccuucuccgccucguaaccucgccucugugcuucccugucgcccgcccuguuccuccucccgucccgcagcuccgugcccgggacccugccagcagaggagacagguauaugcuggucacuuucgaagagccgcccuaugcuaucaagguaacagcccucgcccucccccuuuccucccuucccuucccuguuccuuccucgcucgcccuccccgcccccccauucacccuucauuaugcuccccucccccacccgcugcgcucccagccgcugaggucucuucccugcgggcucccacccccucccccgcucggcagcguccuagcgcggcgcggagucgcggggccaccgccguccccucccggcccggcccggcagcggcggcggcggcggcggcggcggcgcugcuaucaacauggccgacauuuccccuccgcggcgugagcggcagcaaugaacugugggggauauuuauucaaguuagccggagugacagccgggcccggccgcgcacagccccgguuugcauuaaaggggaaucggcccggccggcccggaagccagaugcggggcugccaggauuggucuugucagauucguccuaagagggccggugggacagcugcagguuaacuuccuaaguccggcucccaucugcuuccacuaguaccuucacauacccaaauuuuggguauuagauuagguaguaaauuugucagugaaguuauaaaguauuaaggcaguuaacuaccaaaaccuagagaggaagcuggguuauuccugggccaccuuuggaagagaguuuccucagcagcgguacaguauuaacacguuaaccaagccaaaccaaccaaaagugaagcugcuacuuggugaacgucagauuauaacggcucuguguacauggcuuuaaaaaaugaaaaaaaaaaaucuuacauuuuucuuuucaggcuggauggaaagaaaaccaugcaacguuuaugaaugaauugaaaaaccuucaggcugaaggacuuacgacucuuggccaaucccuaaggacagcuuuugauuuauuaaauuuaaauagauuaguaacuggcauagacaacuaugggcagguagguugaauaauaagguggcaaaauaguugauuuuucauuuuguggaaaaacacaguccaguccaaaaacuacauaacaugaaaugcaaguauaaaacauuccaaauuaaaauagaauaugcacauuguucaaaggcaaaacucuuacccuacuauauauauuuuacaucccucauuuuuucccccucuaaaaugcauugguauucaggauuagaaucugaaacuuuugcuauaaaguugacauacauugguuuuaaucccuugaaaguucaguaaagaccuaaaaggaaaagcauccuaccacaccacacucauguuguaugugcaacuauuauaguggcuuagagacacuaguucguguucuucguuucuauauuaguaaagauguuagaggaaauuaaucuguuuguugcaucaggguuuaaugugaccauguuguauaacuauucugaaagguaagaaguuuuucacuggaguacagucacuggcugagaacauuuaaguuuucuuuugaagcauacacaguuaacaacuauugcaggaagaacucugaauuaaauuucaggcccagaguuuugauuuaaacuccaaacccuuggaaaaaaagacugcuggaaaauaugaaagaacccuucguuucuuaacccccacaaguccuuuuauugcacuuacuuucauguauuugaggaugagaggagcuuuaaaucaacaauaauucacuaaggaauaaugcaagguggucuauuguaacauuuuaugauauuauugcccuggaaauaaaagauacugaacaauguauaauguuacauguaacaaaggaauauuauuuccaaggagcucaguucuuauguuguagugaaaagcacuauuccuaauuauauauuggguauauguuguauuuucccaagucccacagucccuaguuuugugaguuucguacauuucagggaaauucuuucugugacuacaacuuuuauuugcuuccuauugaaggaaauugacuuguuucuguuuuaggaaauuuuaagcuucuuagggauaacuucagugcuuaagugucuuuggaaauaacugaauuuaguucuauaacauuuaaaauguacacugaaauucagagugagcuuaccaaauugaacuuccaacguuuaguuagguaaauauguacuuucuuaccacauuaauacuuuuauguuuuucccaucucugcugcuuuuauuuugcaacuuuuaauaauuuagguagauuugcaaugaacuuuuugguuuguuucuguaaaauaguaguggauuuccuucucuuuuauauuccuuugugauauguagugcaacacagucuuacugcuuaagguuuucauccuuaccucuuugaguucaaagagauauuuaaaacuugccauuauuugguuaccuuuauuugguugucauguuguuaguguauggcagaacuauuaguuuccucuuuuucugcaucacauuucauaaguggucaaggcauuuggacauauucaccuccuauuaccuauuaaaaauacuucuuaaagauugcuuccuucgaaaaacugcuugucauggagaggcugaggacauuuguaauuuaaaccuguauuuuccuuuucccaguugauaucugcccccagagaacacuuuaguucuugucuauaaggcuuaccaaaaguuugcgggaaaggugguccugugcuguuaccacuuugaccaagagaagaaccuggagauugggauguuuuugcaugucaggauuuauuaauucaauaacagagagggaugaugcuucucacuuauucugaugaaucagcaaagauugcaaagcauaauauuaaugcuuaugucuugaauuggcacauuaaaaaugacacuagcauuaaaauaagccacuguuuucaaaugaaaaugauaauuugaguaaagaguauugaauuggaagaaaacauucuuccagaagauuuuuuucaucauaaaacuaucugauuuaaacauuucauguuuucuauucacaacaaggauaaaugauuaggaauuuuggaugucucaaauauuuaauacugaauauuguucauguguuuucuucuuuguaaaaguacuuuguaucugccuguuugcuguggaauacuuuuauuuuguaacuucaaugucuuuacauaaguauuuccccuuuccugcucuauacuaggaucugugguguucacaguacuaaauacuuguauguaacguuaguaguugaaggaaaugagaaaagauuagguggaagauagaacguauauauuuuauagaacaucuaaaaacuuuaauguucugaauuacuuucuuaaaugucuggguuaauauauauauuuguauauuuauguagauauccaccauucucccacauauaugcacauauaugauuuuucauaacuaauuacaagacuauuaaaucuauauugcauuuguuaacuuaguuaacauaccuacagauaaaacaucuuugaauuauuagcuaggaugcuaucagaauuugcagggcauuaguaagguuaaguaacugagaaaaaagaaugguucuuagugaauguuuuccucaagcacuuuggguaucccacuaaaaaauuccaugccuacagacauuguuauaaauauuuaauuuugauaaucaguaccauuuacugauauuucuacaguaauggagcaauguauagccuuuagucaaucuuuuccuuuauagcaguacuuuaaguugcauaucauugcagauaaauuugauacauaaguuuuucacguguguucaacagaguuucaaauaaugcugauccuuugagaccugcugaaagucugaagcagccuuaauaucuaaaauuaggaaauguauaaaaugugagaggucugauuaaaguuuuauauguagaugaguuaauuuucuuauuguuacaggucauccuguuuuccaucaauauauauguauauuuuuuuugagacagaguuucucucuuguugccgaggcuggagugcaguggcgcgaucucggcucaccgcagccuccuccuccuggguucaagccauucucaugcuucagccuccugagcagcugggauuacaggcuugagccaccaugccugguuaauuuuguauuuuuaguagagacuggguuucucuauguuggucaggcuggucucgaacuccugaacucaggugaucugcccaccuuggccucccaaagugcuaggauuacaggcgugagccacagcacccggcccgauauuuucaacauugucuuuuuuuuuuuuuuuuuuuuuuuucaguaaauuauguuaguuaagauuagccaauauaucuuuacucuggccugcaaguccguuuuuguuacugaccugauuccacaccccugcuaccugaaguauguuaguacugauuaaauuguuccaggaguuagaauggcaccuuuccuacuaugugcccuuggugaagacaauccuugacagauaucuuaaaaggagauaaaauaugugcuuaauuuuuugaggauuuucuauggugaauguuuaccucauugaaaaaugguggcuuucguacaauaucaaauuuaaugauucucagggaaaagaauuuuaaccaauuuuauuuuugagcauaaaggucuauuuuguaaacuuaggagauaauacaguuauaguucuaauacuacuuuuuuuucccuuuaccuaaauaguacccauuuaauagguagugugaaauacaggcuucuuuuugaaggcuggcaggugaaguagugagaacuccauuuccauuugggugcuugguuucucuuagauuaucaacaaauguaugaauaagaguuugauauuuauuaagcuauagacaucuuuucaaaugaaaguaaguuaauuacuauaccugaaauacugcuguguugaauauaaacuggaaacacaaugaugaauaguauuuuguaaauuuuuuaauuccuuuaauuaaaauuuuuuuuuaaauugugguaagaaacaccuaacaaaauuuaccaucuuaaccaucuuuaagugugcaguucaguaguguuaaguauauucauauugcugugcaaccaauauccagaacuuuuuuaucuugcaaaauugaaacucuauaucaaguaacucccagucccuggaaaccucuauucuacuuucuguuuuuaugaauuugucuacucuggauaucacaguuaagugaaaucauacaguauuugccuuuuuagaugggcucauuucacuuagcauaauguucucaacauucauuuauauuuuagcaugucaggauuuuuucauccuuuuuaaggcugaauaauacucuauuguauguaccacauuuugcuuauccacauauccauugauagucacuuggguugcuuccacuucuuggcuguugugaauaaugcugcaaugaacaugguuguguaaguaacuuuuugagauccugcuuccaguucuuuuggauauauacccugaaaugaaaugacaggaucauauuguaauuccauuuuaaauuuuuugaggaaguaccauacuguuuuucauagcaguuguaccauuuuacguuccuaccaacagugcacgaggguuacacuuucuuuauaucuucacuaacacaauuuucuguuuuacuuugacauuagccauccuauugggugugaggucguaucucauugugguuuuuauuuacauuuuccuaauaauuauuuauguuaagcaucaacauacgcuuguuggccauuuguacacugucuuucgagaaauguucauucaaguccuuugcccguuuuaaaauuguuuuuuguuguugagcuuuaggauuucuuuauauuuucuggauauuaaucccuuaucagauaaaugauuugcaaauauuuucucccauuauguaguuugcuuuuauacucuguuguuucuucagugcacaaaauuuuuauuuuuguaugguccaguuacauauuuuuacuuuuauugccugugccuuuggugucauccacaaaaucauugcuaaauccaaugucacugaagcuuuucuccuguguuuuaagaguuuuauagcuuuagaucuucuguuuagaucuuuaaucuauuuugaauuaauuuuuguauaugguauaagguaaggguccaacuucauucuuuugcauguggauauccaguuuuuccaccaccauguugaagagacuugcccuuucccauuugaauggucucugcaaaucccugaacuuuugagccucaauaauuuuuguugguggagagggcacucuccugucaaacuugcuuaaauguuuuuuccccaucuuuauuguguaaaagaagagcaguggcuagaaaugugagaauuggaaucccaaucuuggccucgccauugaauuauuauguaacauugagcauucacauuacuauuuugagccucugcuacuucuuauuccaaguuggcaauaaugaagccauuguaccuuuaauauagaauuguugagagguuuaaaugggaugauauauuuaaaauguaccuuauuaggaugucucacuagacaaaagcauccuuuuccuccaaaagauuaguauguuuaccucuaguuuucuauuuuuuucagcuuuaauuuugaaauuaaaauuauaaaaaucuucaaagcugauuauuacaugcuuuaaacaucuauuaguaucacgaaguauauguuuuucuuugggcuuuguauuguaucccagaaaagcaggugugaaagaaaauuaauauaacuuggccaaaguugucucaguggcauuuaauaagcauaggaugauguuuuuaaagaaguguuaaaacaauuuaaauaauuuagcagauaagucagaaagucauucuuuugcaagaauacuuaugugaaaaaagcacaugccuuaggauucuuucaaauagggagcucccccuagugcguuuuagaugagauuuacacaaguuugauuugcagggaaccuuuuaggagcacauauguuggguaaaucaagggauaguuuaauaagauuuaacugagcucaaaguaguacaaaauggauaugauuuauuuccuauagagcauuaauuuaauggugguauaauuuaaaugagaaggaauauccccaaacccagauuuuauuuucuuuuaaaacauuugcaaaauauuucuucagaauuuuauacucuaaaacuguuuucuaaaagaaaaaauucuccagucaugaucugaaaaaaaaaaaaaaaagaaaaaugaaaaacacuauccuaaggauguuauugcauucuuuuuuuuuuugggauagaguuucacucuuguugcccaggcuggagugcaauggcgugaucuuggcucacugcaaccucugccucccggguucaagccauucuccugcuucagccuccugaguagcugggauuacaggcucccgccaccacccucggcuaauuuuuguauuuuugguagagacgggguuucgccauguuggccaggcuggucugaaacuccugaccucaggugauccgcccaccucggccucccaaagugcugggauuuacaggcgugagccaccgccccuggccauuauugcauucuuaauuagaaauuguucaaaacaaaucuuaaauacaaaagucaaaaauaggccgggugccauggcucacaccuguaaucccaacacuuugggaggcuaaagcagguggaucacuugaggucaggaguuugagaccagccuagacaauguggugaaaccccaucucuacuaaaaaaaaaaaaaaaaaaaaaaaaaaaaaaaauuagcuggggggugguggcaugugccuguaguccuagcuacucaggacuccuggaguccugguuggaggauugcuugaaccccggagguggagguugcagugagcugagauggugccacugcacuccaacuugggcaauaggcugucucaaaaaaacaaaacaaaacaaaaacaaacaaaaaaccaaauaauauauucuacuuuaaagagcauuuuacuuucuuucgauauaggagaauaucgauaauuauguauuauauacagcuggaaauuaaaagaucaggaacaaaucuaauauuugacaucauuggacuuauuuguguauuuugaauuaaggucauuuguggucaaaauuaguuaaaaggauuguuuauuuagucauguucaugucauagauuucuacaaagagauuauauaguauuuuauagcuugaaauguuucucaaauauauaaaaugauuuuuggccauaauaaccuugacucagauuuauacucuacaauuaaauuagucuugguggacuuuucuuguuuuuuggggcuuuuuaauuuuaaaaauguuuagauacaaagucucucuguguuacccaggcuggucuugaacuccugggcucaagcagucuuuccaccacgccuucggaguagcugggacugcaggcucuugccauuguacucagcuuaaaaaaguaauuuccuuauauaaacuuuauuuuuguuuagucuuacuauuagucuauaaaaguuuaccaugguugccagacuuuaaacaaaauacuaaauuuuuaaaaaauuuuguuuugguuuguauuuucugaucucuaacauuuuuauugagauguaacuuaaauaaacaaaucugaagugugaagcuuagugaauuuuaaaauauacacucuuaaaaaaauugaacauuugcaucuacugacaaguuuucauuaaacuuucuguguuuuauuauuauuuucauagggcuuuagaauggaagugauuuuagaaguuuacucaauuuuccucauuuuguaggugaagaaaaggcauagaaagguucagaggcuuaauuucuucacauuuaugaaauauuuuuaaaaauuguaauuggugauagaacaguuauggagauuuuauuaaggauuuguauauuauuuaauaacauuuuauuuaaauguauaagcaguggaucugaguugcuuucuucaguuuuguguauaguucuguaaugcaguaugauuucuuucaguucuuguuugaaagcuaagcuuuucauuuugucucuguuacauuuagucuuucuuguaacauucuaucuaaauacuguuuguuacaaaauuagcuuuaguuggauuccuuccucccuuuguuuggcagaaaguaaaugaauuuagggcagcgguccccagccucuuuggcaccaggcugguuuuguggaagacaguuuuuccauggauugguagaggugguugggaugguuucagaugaaacuuuuccaccucaggucaucaggcguuagagucucauaggagcgcauaaccuagaccccuugcaugcacaguucacaacaggguuugugcuccuaugagaaucuaaugcugcugcugaucuaacaggaggcggagccccaacgguaaugcucacuugcccacugcucaccuucugcugugccacccauuccugaugggguccagggguuggggaccccgaucuaggggauaaaccaggaaagacuucuuagagguaguagcaucugaagaauaaaaguuuacugagaacccagaacccuugcagguuagggggcaaugcagagugaagaucaugaucaauggccagaugcgaugguucaugccuaguaaucccagcacuuugggaggcugagguggguggaucaccugaggucagauguucgagaccagccuggccaacauggugaaacuaaaaauacaaaaauuagcugggcaugguggcgggcgccuguaaucccagcuacaggcacccucaggaagcugaggcaggaaaaucgcuugaacccaggaggcaaagguugcagugagcugagauugcgccauugcacuccagccugggcgacaagaacgaaacuucaucucaaaaaaaaaaaaaaaucauggucaaaaacauaggagaggcugucccuguggcucacaccuguaaucccagcacuuugggagguugaagagggaggaucacuagaggccaggaguucaagaccagccuggccaaccugguaaaacuccaucucugccaaaaacacaaauauuagccaggcaugguggugcacgccugcaaucccagcuacucagguggcugaggcaggagagucacuugaaccuaggagguggagguugcugugagccaagauugugcgacugcacuccagccugggugacagagugggaaucugucucaaaaaaaaaaaaaaggcuggagguggggaggccuggggacguaugggauaguugacaggauuuuauacuguaauuacuuuaaggccuagauucuaauaacauacauaaguauuuaauggcacuuuuugguuuugugcuucauacuuuaaguuucugauguguagcuaguuaauauagagcuauuaaccuuguucauuagucaauuuuuccaauguaguaugccaaccaguauuaggguuacauuuauaacuuuuuuccuggagaguugaugaguuaacuaccauauuuucauuuaacuuaagguaguuuugaaaauuucuaagcauuauaucuuaagauucagaaaaauaagaccagauccacuuaugaauuuccauuccacucgugaccugacaagucguauaaccucucagccucacuuuccccauuagacaaauagaaugaaaagaccuaucuugcagaacugugauaaagauuaaggaauguacaacauaauuuauuauuguaacacaaccuauuaaucauuuuuauguauuuucucuuauuugaauuuuaaaaauugaaauuaugggguacuagagguuuuuuuaaucuugcuuuuuucagaacaagcagcauggugguauggaaagaacugcuguauuagaacuggcugugccugguucugucacucacuagcuuauauuguauugaaaagucccuuaaucucucugagcaucaaguuucucauccauagaauugugauuauaccaaugcuuaaauuuugugaggauuagaaguaauauuuguuaaucaucuagcaaaagugccugccuggcauaugguaggggcucauuuaugaugaugaucaucaucuccaguauuacgguaaacacuuaacaggauaaaagcuuuuuagucugaaaccuuugacaaaaacagaauuaagguuguuccauaaccuaucauacaguuauguaucgcuuaacaauggagauagguucugagaacugcaccauuaggcagaucuguugugggaacaucauagaguauaccuacagaaaccuagaugggauagaugacuauaccccuaggcuauaugguauaugacccauugcuccuaggcuauacaucuaccuguauagcauguaacuguacugauugcucuaggcaguuuuaacacuuacaagcauucaugugucuaaacagauauaaacauugacaaauacaguagaaauaugguaugaaagauaaaaaaugguauaccuagauagggcacuuaccaugaauguagcuugaggacuggcaguugcucugggugggugagugaguucgugaugagugaagugaaggccugggacaguacacugcuguagacuuuauaaacuguacacuuaggcuacacuaaauuuauuaaaaaauuuucuccaauaauaaauuaaccuuagcuuacuguaacuuuauaaacuucuaaaguuuuaaaacuuuuuaacucuuuuuaguaagauuuaagauacaaacauagcuguauaaaauauuuauauccuuauucuguaagcuuuuuucuauuuuuaaaauuguuauuuuuuuaaaaacuuuuuuuuuuuuugagauggagucuugcuaugucacccaggcuggagugcaguggcucgaucucugcuuacugcaagcucugccuccuggguucacgccauucucccgccucagccuccugaguaucugggacuacugccaccacaccuggcuaauuuuggugguuuuuuuguauuuuuaguagagacgggguuucaccgucuuagccaucaugcucuccugaccuccugaucuccugaccucaugauccgcccgccucggccucccaaagugcugggauuacagacguuagccacugcacuggccuuuguuaaaaacuaagacuuacacucauuuuucuaggcgcacacagggucaggaucauuaagaugucaggaggugauaggaauuuuucagcuguauuauaauccuacaggaccacugucauguauaugguggucugucauuggccaaaacauuaugugaugucuuacuguacauccaucaugagaagccauaaguagcuauccaguuuuuucuggcuaaaguaauuuucaaagcaagaaagguuuuaaacuucuuugagaaaauuuagaguuuauuucuaggacuuuguauauuuuagaauucacguuggugaugguugggauggggguuuaggggaggugcucuccuccagaagaaaagucaaguguaaaauauauaauuccuuuuauuugucguguagauuuguguaggaaaagacauaauaggauaggccuaggaagaauuuuuuuauaugaagauuuuuuuuugaagggcauauauaauuggaaauugauuauugguauauggagagagagaauuguacaugaaaaguacuauaacuuaaaaaaccuuacaguuaagaggauuaguuguaaccaaaggacaaauuuaugucagucuagugauuaguccuaucaaaaauuauucuagcuuucauauaaccuguuuuuuauugccuguuuuaucugugacauguugacaucuuccuucuauuaguuuuugcccaaaugaggugugggacuccuagugaagguccuuggaaggauuauauuuucuauaaaacuuuauuagggacaugauaacaguucugaauaugugagaaaaaguaauuguauacuauuaggugaugcaguuuguagcuaggaaaugacagaguugaugcuggugugucagaguaaaacuuucccuuugucuuaaagcgagugaaccuuguuagguacuaggaaacaacaacagucuuuugguuauucugggguuucaacacuggaaauaucuaauaacagaauuauucugaaauaauugaaaacuauuuuaaauaaggaauugaagauaauugaauaugcagugugaaaggucaggcugcaagugacagugggugauguugcaagacaaugacaagguacagugcuuuuggauuaucaggaauuagcaaaaugaugucuugguguccucugguaauuucugaguugugaacuaucuugcuuauuuauauacuuuggcagguaaugaaauaaugaauguaaaauuuugaauuuuguguaaucacauuucuuaaaccaauaaguuagaaaggaaaaccaagagauugcauccacaagaucaggccuaaauagguaguagaaagaauagaaggucuuuauuuuaaauuuuauuuuuaauucagaaugggcagugucuaaucacaaaugagauuauagugaauguaaaucuuaauguaacaaaggauuaucuugccauguucuuaaaguuuccauuuuaaugagcuuuaguaacauucuaaaacauguagcaaucugugcagucauccguaugugacaucugcuucuucaugaagugcauuucuaagguaaaacuauugguuuauuuguauguauaguuaggaaggcuuauaaaacuuuuuuuuuuuuaaugauaggcacaaguauuauguaguuagauuuuuuuuguuucuggaaaauguuaucuacuuugaaaauuuuaaaucuauaaacacuugggaagguguuuagcacaagcaucaauaaauguuucaaucagaaucuagcaagaaaggauucuuagaaacuuuuacuccuguacauguacuguguaauggauuuagagaaauuuguuuccuccuaaaaaaucuuagcaauguuggguuaguaccauuucuuuccuugaaaacaaaaaaauccacauuuuuuacgaaccagggccccuuaaaacuaaucucacauuaugucuuuuuuuuaauuauuauuguuuuugagacacagucuugcucuaucgcccaggcuagagggcaguggcaugaucuuggcuuacuguaaucucugccucccagguucaaacaauucuugugccucagccuucccaguagcugggauuacaggcaagugccaccacaccugacuaauuuuuguauuuuuaguagagacaguguuucaacauguuggccaggcuggucuggaacuccugaccucaagugauccuucugccucagccucccaaaguguuggauuacaggugugagccaucacgcccggccucacauuaugccuuacccaauuauuuucagauuggccuucagccauagcauaugggaaacaauauacuguuagaguuuuccaagugcuuuucaugaauuuuuuuucccuuuuuaaaauuuaaugcuuuauugcuaacuuuccugaucugaaacauuuauuaggcaguucuucauuuucaguuguagccuuuaagauauuuauauagaaggcugucauagaaugccaucuucuuuuguaggacaguugugugugugaauugauuuuuuuuuuuugagaccauauuuguagugugauguguagaaggaaguaaccagaaugguuuuaucugcuucuuugcccuacauucaaggucugcuugugauaguauuuaaaauugaguucagugcugaguucaagaugggauuuaaccagacuuuuacaaagguagcaucuguagauuuuguagcagucuacucaaggaggugauuaaucuugagagacuagacagauuucuuuuaggucaaauuaaauuuuaccauuauugcuguauaacuccauucaccuaucuuugaaaauauguuuacaucuugguuuuuauuuauacguuuauuuuuaaaaaacauauuucuaacauguuuuuuauuacaugcuucacuagaauaaaauuuucccaaguuauuauuacccaguuuauccugaaaucuuagccucaggcaguccucccaccucggucucccaaagugcuaggauuacaagugugagccaccgugccuggccccaguccaucuaauguauguauuagauucuuagaauauuacuauuuauuaaguaaaguuauauuucugauagcuuaauuacuccuuauaugacagcauaaacacuauuugccuggcacuacuuuuuaggcauuccccagaccaguuuguuaauuucauucaaacuuuagauuccaguucaaguauaaaacucaaauucugccaaauuauuaauauuucagauauauugaguuuauauuaucgucuuuuguaguuauacuuagucuuaucaauuauugaauuucccuaauguuauuauuauuuuuuuuuacaaagucaaacuuuagugauucugcaguucuuauggugacuuacgauuucuuacauuauuacucuucagucuauuauuaaaucaaauuccaggauggaguuccuuagucguuacauuaaaacagauauauggaacuccccccuacuuuugcuuaagucauaguauuccaucuguuuuuaaugcuguuguauuuuuaacauaaggaauuacgugguugaauaaaggaauuguaucggaacacagucguguaacggaguuacuugaaacuaaaaauauauuucuuauacuguggaauucuaacauguuuucuguagcuguagaccuuaauguauucuguuaccagauuuuuauauucuagcagauuuuauuuuagaauaccaaacacauuuuuaauuuugaagaguauuuguuuugaacauauaauaaaugcacaugguuaaaaaaaaguugaaguauuauaaaaaguuacccaauuguuuacuuccuuucuauggaggcaaccauggcuaaucaguuucuaacguauccuucagagaucuuuuuuauguggucaaagguuuuacaaggguuaaugucuuaagaugaauauuuuagaguuugacaucaaaagacucauuuauacuacacuaccugagauuuuaacaauaaaaauaauaaucuuacugaaaucuaaaacaaaugugaaauuuguaauucuggccuuggaauauugauuuaaauauaagcauguuaggccuuuauugacuuaaguaauucuguuuuguuuguaauauguuauuacccaguuuguguauuuaucccuauaauuuaaugaaccuccuccaccuuuaaaaaaauuaacaguauuaaugacaaugaauuauugacuugacaaacaugauuagcacaucagaagauuuuaugacccguuuaaggguaagguagcauuccuaugccccuccuccacuacauuuucaguuucuuagguaagugaaaauaauuguuuuccugagaucagguuaguuuauauuuggaggaaauuaccuuuucuuaguauuuucaaaauuuuuuuucaaaauuuguuguaacauugcaaaagcauuuucuuucaaaaauaacauagguuauaauagauaauaucuguuuacauuaauucuuuaaauuuucuuauuauugagauuuuaugcuuuaacugaguaauuuaacaccaugguaauugguuguugagagaacuauaauaggaaauuuuaagugaaguaaaagguuuugcuuuauauuaucuuguggcagaacucuuacuugagguuuuugaccaaaauuaaaaugaaaaauuuuuaaugacagauugacuccuguuaguaaguagcucuagagcuagaacauuauauuuugcauuauauuuucuagugauauguuuggauuucuuuaugacaggaaccacugcucugagaguaaaacgugaauuuauucugcuaauagcaaaaguaaacuuuuagucccucuacuggcugucuuuguuguagcagagcuuagauuuuuuuuuuguuuuaaauauaucauuauaauuaugauaaaggcuacuuauaacuuuauggccaaggugaauauugacagaacuucuaaaggauugucucccaacugagugacuuuauaaacauacuuacuuaggaauaacaauguaaaauaauugcucuuaaauauaaggauuugggaauuauuaaauugcguaggcuugacaccagauagugaauaacauuauauugcaguaauuaaguuguaacucucauuuagacuuuggagguguuaaaacuuuauuuuuuuguaaaacaugacaaaaaacaauacuggcagacaacuaaaacuuuuuuaauuugcuggguaaacaauguugacagagaaagaugacauuaugcagcaacaaaacagugcaaaacaguauauaagaaaacuuucuuggagcuacauguucacuuucugcuagugauguagaaauucaugcuuaaauaaauuuguuaaugucaaacauuuauauaauagagaugggggcacauuuuuccugaagaaauaauaaaacaaccuuguguguauaaauuacauuaacuuaaucauuauucuaauuuuuguaguaacugauuauugcuuuucuuagugugauucuugacuaagcucuuuaaucuuagaggggaaagaaucuuaggcauggcgggauaauugguacaaugaggaugauaauaauauuuuucuuuuuucuuuucuauguuugaucuuuaucugacuuuuccaaaauuuaaagucacuaaagaacuuauuauuuuaucuuguguuuguguauauacucucugaaaguugaaguuauauuguuuuuaaaaguaaacauuaguauauauuguguuuuguuucaguguguguugggggaagauacacugauuuuauacaucaagaaauuaauggcuaaguaauuacagaaucacaggaaucuaccaaguaaaggaauaguuuuacuauaguuaauuuuauugcagaaaggauauauuaaaaacaaaacaaucugauuauaaugccauuccuuguuggguaaauauggcacaauccagguuaguauggaauuauguccaagagaauuuagcagcugccaauaggaccuccaggugguacagaaagaccauguggauuuuagaauuagaauagcuuaauaagguucuggcuuugccaccaucuaggccaccuugaguuauaucauuuaaucucccugaauauuuuaccucacuaaguuuuuuuagggucaaaugagauaagugcuuuauuguuauuaucaagacgauagcaguaauguuauuguuauuauaguaauuucaggcccguuuaaggguauccucuguggagaguauuuuguguaagacuagucaaguuucaacuaaaagcuuuguuuuguugucuaagaaaaaguaacuuugguuuuaguguuugaauuuagcuuaauuaaauuuaauaacucagacuuucuguuaaguuuuaauauauuuuaacuuaauuuuguagacaugggccuuuaaaaaguauuaccuuucggguggaugucaucaucuauaugagucugcuacaugguagauuauuuuucuuuaauuagaaguaugauuaaucucuugccucugaaagauaauucuaagugugcuuauacaggaauaaaagugaaugggugucagacuuuuggucagaaaaucugauuucuuuuuuugagacggagucucacucugucgcccaggcuggagugcaguggcacgaucuugacucacugcaaccuccaccuucuggguucaagggauucuccugcuucggccucccgaguagcugggcacuacaggcaugugccaccacacuuggcuaauuuuuguauuuuuucauggagacgagguuuuucacaguguuuccuagacuggucucgcaguccugacaucaagugauccgcguaccuuggccucccagagugcugggauuacaggcaugagccaccacucccagccugauuuuguuuuauguuaaaauguagaagugauauagaagacccuacuacaaauauuugguccaugcugugguggcuuuuagagcuuugcugauuuuuuuuugaaaggcaccaagucaacaaaaguaguuuagcuuaaggguggaagcaagauaauauaguuucgaagcuauuaggaccucuugguuuucuuuaucucccuuaggcaauuuuugagcuaaaauacugguagagaccaagagagagauuuauuguuauguguacauauguuuauuauguaugagaguagagauuauauaucauacacuuaauaguaaccacucaaaucuuugaauggccaacacgaaugaguagauaguggauggcugaaagacacaagagggagauagugcuccuuuuuauacucuaguagcccagcaaauucaugaguuguuaugcguugaauuuggggaguacacauuuauauugagguaaagguaacauacauuuuuugaaucuuuuugaaguuugaguaauucuaaaugguucugugaacccaggcugauuuguauuaagcuauauucagugagucaaugaauaaguugaaguguuuugugcccaguaccugcuuagugguguggaaagaaauaugacauauucuuugccuucaacauguucaaacacaugaaaaaauagcaagcaauacaagaugguguuuuuuuuuuuuuaauaaauugugguaaacacaacaaaauuuacugucuuaaccauuuuuaaguguauacuucugcaguguuagauauauucacauuguguaagaugguguguauuuaaauucauauuuaaauuaaaaauuauuugaaaaggugggaggauagauguuguagggaagugguauucaaauugugcuccauggaaccacucaaauccaauuuuaaagaaacauuuuauuuaccuuauuuauuuaauuuaaaguguaaaaacuaccacuauuagaauauggagauggaaagaugugauuacuaaaggccauaguaaucagggaaggcuucguggaaaaugcagagauuuaaacugggccuuaaggaaugaguggcaguuggguagguuugaggagggaagaggaaaagcauucuacuuuagggaaacaaucaaagcuaagaguugggaaugaacauugccugagaagaccuauauuauuagaauuuauuauauauuuugggggugaaugguaugagagacaauauaauguaauguaauaauuccccaaaaugaguucuuuuuaacaugaauauuacagaggaaaaggagggauaaauuaauucauguuuucucccugcaagacuccugugacauuuuaaugcugcuaugcauuuagaaucuucuagagauuauaucuaacauauuuuaaguuuauuuaaccaaaggaaucuuucucccccggaaccauuuuuuucuugggcaccaauuagaaaagugcacgugucacuuacaaguugaaugauuugaucaagacgaucuauuacaugucccccuucccacuuuacgaugauuagguuauaaucauauaacuaacugugaauucauucaauaaauauugcguauauauuauaauauguuaggaauugagaguuguaagagaaagguuauaggaccauagaauauuauauguuuauaacucuucuacauucuuguuguucuaaguauggucuguggcuauuagugucuucuagcugccagucuuguuagaaaugaagaaucuuagucuucaucccagacauaaucagaaauugcauuuuaagaucuccaaguggcucauaugcacauuaagaaauugucauacacaguucuacauuuuauccaagaaagcuucauucaauucuugguaccauuaguggcagagaauuugauaccuuugauuucaaauacaagguuuacccucuugaaauuuauauccuuuggucuuaguucugucaguccuucaaaugggagccauuuauauguaaaaggcaagcuuauguuugucuuagucccuuacagaugugucgccuagaacucaucguugugcuaguagaguggguuggccagagauuugaauggaagcuauugaaguuaucucaccuucuauauagagcauuugagaacccgugcuacucuguuccauugcuuuugcuaccacuauuuuuguacuuuucucuccaagcauuuucuuuagguaaccauuuuuaauuuuaacuuuucaucuuguacuguuguuaaauuuuugcugaauuuagaguagcucuacuauuuccauagaaauagcucuuaaaaucuuucaaaucauuuaccuaguuauuugcuuagacauuucgauuacaugcauaccuugugguaauguucaccuacugucuugccuuccuuuuuaagaaaguuucucaggaaauguucuuuuuuuauuguaacuuguaauaucuacaaaaaucaaauuauuagaauugaacuacuagggucccuuuuaagaaauuaaauacucuuaguaacauaaauauacucccucuaaaaaugaaagcaauacacaaauuuauaaagaagugaaaaauccaccucuuucucuaccuaaucccucuuucucaggguuaaucacuguuuaguuuaugugucguucuauaucuuuucuuaaaauguacaaacagguacauacuacauguaaaaugaaacuagaaagggagaucguauauaugcuguucugagaauugacuuuuuacuuuguaagccaaagucuaaaucuuuguaugaucaauguguuuuuugacuuuagggaagaaacccuuuuuucuuggagccagcaauaauuaucacaauuacugaugggagcaaguugacuaccaccaguggaguccaggaugagguaaguugugcuuauauuacauggauuaugcaaaugcaguugaacaauccuuuauuuuuguaggauacugaacaccuuuaauagguucucucguugauuauuugaugcaauuuagagucaucugucuccuauggcccaucuuuguuuguagcaguguucuuauuuucuugaauaagaaucucuucugugagaaauguuugagcauacccacaccucauuuguauguguaauuaugaguuuaugugagggugacaguuucagucugucauaaauaguaaaaugaauuccuuaguuuuuuucagauuuaaaaaagggaaacagcguucuaguaauuucuuccuauauuucaguggauugucguuggcaguccagcgacuguggaaacuccuuggcuagaguauagcaaagccaagaagagguguuaagacuaggaaaaguaagguuuuucgacauuuuuguuuucucuaagucaaauguauuauacauauauauauauauauauauauauuuuuuuuuuuuuuuuuuuuuuugagacagagucucacucuguugccccggcuagagugcaguggcacaaucuuggcucacugcagccuccaccuccuggguucaagcgauucuugugccucagccucccgaguaacugggauuacaggcaugagccaccaugucuggcuaauuuuuguaauuuuaguagagauggugucuugccauguuggccagguuggucucgaacuccugaccucaggauccaccugccuuggccucucaaaguguugggauuacaggugugagccacugcacccagcuguauaaaaaauuuauagcuaaccuuaucuauucuacagcaacauucauuaugcagaguuguguguggugugguauaaugaauauaauagauuuuuuuaauuuuaagguguuuuuacuaugguauuugaacugcucuuuaacaugggcugauauagaaaggugauuguuuugauggagcuuuauuguuugcauuugcuuuaguaucuuaauucccaugguauuuauaaggguuuaauuaagcaggaaaaguauacauuuuaaguucaguagcuuuuagaauuacuuuauuugugugacauuguggaauacaaauuggacauggagucagggcauguggguccuagucuuuguuuaucuacuuucuagcaguaaacuuuguaccagugaccugacuuccuaauuucuauccuucuccaugaaauaaagagaauaacauuugccuuacuucauaggguuauuggaaguuugaaauaauguauaugaagguacuuaguaggcuguaaagagaaguauauaguauuauucuuucaugaggcauuggaaccacuaaagagauauaauucucugcucuuauuugggggaaaagagcuaaaauuguuuuauuugaacaguugauaauaaagggaauuuaggauauaauucauggagauagagcugaaaaauuuagguagauuauaauccaugauuaaauaauuuauagucuauauauaaucaguagccuuggaaugcucuguagcugaacuugaugggcuuuugggcuuuguuagauuaguugacauguacagccaauugugguccugcuacuuucagaaacagguagacguggauuauauaaaaagcaagcaauaaaaauucauuuuagccgggcguggugguucacaccuguaaucucagcacuuugggaggcugaggcgggcagacaugagaucaggaguucaagaccagccugaccaacauggugaaacccugucucuaccaaaaauacaaaaaaauuagcugggcgugguggcgcacaccuguaaucccagcuacucaggaggcuaaggcaggagaaucacuugaacccaggagguggagguugcagugagcugagaccgugccacugcacuccagccugggcaacagagcaagacuccgucucaaaaaaaaaaaaaaaagaaaaaaaaagucauuuuaaauuugaagcucucaaauuaauuuuucuucuuaauaggacacauaauaguuaacagcuucauucaacuuuauauauuaauaaauuaaaagucuuuugaauguuuguuuuguuuuuauccauaaugauuuugcuugagaaguuauuucuguuuucuguuguaaaguauucuuaugugcgaggugaugcauuugaggugcugucuacugccuuuguagaaaugcccuuugggguacaauguauuuuguuuccauaugucuggaucuguuuuguuuguaaaauuuguuuuguggagaccucuucuagcuuaaaaauaucuugaaauauacauguguauuggaauugcucaccuuucuuccuaugucuuuccuugggaaggauuuuggaaaaauagggcaauguguuuauaaccugaaacuaccuugcuaguaagguuaggaagauuuuccugugggcagaguuuuuaccuuuuaguucuaucuuuuacaauacuagcauaguauugacaacagagccuauauuuuuaaaaaguauugauuauaaacauugguguauugaaucugguagucauugaguucaaaauugauuaccguugcaccuuauuaucugagguggaagguucauuuguuuuaaagcaaaaguaaauuauuuugaaguuggaacauaggccggugaguuguuucaagguuaggaaugucuuugauucccugcguguuuucuucuuaauguaccaacgagacucucguuggagcaaugagaaaguuauccuagauuaauuuuugcuaaauguugugagauauugugaaauauucuagccuaaauaauuaugggauuuguuuuaaggagcuuuucaauucauagaaaagcauaaagaugcuuuuuguauuguucuucuguguuuguauugugcacgugcaugaaugcuagauaugaucuguauucugguuccuacuagggaauaacaauuuugccuuuauaucacugucuuuucacaucucucaaccuuugccucuggcagaacuugauucuuuuuuagauuuauucaguguaugaaugugucauuaauuuccacauuagagauauguguacauaauuccuguuuggcuuguggcugguguugguaugaccuauuacuuuuuauggaguuguauaauuccaccuguaugauauccuuugcuuaagagucauguuauccaacauuguauauuauaucuguucuguuggugcuguuuuucaggaguaaauguucuugcugcuuuaaaaucauccuuauaucauaugaggaaauauagaacucauuuagucuuauauuuuacaaaugagaaaauugagauccagggagucagagugauuugcuuagguuauaacauuuguuacugccaaaaucuagauuagaauuuaucaauuccaaagacauuccagcaccuccagaccagugcuuucuuccugauacggcugcugccuuuuugcuugauucuaaauuuguguguucuuaaaauuuaccuucuauuuaucugauuucuuauuugucuacuucagcuuucuauguaagugucuuuuagguauucuguucuuauucaguguuccaugaaaaacuauuaugaccagagcauuucuaggcaaugaggauaacaaagauaaacaggacauaucugguucuuaauauuuaaguucacaguguuaugggggaaaucaccuauuaaaugguuuuaugaaugauaaaauaaggauacauacuaagugugugggaguacuaaagcaggggaaggguuaauauuaccuuucgugugucaaaucuuguauaaugugcauuuuuauaguauaauuucauuuuugaaugacugaauucaaggaucuuauggaugauuuggcauaggguguggcuccuaccuuguaucugugaauuuuaggaagaagcccaguguaaaguuguuuugagccuagaaaauaguuuuccuagcggcaggaaaaauguggugccauauugucucuugaccuggcuaaguauguauaggcccaaaugaaccaauuucuuauaacuuguuugucagaaaaauguaggaauacuguucucugggacagcucgucacuuagcaauguguuaugaguuaggaaagaaaaguaauagauacauuaugaaugaaaaucuugagcuguauaugaucauuuuacauuaauuuaugauuucaauuauauccuugggccucauuuaauaaaaguccaggccauugucugaagugucaugaauguauuucuaguguagucuuuuuggauaacugucuaggauuucugaugauuacuuggauugaauuuuauguguauauauuuggcuuuuuuuuuaaugcagcuauuugauaaaacugguuguagcauuuucacuuacgaggaguguguuugauaggacuuugaauucugaaacacgauaaaacuauauuacuuacuuccuuaguaguuaccguugauguugauaaacauaccuguguccagauacucaguacuguuugucauguuauauaacugauauaucaaauguuuugguagaaucaacaaauuagaguuauugaaaaggauuuucuucugauaucugcagauaauccucucuaguacugcuuugcaauggaaaacuauucuguacuaugauuccaggaacacauggcuaaugaauauugcucaauagaggagcccagaagaaauccugccaguacuuucuuagugaugaaugacauuccaggauaguguagcaguuauuuuucucuuccuugaaagugcuaauaguaguauugucuuucaaauauugagauuucuauaugcugacaaguccuucugcaucucuuuaccaauguuaugauugcuguggaggcuaacguugagagaagguauuugcagccaaaguaaucuguugggaagaguuuuacuugcuuauuagcugucccagcuuuuuaagcccaacuaggacaacuacuuuuguaacuucaugggauagauauucgguaagggcaugucuucauagaaagagaaugaguagucucagcuguguauucaaauggcuguagauuggggucuucuauuccaacuuguggguucucaaaaauggaugcaaaaguccaccaugcuuugagauauggauaauucuaggcauuguaaauggguuuaguuuaacuggugaagauuauaauuaugaugugcauuuaauucuuaaugauuaaaagacaggccagaaauuuuugaaaucaguuucuaguaucugaaaugauuaaaaaaccacagcucccuccccuaccucccauaaaauguuuuuauucacuaaaaucacuaaaaauauuugccuuagggugucaaaacucugauuucauuguauacuuuuaaauauauauuuaaaauaguugcuuuuccuaagacacuuagaauuuuggagaacuuucucuuuuuugaaaagaucuguaaggaauuuugagggaugccacaguggugugauagaaaauauaaaacauuuuaucuguguuacauguguuugaauuuucauguuuauccuguaguagccucuucauagugauauuacuagggacucaguaaaaaucugaagauuagcucuugucuuacugauuugcgauucagauguucuaaauacaugcauaacacuacuguauauguuagucucugucaauucaucuuucuaagaacauuuaauaagaauuuguugaauguagaccauuuguauuucuuuuucuacucauauuuuuggcccuguucucucaaccccuggauuuauuacugcugguauguuauaggaauauauacaucugcaauuauuaguaguuuaaaaauauguaauuauaauaaugcauaauuaaagaaguugaugaaauauuucaauuuaauauaguaaguuuucagcaauuuacauuugcaguacucuuauugauauacuuuuuuucaagaucauguaguaagaaagacucuucaguacuucuaggcaaacacaacaauggagaaauuuaaaagaaaugcugguugaucauucuaacaaagcuguauggccacaguaacuaauccgcuaucuagaauucuuuguuaagauauaucaaaauaguuuuuauucagagggugaagcaauuucacccuguguuuauuagccuguuagaaccaauaagcaauaagagagucuacauauguaaggaaaauuuuauuuagagauguuucuauuauccaauucuagcucuuauauauauaaaguacugugguauuuagaacaguagcuuugaaauggcugcaggcugcaucaaaaucaccuggugugccuuauagaauacacaugccuuuguucuuauucuggaaauuuuguuucaguugaucuggguaaggaccugggaaucuguauuuuuacagugucucaugugauucugauguacagucaaauuuagaaacuauaguuuuagaacacaaucuaaccacaauuuuuuuuaagcuacacaaaaagcaugugaaaaugaacaacuuuaacaaaacagguuagaaaguuagaaauguuuuugacuuagaaggccaccaaaaaguauuuuuuuaggauaaaaauaauucuugaccuuuagaauuguuaaauuugggaacggguuuccaagggauauggaacuggccuucugugaauauuuuuaauaggauaauuucuaauuugcuugauauuuuagaauaaguuauugaauagcccccaaaaauuaacuucugugcugacugcagucaaucugcaguuacugcuuacagugugcuauauugaggacucuccuuagaccccauauaugaggagagaggcuaagaagagaagagcaguuaauuuauauuaucugucauguguuucuuaucccuggcuuaggaauuuuuauccaaaggaugguauaguauucugguauccuuacuaagccauaauuccugauuuggauguccauguaauuagcauuauacacacacacaugcacacacacacacacccccuaccuuaccagaugagagcaguuuauaaagaauuggugauaguuacacuuaauuuucuagacaguugcugcaaaaauacccuuccagaaugaauucguuagauuuugaauugugaaaguauauuuuaaauuaauucagcaacaguuuuccuugugauacauaguuacuuuggcuguguauaagaauagcggcagcuccauacguuuauauuuaguucuauauuuauguucuagguacuggggacacacagauggaauuaagcaaggcuagaaaacguauuaucuuugaagacaggcaaguaaauaaacauuuguaauacauuaagauaaaucucauggcagaaauaaacagaagguucugagacagcguaaagaaaggaguaaaguuuugagggaagaguaaggaauugagccaugacauaucaggaagagaaaacaguaugcaaaagcaugaagacuugaaaacaguguaucaggagauuauaaauuguacaccuggaguauggaaaguauagguaggaagaguagaagcuugaaauguagguagagggcagguaauagcacccuaaggagacaggacuucauucuguuagcauuugcagggaagguauugaagauuuuaagcaggugagucacaugaucagauuugcauuuuaguaagauuacugugccagcaaggugaaagguagacuggagggugguaagaugggaagaguuagcaaacuacauguaacaaccuagaagauauggggaaugccaaaacuuagcuagugcuggacaggaaggcagaauucugagagguucgguagguaagcuaggcagguuuucaaagaugauuuguaagauaggagaaaaaaggcaaaguauuugacaggagcccugaaccuaggguccaugcuuggucugaggagaguucugugaauucccugacauccugucuacacauuguccaucugugugcaugaacuuuuuucuggguaaagagauccauagcuuuaaucauauucucaaauaaguaaaaauauacugguuuaguauuauuuuccacuuuccaacuugggcaucuauguggauauuugguaguguuaacugagaugugggugauaaaaaauaaaggaggagaaaggaagguaaaguaauugacagacaaaguaucauuaccuuucguguaaggauguuuuaaaggauuuauaauuuaacauuuaaaacaauuaccucaaagacuuuuucuugccuuuuaacauuauguuuuaggaaaauauuuuguauuuaaaaauugaaaugagcagauucugauaguuaaauuuuuuuuuuacuuugaagcagauuuaaauaaauaagcguuaaaucagcuuuuaaaguuuguuugaaauuuaaggacauaugauaugaacauuuaaaauugcuuauuucaagcaaacauugaaaauucuacagaaugcuagguuaagagcaguguguguguguguuuuacucuguguacuggugucaaguaagucagaggauacuagccuaauuuuuuauuuaauagauuggcacuuuucuguuaaacuuagccuauuuggguguuucaugcuucuccaugucagauuucaauuuugagagaaugaaaauguugaguaugugguuuucugauggugcacucucuuguaaauaacccuuaggcugcuagucauuuauaaauaccuugauaauacuuauuuagcuguauuuccauagugauuuuauuuaacuuccacuuucacuuguucuuuucagauguaauacuguagauauuaaacuuuuuagacuuuuauauuaggaauaaccuuagugcagugacuagaaagacauugaaacuaugggcuuuacaucaaggcaaggcugcauuuugaucuagacaaggcuguuuugguauauuuuuccccacgcucugucuuuucagauugaauuacugauuuuucccccuuuguuuuguuuguugugguuuugauguuuuuuuuccuuucagcuaaaggagcagcccagugguuuucaagaagugcuaaagugcacugacugucucaugaugacuggugccucagggagggucaugauuccuggauacaggaucgaccugauccuggaugucacuucaagcagucagaucguggggaaaagccuugucuaauggcuagccuuccucaaaagucugaugcuagucaucucggaaggccucagaaaaagccuuaaaggugagcagaguagaguguaguucucucugggggcuaugacuauuuguuggagaaucugauucaacauagaaugacaacccuaaacugauaaauccagguucaauugguaauuaacuuugagcuuauaaauugguugaugaugauuaucagaccccagcuuuugaguuaguagaaccaccuugcuaagcuuaagaucuguaagugaggaacucgguauuuccuggggcucuucacagcuuuagguuaguaucuguugucuuagaccgaaauagccuugcuaucauagcuaaggaacacuuugguuacaaaauugcacuugguuguuaaguauggauaguuuuuuuuuuuuuuuuuuaauuuagcuagcaagguauucucuugauuuguauauuuauuagauaccaguuauuugguauuaccaauuaucaggguuuggaaggauaaguuugcauuugcuuugucuguuauaauaaccuuuuuuaaaaaaacauagcuaccuuugaaccaaguuuggauuuauguagcucguauuuuauugcauucuguugaagaauauuaguacuaccugcaucauuucaaugacauuuuuagcaccagaaaaagauucuccagagauguuuugaguauuuuggaaaaaguuuaauucugggccucuuucucugugauuugaagcacucacagaacucaguuauucauguaauaacauugauugcuaauaacguugauuacuaaauuuaaaugcuaaagcuuguccuaagacuuaacuuuuuuuuuuuaaaugaaccaccuauauuaguaaaaaaaaaaaaaaauuaaguauguaccauucccaguguaugcacauuuuuaaauuuagaaauuauauaugugacuacugcauuaauauuauuauguuaaaaacauauauuaaaauagaacuuuaaaaagaugagaggaaaaaauuuauacaaaggaaauucugaucuuugcuucuugaauaacauggaucaugauuuauacuaggggucagcaaacauuuucuuugaagggccagauagugaacauuuuagguuuuucagccuguauaguguguacuggaacuauuccacuguuggagggcaaaagcagccauagacaguauguuaaaugagugagaguggccguguucaauaaaauuuuauuuacaaaaaauaggcucugggcuggauuugguuggugggcuauaguuugcugaucgcugguguauacccuguuuuguagacuacuguucuagaccuuggaguuguauuguacuacuucuguuagauccuuuucacauuaguuuuagagaguggacuuuauggaauugauuuuuccuuuaugaaguggguagaacaccacuaguagagaguauucaguuaaagugaacagaugcuuauugaacaguagugaaguucagaugcaggguuagguacuggcucaugaguuugauaugagagguacaguuauggcauaguguaagauguaaaauuauuaaagcacaagcuaauaagaugguacaguugagaaagugaggccggagcuggcucuaggaaaugucuugaguuggauuuugaaagguuaauucaaguuugugaaguagauguaugcaaagacauaaaggucacugaagagaguuugggagaacuguauguaccucaguauugauagcuggcaaaguguucaagaaaaacagcagcaggaaaugagacuagauagauuggcauggcacguccuauauucucugccaaggaguuucgacuuugucuuacagauugaugaaaaccuuauagauugaaccuuacagaugggaaccuuauggauugaagagauuuuaguagaggagaaaguuauuagauuugcauuuuagaaagaaguagcguggacuauacaaagagcagguuuuuuuggcaccucaucuguuuucacuuccucauaaaagaggacaugauuguagguugaacuauaccagacauaaaauuaagaaacuuggagugcuauuuagcaauaaaaaggaaugaauugugacaugcuacaacauggaugaacuugaaaaacauuacccuagaugcaaaggaccucauauagcauuauuccauuuauauggaauguccauaaaguugauuagugcuugccuggaaguguuugggagacugacugcaaaugggcacagggaucuuuuuaagauguuggaaauguucuaaaacugcaugguggugaugguuguacaacucuguaaauuuacuaaaacucguugaacacauaaaauggaugaauuucucaauaaaguuguuaaaaaauuagaaagacuuuaccuuugcaauuuguugggguaaaacuuuguugaagaaaguauuucaguauugcagguugucaagugauugcucuuuccucugaacaaauauugaccuuaaacuacuagaagcuaaaaaaaaguuuugauuuuuuaaucaaaaauuccuuuuggauguacauuggauauuccuaaggauacacauuuuuaacuguggaguguaacaauaggaacuaacaauaaauaauuggguuggcauuaaguuuuaugggauucacuuugacuuuaauaauuuuuuuugagacaggaucuugcuuuguugccuagaauuucuuaauuuuccuuuccuuaauaaauaugauaugaggagaaccuucuucauugcuuauauuggauaauaguauuaaaguuagaaauagccuaagggaaauuuacuugauuuuuuuuuuucaaggaaauauacuaaagaaaaagcugauauaggaugcuuuuaaauuuauaaauuguuuccucauaaucuuaacaguuauaggaaaugaauaaagagaaugcaaaacaauuggaaaaugguuaauuucauucaauaaauauguauuuagggcuuaccaugugccuaggcacuguucuuagaaacagauugugaaggacuguuacuguauuacuuucuuuuauuccuggcuacuaaaauaauguaugagguugagcuuaauuauuuuaaaaaauguguaaacuuaaguguuuaacuuuuauuguuuacaagguaauuucacaucuccuguaauucucaauucugugacggugaggaaaaugucuuaguaaggcugauuucuaccuaagaggcagagcuaggacuugacuguuuguuuuauuuuuucagguccauugcucuuuacacucuagugugggauuaaaagaaaaaaacaagcaacaguauuguacugcauaaggacagucauauaggucagugagauagaauugagagucuagcagcaaaacacauacauuuauagucagucgauuuuugacaagaguuaagacaguuuaaugagaaaagaauaauuuucuggccgggugcaguagcucacgccuguaauccuagcacuuugggaggccaaggcagguggauugccugagcucaggaguucgagaccagccuggccaacccggugaaaccccaucucuauuaaaaaauacaaaaaauuagccgggugugguggcaugcgcuuguaaucccagcuacucgggaggcugagacaggagaauggcuugaaccugggcgguggagguugcagggagcugagaucgcgccauugcacuccagccugggugacagagcaagacuccgucucaaaaaaaaaaaaaaaaaaaagaauuuucuuagcaaaugguuuugggccaacugaauaugcaugcacaugcaagagaaugaaauugaaccucuaccuuauaugcaaaaguuagaucaaaauggaucaaagacccaaauauaagagcuaaaacuuagaagaaaacauaggcuuaaucuuccugaccuaggauuaggcaaguuuuaguuagacaugacaccagaagcacaaagaacaacuagacaaauuggacuucagaauuaaaaacuuuuguuucaaaggauacugucaagaaagugaaaagauaguaacagaaugagagaaaauauuugcaaaucauuuaucugugaagggcaugauauccagaauauauaaagaacuguaacaacauaaaaauaaaaagacaaucuaauuuaaaaauggucaaaggauuugauuagacauuucuccagagaagauacauaaauggcuaguaaguacaugaaaagaugcucaccaucauuagucaugagggaaaugcagauuauaaccauaaugagauagcaguuuacaccuacuaugacauauaauaaaaaagauggacaguuacaaauguuggugagaauguagagaaacuguaaccuucauacuuugcuagugaggauguaaaaugaugcagcugcuuugggaaauaguuuggugguucuucaaaaaguuaaacauagaguuaccuuaugcuaacuccaauaauucuauucugggguauauaccuaaagaaaugaaaacaugucuacacaaaaaccuguaagugaacaucauauuaaugucauucauaauagccaaaagguggaaacaacacaaaugucuauuaccugaugaauggauaaacaaaauaugauacauccauacaauggaauauuauucagccuuaaaaaggaauacaauucucucacauagugcaacauggaugaaccuugaaaacuaagugaaagccagacacaaaaggcuacuugaugcaaauuuccauuuauaugaagugucuagaauaggcaaauccauagaaacagaaauaagugguugccagaggcuugggauaaggguaggaugcuaauguauauagaaggguuucauuuucaggugaucaaaauguucugaaaguagacaguggugaugauuguacaacucugacuuccugguucagccacuuuaaauagaugaaugaaacaaauagaagaacuuguaucuuuacucucauacacccacacuauuuuccucucuggugccuaucuucucuauuuccuuuugcaacaaauuuagagaucauuucuguuaucuccuugacuucucuaccuccuuuuaaaucuauuacagucugacuuuugauucuaccuuuguuaauaagaucacuaauaauguccuuaucuuccaaauccaaauuugcuuuuuaguuuuucuuucaugauguuuugccagcacuauugaacacuguuuuuuaaagcuucucuugacuucuguguuuacacuuuccuggcucugcuuuggcuuuuuguuuuguuuuaauuuccauccuugaccuuaguguauuugccugucccugaguguuacugguuuaguuuuagauuuucuuacacguuuacugacauacucuuggacaauuucauucccguggcuuuauccguguucaucugcacagaaguguguguauuuggccuaaaaggcuuggugacucaacuuacucucaaauaguuugucaaauauuaauaauuauauauuacucuacuacuccauuuucaugcugcugguaaagacauacccgagacugggcaauuaauaaaagaaagagguuuaauggacuuaaaguucuacauggcuggggaggccucacaauccugguggaaggcaaggaggagcaagucaugucuuacauggguggcagcaggcaaagagagagagcuugugcagggaaacuuccuguuuuuaaaaccaucagaucuugugagacuuauucccuaucaugagaacagcauggcagagacccauccccaugauuuaauuaccucccauggggguuucucccacaaaaugugggaauugugggaguuacaauucaagaugaaauuuggauggggacacagccaaaccauaucaaucaccauuauuauuauuguuauuauauaaaagagaaagaaguaaaugugacaaaauguaaacugucuaugaaucuagaugaaugggacccuggagcucauaguacaaucacugcaacuuuucugugagauugaaauuuuucaaauagagagauuuuuaaagaauuuuuuuuuuaagugaacgguucugugccauuuaguacauccuuuccuuuaaaaaaaaaaacucucauacuugucaggguauuaaguugcuauaacagaaugcaguaguucuuuaauugugaguuucuuauauauucuaggauaggcagaucuguuuaguauaccuuuuuccacugcaucauuucaguuuggauauucuugacuuucgaauuguucuuggaaauaauuagaaagaaguagggauugggauuguuggacggugaaaucauagggagagaaaggaaguugaggaauucaaucuugagucuuagaacuguguguguguguguguguguguguguguguguguguauagaagaacuacauacauacauauauagaaggaagaaacggaaaugaaucuauaaaggccugauaguacuuacauauuuucuuguuauugucuguuauguuaugaauaggaccugcggcuguauuauauuugagaaauaggauuuaagaaauacccacucaguuucaccaaaaauguuaaaauuuuauuugcuuuaaaaaaagcuuuuauuaagcuucuuuuccaucuacauuauccaagcaaaucugaauaauugggacuagaguuggacuagauguuggagggaccaacuuucuauuuauuaaaucacggaaagauuuagcauuaguuugauuagaaugggugcuuuccugcccuuaacacacauacagugccucuuugaaugcauauuuucugcaacaaagaaaaacaaauuaacaaacaacuaguugaaccuucaaggauucugaaaagcuucuggcaagguauauuuuuuaggauauugguucagcuucucuauugggacaaaaauagcugguuuaaaaauacagaaggcuuuuccuuucacaucaaagauagaacugguaguagucagggaaguggagugguucugcucuaagcuauugucuaggguuccagguuucuucuacuuuguuccucuaucuuugcuuuuaucugaaugguugaugcugguuucacagcacaucauacaacuggauuucagccugugggaaggaguaaaggcacacagcuuccuaauauaagcaugaccuaaaacauaaaugacguugcaaugagacuccaucaacuagaauuuggccacacuuagcuguaaggcagaguggaaacuaaucccugcuuggguggcugugaguccaguuaaaauuugggggguuuaauuaguagaaggaaggagagacuagauguggacgggcaguuaucagaaauuaaaggggugauaaaguaagcuugaaagcuucuuugcuuucuagugugacagcuuguucugagcuuaucuuguacauuuuugcuucagaccugaaaucaggucagguuccauguauuaggacgugguauauggaaaccauagcauggguuuuagaaaagggugcauugccauugaguuaaucaucauuuucaggcuuuuucaguacagagcuaggaaauauuuuuuucugaaagagaaaauaggucaugaauccauacuacuauuugcauuucacuuuuaagguagauauuuaaaauguuaaagaauguguuucugucauaaaaaccaaaguuugauuccugguucugcaacuuauuagagguauaauuuuuuugcucauuuugaguuucaguuuucucaucuuuacaauggggauaauaacuacaucucaugguugucauaugauuaaaugagauaagugcucagaaauuuuuacugauuuuauuauucucuaucacaauacaaaaaggagagaccccuaauucuucuuacagggguuagagaagacuuagagacacuugugccaucagggaagauugaauuuuaaaugggauauggagguuuagugagaagaaauacccagguaagggacccagcagaggcugugaucugcauuugucaaggcuggugcauaggauucuauuuugacccuuuaaaaaaaaaacuuuuuucuuauaguauuuaucauaguguguaauuaaguaguaguuugugugcuuauuugcuuacugucugacugccuuucugucccacagugacaaggaaggacuauccugucuuucuuuuugauuaccauuauaccuucaguaccugccacauaauagucacacaguugcuguucagacccugaauaaaauuuugaagcauuuauaaauaucacgaaauuucgcauuugauuauauacauaaauaauucugcacuuauuucaguguuaccuacugaggguugccuacuaguugaucuaguuucuuccaagucaauaacuuuaauuacucuggagaauuuugcacacuugauagcauuaguucuuuaucaauuuuuauugaaaguaaaugaaugaauuugcugguguuccagucuguuuggaucagauucugagccacaauguggauauacugguauguugugaaaugugugccaaguaauuuauuguuaacaagaguuuaaaguacuucagguaucccuuauaaugaaaccacucugguuuuuccauuuuauuauguugccuuaagagggagagagcugcacauacagguuauucucccaagaauuaccuguaguacucccaugggagagagagagcucacgugugcgcuugugagccucagcaccucugugcugcaucuuuuguguccgcauggaaagauucagaaugagaauucucaccuggaucuuuagggaaguauucugagaaaggaggcagcaugguacaauauaagacacuagauccuaagucaaauggcauuugcauucuagaaccuuuucuuguuuggcuacuaaauacaugacacucacauuuugcauaugcuuauuuuuguuguuguuauuguccccuuuguugagguauaauuuauauauaaugaaacagcaauuucaaguguaaaacuucaugaauucugacaaauguuaaguaauguauuuaauacuacaacaauaguauaaaauauauguuacuccaaagaaauuuucucauuucccuuuguaguuccuaucacccucccuugacaacugaccugcuuucugucacuauuguuuugucuucucuagaauuuggaauuauacaguggacacaaaaaauuauacacuguauauaauauguggcuggcuucuuuagcauaaugcucuugagauucauucuugcugcauaugucaguagauuguuucuuuuuauugcugagccauauuccauuguauggcuauacuacaguuugcuuauccauucaccagagggaacauuuggguuuuuugaccauuaugaauaagcuacugugaacauugguauacaagucuuuuuguagaccuauguuuuauuucuuuuggguguauaccuacgagcauaauuggugggucauaugauaaguauauaucuagcuuuauaagaaacugcaaaauuguuuaccaaaguguuuguacuauuuuguauuccaaccaggaauguaugagaguccuaguuacucuacgucuuuccaacacuugaauuuuuucaguuuuuaaaguuuuauuaucucuuuuugguuuuaguuugcauuucccaaguaacuaaauauauugaaaaucuuuucauguguuucuuuucuuuucuuuuuuuuuuuugagauggagucucacucugccacccagacuggagugcaacggcacgaucucagcucacugcaaccucugccuccuagguucaaaugauucuccugccucagccucccggguagcugggguuacaggugcccgccaccaugcccagcuaauuuguguauuuuuaguagagacggguuucaccauguuggccaggcuggucucgaacuccugaccucaggucauccacccuccucaguuucccaaagugcugugauuacaggcgugagccacugcaccuggcccaugugcuugcuugcuuauuuauuuauuuauuuauuuauuuauuuauuuauuuauuuuugagacaaagucucacucugucacccgggcuggagugcaguggcgcgaucucggcucacuacaaccucugccucccggguucaagcaauucucgugccucagccucccgaguagcuaggauuacgggcacccgccaccacacccagcuaauuuuuuuuauuuuuaguagagacgggguuucacuauguuggccaaucuggucucaaacuccugaccucaggugauccaccugccucugccucccaaagugcugggauaacaggugugagucauggugcccagcuccaugugcuuauuuucuaucuguaucucuuuggucaagugagcauccugaccucuuggcuguuuuuuauuggauagucugucuucuugcuaaugaguuauaagaauuuuuuacauauucuggauaggauacaaguucuuuauuagauauauguuuuucaaauacuuucucccagucuuuagcugccuuuuuauauuuuagagugucuuuugaagaguaaaguuuuauauuuauuuuuucuuuuuaguuuguguuuucugugucuuauuuaagagaucuuuuccuagucugagauacuaaggauuuucuccuguauuuucuccaaggagcuuuauaguuugugcccuuacuuugagagaaauaauucauuuagaauuucuguguaugaugggaggaaaguguugagguuuauuuuugacauauggauaauuaauuguaucagcauuuuuauuggagagauuaucauuuccucauugcugaagcaucuuuauugagucaauuagccauguuuuuguguggcuguuucuggacuuucuauucuguuuuguugauaaccugugucuucggcaauacaacauggugucaacuacugugguuuuauaacgaguuuugaaaucauuuaguuaagucuccaacuuuguuuuuauccaaauugcuuuguuuauucuagguccuuugaguuuacauguaaauuuagaaucagguuuauuaguuuuuauaagaaagcuuacugcaauuuuuauuggaauuacauugaaucuauaaaucaguuugagggaaaaaugacacuuuuuaccuuauuggcuauucugauccaugagcauggcauauuuuucagauuuaaguguuugauuuuuucagcaauauuuguaguuuucagaugggaguuuauacauauguuggguauuuuauauauuuugauguuauuauugauuggucuuuuuacuuucaacuucugaugauuuguuguuaguacauaaacaguugauuuuuuugcaucuuuaccugguauccugugaccuuucuaaauuuucuuguuaccuaguagcuuuucuagauuccuugaagcuuuuuacguacaaaaucaucuugucugaauauagacagguacacuucuuccuuuccaaaucugucugccuuuuauuucuuuuucuugcuucaauguacugguggaaguagugagaauggacauuguugucuugucuugaaaucuagaagcuuaacauuaauuuguuaacauuaacauuuaauuuuaaggaacaccaauuguuccuuaaaauuaaaaaaaauacuaccuaugaugaauuagcauuguaacaaaaaaaauacaaauaauaaauuaccuaaccuauaucagacagcacaaauaaaggcaguugacauugccaaauuucugagaaaacaaauaaaacuaucaaagcuaugagaugguaucauaacuguuucacugacuaugaaaaacuguuacugaggaaucuaauaucuguccaaagccaacauuuaaaagauaaguguuauauuggcugguaguuuguaauugaaauaagaauauaaauauucuccuagaaaguacgaaugaaauacucagagucuuuaguauaccuugaaguuauacuauuauuauuauuauuauuauuauuauuauuauuauuauuauuauuauuauuugagacggauucucacucugucacccaggcuggagugcaguggugcaaucucggcucacuacaaccucugccuccacugugcccagcugaaauuacauuuuucaaacucauggugcuaaaaaggucaagaucauuaagcacacguuauaaaauaugacccugaugcucugcuuaacuucuaauggccaaaaggaauuuaauuaguagacuuagucuggggaaggcguagacucaaacucugugauacucaaaugcuauggagcuaugauauggaagaagaaagggauaugcagcugccuagauaauuuuaugcuauaguuggaaaaauuuuuaugcacauuuaauguuaaauuuggggaagcaaagaaauauauuaaagugaugauacaccuuagaauuuaaguuauagguuuuagguuuguuggaggauuaaauaagaugauuaaagcaagguaacucauugaaaccuugucacauuauaagcauucaguaaaugaugaauuaucagucucuuaacuugugugauuaugggcaauauuugguguggucaaaaggucuuuaaguuuuuuuccuacuucuuugaguuaucaagaaagagauuauuauuuuuuaauacaaccuaguuucacaaauagggacauacauaacauacuacagaagguuucuguugauguuuuugugcuugaggcauuaagugcucucaguuaccuggaaaaauaauggcucuccaaaaugauucaaagcuuuuccuuuauaauuuuuaagauuccuggccaaugugcuuuaaaugaacuuucugacuuauuaauaaaacucaaugaccgggugcaguggcucuugccuguaaucccagcacuuugggacaccaaggaggguggaucaccugaggucaggaguucaagaccagccuggcuaacauagugaaaccccgucucuacuaaaaauacaaaaaguuagcugggcaugguggcaggcgccuguaaucccagcuacucgggaggcugaggaaggagaaucacuugaaccugggaggcagagguugcagugagucgagauugcaccacugcacuccagccugggcaacaagagcgaaacuccauuucaaaaaaaaaaaaaacccaucucaaugguuuauucuagucuaaauguuuuaugguagauucugaauaauuugggcuauuauuuaacaauuaucuauaguuauacuuuagcauugaaaauguuauuguacuuuuuuuuuuuuuuuugagaccgagucucacucuguugcccaggcuggagugcaguggcacgaucuuggcucacugcaaccucugccucuuggguucaagcgauucuccagccucagccucccgaguagcugggauuacaggcgugugccaccaugucuggcuaauuuuuguauuuuuaguacagacgagcuuuugcuguguuggccagacuggucucaaacuccuggccucaagucccaaauugcugggauuuaggcaugaaccacuaugccuggccauaccguacagaaacacucuuaugguguauguaugcgucuauuuggaacuuaguuuuguagucuuuuuuuaaaaucauacuuuauuauaguaccuuguuaucauuuugaauauguuaaaucaacacuauaauaguuaagguagacagaacauuaggacauaccguauucuauauuuuuuccucuguauuugguaucagucccuggauuuuugcuuuuaugagucuguuucuuucauuccuauuauuuuuguuaucaaucauccuagugcuuuuuuaaaugauuguguuagcuuucuagcuugucuuggcugcuuucagucuguccugcagguugcaaaauuauuuuaaagcauaccacuugaguguauuacucuacuguucacaauguuucauugcuuuccauugucuacuagguugcucagugcccuucacaacuuagccagucacauuauuuauucauccauccauguauucauucagccauauuuauuagguucuaugaaccagacaggauggaggaauaugugcuaugagagcuuauaaugaauuagaucuggucaaggaggucauuggagagccaagaucugaagagaguaggauuuguuacucaaaaaauagaaaagaggauuguaccagacagagggacuagcauguacaaaggcuuuuuuuuuuuuccucugaaaggaauauauuuugagaaugaagaacugaaagaaggcuacuguggcuuagacacagggguguccaaucuuuuggcuucccaggggcacauuggaaggaagaacaauugucuugggccacacauaaaauacacuaacacuaaugauagcugaugagcuaaaaaaaaaaaaaaaaucacaaaaaaaucucauaauguuuuaagaaaguuuacaaauuuguguugggccacauucaaaaccauacugggcuacaugcagccuguggaccacggguuggacaagcuuggcuuagagcauaaaagaagagggaucguaguacaagauggaaaagaagguuggacuugaccauacagggggcuuccagaccaugcugaguaauauuauuaauauaaaagcaauaagaagccauccaaggguuuuauuuagagguaggggguggaggagagggagauaaaaguggucuccguuggagcauuguuguuuagucuugacaauagcuuggucaaggagguuggugauggcagaagaguuucaguuucaagagauacuuaggagguuaaaucaguaaaaccugcugacauauaaugcaguuggggguguaagaaacagggaggaggugacguaagaaacagggaggaggugguuauccauuauucgauaaaugaugccauuuuacugaguuagggaauauuggaagaggaccauuuuggguagaggaaaaucuuaaguucaguuuugaacauguuuaguuugacauacccuuugagccauucaggggggugugucaugaggcagaauauuuggugcucagagagagauagaggcucaaaauacaguuuuuauuauuugauuauugauaggaauugaagcugugaguaguaggguuggggguugagacuauacauugggcaagaccuaagacugauucuugcggaucugcagcacuuacuaguuagguauuggagauugugucuagguuaggggugaggauggaaggcaguagcagccagaggagagaaggaaaaccaugaaaauauuucagcaugaaagccaaaggaagauuccuuucaaaagacugggaaguaguuuugaaugcugcuuggaagccagauuugaaaaucuccaauggauuuaaugacucaaggagagaucugcugcuguguaacaagucaucccaaaacuuagugacuuaaaacaacaguuuauuauuucuuaagaauuugugaguuuguuacauaagccccaggcuuauccaggacuggaacguacaagauggucuuauuuauaugucuggggcuuuggugcugccaguuuucugggggaccuugcuucucaucucuguggcuucugucuccaucauuuaguagcauaauucaagcuuuuuuacaugguagccagcuuccauggaaguggaaauaaggcugcuaggccuaguaagacuuagacucugaauaccuuugagugcuucggaguacugugccaucuaccagaguaaccaagccaaaacaaaacaaaaacccauugaugacuuaguguaagaguuguuuaugaaaaaaaaauuaacaguagggaaauccaagaauugauaggcuaaguauaacuccaaaagacagauacauugagaggacuggggaacgaagaaaauuuccuaauuauuccucugcauuuucuuuaagcuugaccucaacugggcugcugauuuccugaacacuuccucuuucuuuccucauguacuccuuuucccuggacguuauuucucuaucucccuauauuaaaauccaacccauccuuaaaggauuaaaggcuuucuuaaaaaucuuucucuccuccuuugcacuguauucuccaccaguucugaaguuuaauuuaguuuucaucccaguauuuauuauuauuauuucuugucuccuauguguuugaucaugaucuucacucuucauuacucccuaacuugcaugagguucuggauucucaguaaacuuauuauucuucacacuugcucagaugcuacuuccucugagaagucuucccugguuuguccccuaaucauuuauucuuuuguacuuuaugcauauuuuuauuguuguacauaucauaacacauaauuguuuacuuacauguuuuugaaaguagaagauuacaauguguaauguguugccuuucauuaaauaaauccugaguuauagcuugauuucugaucccuauuuuaauuuuuuuuaaaaguccccacauguugacaauaaaauguguauauuuaucaugaccuaauuauuucuuugauacugugcugaguucauugguacuaggccacugcaguaaacgguaaagaaaaguuaugauuugguauaugaaguuaaaaauuacaagaaauaauauauggucaaguuuuuuauaucucuuaauaaggcaagaaugaauauaugagguuauguuucaugugggccucaguggaaguauguacauauguaaauucucaguauacaucuuauacauugagcuggauggaguguuuguuauggugccagcuuauggaauauguguuuuuccacaccuuguucaaggugucagguaggcuuugcagcucauguguuuguauucucuauguaugggcacguacaagggccauagagaugaacugguuacacacacagggaaagaauaagacuuccagcucuuggagauaagacugguucugugacucgugacuuacauuagcauggaaacuuuguaucuauguguguugggguggagggagcacaguuuuguuuuuuuuuuuuuuuuaguuuuugcuuguuuguuuugugauggagucucccucugucacucaggcaggagugcaguggugcuaucaugacucacugcaaucucaaccuccugggcucaagcuaucccccugcugcagccucccaacuagcugggacugcaggugugcaucaccacgccuggguugucucucucucucucucucucuguguguguguguguguguguguguguguguguguguguguauuuguagagauaggaucucacuauguugcccaggcuggucucuaacuccuggccucaugcaauccugccugccucagccucccaaagugcuaggaugacaggugugaaccaccacaucuggccaggagcacaauuuuuauuggcaggacacugagaggugcuugugaucugauuauaacucuagcuuugcaucucuuuuacuuugcuuagaccgcaugaguggaaccucauuuauuauuucauaugacaaauacugugggggaaacaaaagaaucagauccuucuccuuucccuuuuccaaacucgugggauaggcugcgaaguaaauaggucauuaaaacuuaagugggaagcaugauuaugagaauacauauaauuugaauuacuuugauaauagaaccaguuggcagaacuuccaaguucaagaaaggggaaaucuuuuucuuuuuuuuuuuuucuuuuuuuuuucuuuuuuuuuuuugaaauggagucucacucugucccccaggcuggagugcaguggugcgaucugggcucacugcaaccuccaccuccuggguucaagcgauucuucugccucagccuucugaguagcugggacuacgggcacgugccaccacgcccggauaauuuuuuguauuuuuaguagagaugggguuucacuguguuagccagaauggucucgaucugcugaccucgugauccgugaccuugggcucccaaagugcugggauuacaggugugagccaccacacccagcuaaggggaaaucuuguguugguacagaucaguccugacucauggugggcucagguuugauccucauccagccaauuagguuguaugcuaggagacaucuguuuagauuccugaguugaagauguuuuaaaaauaaacuucuuuuaucuuuuuuuacuguuuguugguuucuauuuuuuacauucuacaguuuaaaaaauaaguaauaauguaugagaauuuugguuaucugagauuuuauaauagcuuuucuuacaaugagcuagcuaaaaggugaucucaaaucuuguuuauuuggcguaguuuaucuacauuaaauccugaaaucgugcuguguuuaugguaggugcuccaugaauaacuaaauaauuaaaauuuaaguugagcuuuagucuaauuuuagaaaagucacaaagaggaaauugcacuuuuauaaguacauaaaauugagcauaccuggugauaacugucaccugccuaaucugccauuuguuuuucagaccaauggagaaguagguuuuauucuuuuucuuuugguaagaaguugaagauggacucaaaggugaaggggcaguaaagucuccaagggaagcuaggaaaaauaggacagucuucccaaauuuaaauugaaguugcauuuccuuuucuguuggcuacgaagaugaugacguaagauauuuggguuggcgauauuacuaaaauuaaucauuuaaaauaacaauauggaaaaccucacuuguauucaagcaaaaaauaaacugaauguaaacaauaauuuucucugcuuauuaguccauuagacugaaacuuugcccaguauaauuuuauaagauucuaauaaaggcccacaauaucaugguuaugggaaaauuacuauauuauugaaucacacaugguuuauucaguucuuaaaauugcaguccucccucccuagauguuccagacuugaugauauagcauggguuacuugaguguguucuccaaacagaugucuccuaacauacaaucuuauauuacaguucaucucugaaaaggggauaauaauaguaucuaucccauuugcuuguuguaaauacuguauguaaagcucauggaauggugcuuggcacacaguaaguguucagaauaugcuagcuauuguuguuuauuguuauugcccauguuuuaagaaauggaagggaaaagcaagagggagaaaaauauauugccacuccuuuguaugaagaguaacuaggggaaaagcauaggaccgugcauuauaaaaauaaccuacaguguuuauaagauguauuaauuaaggacuuaaaaucacuagauugauacagaaauuaauuuaaauuuuuuuucuaaaaguaguuauuuuuauaauuaagguuuucuuuuuucauugaauacaauuaguuuuuuuaauauuaauucaacauuugauuuuuuaaaaaugcagauuauauuuccacuccugguuaggcaguauaauacaguguuuaagagcacaguguuuaagagccagacuuaccuggguuugaauucugucuccucaccacuuacuguguaccuucagacaaguccugaagcucucuguuuguuguuuguaaaugaggacuauaauagugccuaucucauauguuuauuuuguggguuaaaugaauuaauauauauaacggguuuagaauaacuugcgccuucuaauaguaaccacuauaaaaguauuauuguuauuaauggcuauauuuuuuaaagcaucauuaguucagacacuuccauuugaauacucauacuagaguuucuugggauuaacucucagaaaacagcucuuaugaaacucuuaucccauccaguguucagaaauaaaaauccuauuaaauaucuuguuagcuaguacugugauucucaguuuucuucuuucuguuaaauacagcucugaaacagauuccuucaggaacaugauccuucuguuuagaacucuuaaaguacuggguguauuuuauuauuuaucuuuaaauccucagagccuaaacauaccuaauauuugguagguacauaaaaaaugaugagugaaugcauauauaguuuucaggaaguagucuaccuucuugcaguguauuuuaauggcugaucaagaauaacucuuuguuagggguccuuacaaaugucugagcuuuggaguuaguaauuacuguacuuaaucuuucucuuguucaguugaggcauauaggaaguuuucuugucuuugguuuuguauaaaauaaugacauuauuggaaaagagguacagauaacuacuugaauaauuuacuggcuuuugacaauuaucuucauauuaauauguuucaguacuuuggauaagaauaaggaauauaaaaguuucugccauauuugccuuguucuuuuuguuuuggauuuuaaaaaauuuaauaagugaaacagaacauugcagauugauaguguguagucucccuuguuccccuacucagugucacuuuccucccucuuucccuucccguaaucaacaauugcaaauuugauuuauagucauuuaguccacauuuucuuauuuuuacuacacauaucuaaaacuauucuaaacauuguuuacuuuuaacaauguguagagaugcuauucugugcaucauuuugcaucuugccuuuuuuuccuuccauguaauacuguuuuugacacagaaauagacuaccacguguacagucacccgauauaagaaagaggugacauucuagugcagcauagaaaggauggccuguaucaauuggauauccauuugggaaaaaaaauguaucuuugccccuauuuuggaccauacuccaaacucaauuucagauguauuucagguuugauuuuaagugggaaaauaauaagcuuuuagaagaaaacaugggagagcaucuucauuaucuaugaggaaacaaaaagcacuaacugugaaaggaaaaauauauuuagauaacuucuguuuaucaaaagauaccacuaaaauaauggaagagguaacagaguagaagauauuugcaauacuauaauguauccaauaaagcagcuguccccaaccuuuuuggcaccagggacugguuuccuggaagaaagacaguucuucuguggacauggguggguaugguuuuggaaugaaacuguuccaccucagauuaucaggcauuauuuagauucucaaauaaggagcgcacaaccuagauuccuugcaugugcaguucacaauaggguucaugcuccuaugagaaucuaaugccacugcugaucugacaggagguggagcucaggcaguaaugcuugcuugcccacugcucacuuccugcuguguggccccauuccuuaacaggccacagacuuggggaucccugcaauaaaagacaucuggaauagauuaacaauccuccaaaucaauaagagaaagcuagacaacccaauuaaaaauaauaagcagaagacuuuaauagucacuucacaaaagagcacguugaaauggccaauaagcguaugaaaagguauuccacuuccauaaacaucagggaaauuaaaaccccaccccacuacacacacgcacacacacgcacacacacacacacccacaauggcuaacaugaaaaagacagccaaaacuaaguguugaugaaggagauacagagcaacugguucuguuauacgcugcuaguaggaguauaaauugguauaaccacuuuggaaaacuggcaguaucugaugaaaguaaacauauucauauccagcaauuccacaacuagguauauacucaacagaaaugcauacauauauuuuccacaaauacauguacuguaauuucauaguuacacuauucauaacauacccaaacaauucaaaaggauaauuacggaguuugaggccagacuggugaagaucccuucucuacaaaauauuaaaaagugagcugagugugguggcacgugccuguaguccuaccuacuugggaggcugaggcaggaagaucucuugagucuaggaguuugagggugcagugaacuaugaccaugugacugcauuccagccugggugacagaacaagagcuugucucuaaaaaauaaaacuaauuaugauauacagauaaacaauauggcaauaggaaugaacgaucuaccauuguauguagcaguauaggugauucuuaccuuuacaaugaugaaagaagccauaaaccaaagagacaauacuccauuuuuauaaaguucaaaaucaggcaaaacuagucaguuggggaggggcauaaguuaguaaaguuaucuuucuugauacaaauuuuaguuacacaaaggcauucaacuugugaaaauuuguuaggcugugcuuucuggauauauguucuuauauguauguauguuauauuacccaaaaaacauuguuuugagaucuauccauguuggauguuaagaguucuaguuuauucauuucagauguggugugugaacagacugcagcuuauuuauugauucccuuauuggacuucuaaauuguuucccguuuuccucuguuucaaauaaugcuguagucaauugcuuuuuuuuuuuuuuuuaaacaucuuauacaaauaauaugagaguucuucuaggaguuggcauuguugaguuuuaggguaugcucauguuuagcuuuaucagauacuauccaauuguucuccaaaugguaguauaauuauaggcucaccagaaguauuggagaguuccuauugcuuuauauucuugucaucacuugguauugucaaauuuaaaaaauuuuugcuaaucuuauugugaaaugauaucaauauuuuaauuuguguuaucuguuaacuaguguauuucaucaucuuccuacauguuuauaggucauauggauuuccuuuuagguauccuuaucuauugcccauuuuuugcuuuugggaauugucuauuuuuauugcauauuuuucuagugacuaacuuuauauuuuucuucauuuaugugcaauuuuccuugauucucaaaguccauauauucaggaagaccuccccacccccuuugauuuuuaagacauuacuggaauuucaccuguaaacuuuaaaccuggaguaagucaauccuccugagauuuuuccuucagauuuuaaucuuuuuccuguuucuauuugccugccauuacuccuuauuuuacuaauucauuuaaacuauagcggauuuuccccuuuuuugguuuugggagguugguggugauuugcagagggagaaaugagaagcaauagaaaaauaaauaaaaauuugccuaaaguuuauaaaauugauauagcuauguguaaaaugcuuagaauaugcuugugaaccuugcugggguuuuuuuuuuacauuugaaauucauucuagauucagcauuguacagccaaaggccauuuauuucauuuuauauugucugcguugcagaugcucaucauuacaugauuaguuugugugugugcaugugugugugugugugugguccgcgcagugccuguuuucccccacauucucaagacaguuccauguaucuauccauuauucugcaaagcaacugcauuaacaguugaaacuucacgcaguaccacuggugcuuugacauuuuugugauauuagagagaaaaugaccaaguacuugguagcuguguuucccaaauacuuuaaaggugguuuaaaggguaaaaggagaugauguaaguagugcuugcuuauuuaucuucugucagggugugguaauagcagcaagggccuggagcuccugagcuguuuacaauugucacagagccugugaggcugggaaaccuuccucgagaauaugcuggcccagauuucuucagcauuccuucucuguugcuucugccuucugccuuacgugccagagaaagaacucaugacuucuguccagagucacaaaaucuuggcugaucuugaugaaggagucuugcagcauauucucauggcaugaaucuuuugaagagaggugccaguauaacauagcuucacuaggaaaacucuuccuagaauagaauuggauuucuuuuuuuaaugguuugauguaagucaaugaagaaacuugagucuauuuuaguguagaaugacuucaacccccaucaaguuuggaagucuucucugugugagauuuagaaaggcuguacacaauacaauuaggucuugcuuugugaagaaauuaguauaaaaaaugacaauuaauuuagaagugaucauuuuaaagcauguuuuguauaaaaauauacuccaguauuuguagaaaaaagcccuaaacugagucuugauuuuauuuuuaaaaaauuuguaagugguaaggauuuugguuuuccuaagcaccauauacuuaaauaccauuaucacacuuaaaagaguauuaacaauuccaguaauauaaucuugaaauuuccugauugucucaaaaaucuucgcuuuugccucuuuuauaacaguuuuaacucuucagauucccuucccuuugcuuuuuuaugccacugauuuauuggagaaaccaggucauuuguccuguauaauguuccacauucuggauuugacugauugcucucuugugcugguguuuaacuugauccuauauccccacuauucccugcaaacugguaguuagaaccgaaggcuugauucaauucaggucgaaucuuuucuuucuuccucuuuuuuuugguaagaauccuuuauaguugauguugugguauugcaucaugucaugagaaacauagugucuggucauccucauugagugauacugagaugaauauguggauucuguuuguacacuguuacucuguugguauagaagggcccauuauagucauuuaaaacuuuuuaagaugcuuaagaaucucagaaaagauucuaacuuagcagguguaagggaagaaacaucuauuauuaauaaaacaugcaacacauacaaaaacccccaaaccucucuacauuuacucagaugugguaagaaucacuacauuuaaaauguaauuagagugacaaaaauuuacucuucuacaaaugcuuugagauuguuuaucuuauauaaaaugaagcauauuuuaaaauauuaagagcuguaaagauguuugagauugcugugguguaauaaaaaaguacugacucuggacacaggaggccaaaucauuuuuuugaggucuauuuuuuuuuacauuuagaaaauaauaagaccgggcaugguggcucacaccuguaauccagcacuuugagaggccgaggcgugugggucaccugagaucgggaguuugagaccauccuggucaacauggcaaaacucugucucuacuaaaaauacaaaaauuagcugggcgugguguugcguaccuguaaucccagcuacucgggaggcugaggcaggagaauugcuugaacccaggaggcagagguugcaaugagccaagaucgugccucugcacugcaaccucaaaaagaaaagaaaagaaaagaaaaauaacauaucuaucacaggguuguuuuaaugauuaaaugaaauuauuuauuuggaagcaauucagcacccaguaauuaauugagucuaaaucugaaauucauuccaacaauacagauuuuuuucagucuauaucuucaaaguaaguuuaagaaaauuaaacaguaucaugugcuguuuuagcuaugucugaacaaguaagcuuuuauauuugagcuuguuuuucaagugauaggagaguugaugcaguucuaacguaaguguaauuaaaguaggcuuuuugaaaaaauagucuguggaauucuuauuacuguuuuuccccccuacuuucagcuucauuuaccucuuaauucuccuuugccuggaagugaauugaccaaggaaccuuuucguugggaucagagacucuuugcauuaguguugcgguugccuggcaccaugucaguagaaucagaacaguugacaggugugccuuuagaugacucugcaaucacaccaaugugugaagugacaggcgguaaguuuuuugcuggcaguaauuugguaacuuaaagcagauuuuaucugaauguuuuaaaaguguacauucaaaagcuccauguuuguuuuuauuucacaaguuaauauuaggaauuaggcauauaugcuuuuaauaguacauuuauugcuaauggucuaugaucuucauuugaauagaauguggguuacuauuggacaugacaaggaaugguaauauuuuuucuacuuguauagaaaaugcuauuauuugaaguuguuaaacuaauuuucuuaucuacaaagauugccaaugauuuagaaguaccauagcauuauuuuuugcaaaaacagucuugagaaucaucucuguguauuugaugagguaugcuugguuaagugcaauuuuucccagaggcaaagagauugauagauuaaaggaaacagauagugaggucuuauccagcuucuguuucacuuauacaucagauuagguagguacuaugccaagugaacaucaaggaaaaucuugaaauacaauauguaaucaacucagaacucauuuaauauagaauuggcuaacagguggauuaauuucauauagguauguauugcgugccuacuguguaccaaguaucguuccaugcuuuuggcauucaguagucaguacagacacggcauuuuugguuucauggagcauuucaguucucaccugagaauuguauuaaaauaauuuuaauaucaaauucuguauuugauauuaaaaugugcaagucuagcauuccacuauuuuacuuaugauaagggccugugacauaaucugcagacacaguuggugcgcuaaugagauucgucauagccagcuacauaagagaaaauguaaguucuaauuaauauuuuaggugcauuuuuucuaaaauucuauggauuuuggaaaucugcaaaauucacagacaaaaagggauuaaccuuacacaggugugugaaauagauagaaagcuguuauucaugucauuaaaugcuuucauuuuauagaaaugcuuuuugugaacuuucguaaugccuucacaauuuaauuaacaaaggguaaaaaaggcauauauguaauuuuuuuuagggauaaccugucaucuacauuugaaaauuaaugaacaauucucguuacauagauaauauuuuucagugacagucguauuuuuuucugugggagggugcacauuuauauucaugaaauuuuaguuuccagcuuugaacuggcacccuuguuaaaaauucugauuuuuuuuuuuuuuuaaacucuggggauuuuacuuaacagguucugaaaggcuuggaggcuauaacauucucacauuggaaauuccuuacuaggaauuacuuaguuugaacuuagaaugaugaugaacuuuugggacuuaaauauacuauaacuuuugucacuaggaucaggaauauucagagugugaagucaagugagugguguaaucaaagagucugaaaagaaccaugagacaucauguagcagucuugccuuuaggcaguaauguauuaaagcuacuuugcuuauucuuugaaaggaacaucucuagagaaguuccaaagucauccuuggugauaucuuucaaugaugcagaaaucuuagucaagaaauuaggaagucuucccuaaauauacauucugaauccuuccugaugugauaguuuauuugccccuuuucaugcucuuacuagcaauaagaguaagccgcucaaaugucacucaucuuuucauaucucugaauaauguguuuccuuucuuuuuuaauuuaaaggauguucacuaaacaaaguuuuggggaacaccagaaaaguagaaagaacaaaaaagauaauacccacugguauugcacuauccaaauauguaaucacugcuaacaauuccugugcauuuuuaaaacuuaagguuggccgggcgcgguggcucaugccuguaaucccagcacuuucgaaggccaaggugggcggauuaccugaggucaggaguuugagaccagccuggccaacauggugaaaccccgucucuacuaaaaauacaaaaauuagcugggcgugauggcacacgccuguaaucccagcuguucgggaggcugaggcaggagaauugcuugagcgcaggagguggaaguugcagugagcugagaucguaccacugcacuccagccuggcugacagagagagacucugucucacaaaaaaaaaaaaaaaaaaauuuaguuguuuauguguguauuuguguacauuuauuuuucccauuauggaguaauucauguucacuaaggaaauguuggaaaaaauucaucuguauugccaaaauaauaauauauuucuuucuauguauuuuuuuaauugcauaauuguagucauuguaagcauuuuucuuuugauaucagguaauuaaugagugcccacucuaugccaaauaacuguuacuggguguugggaguacagcaggaacaauagaaagcuuaugucuuuguacugagugacagauaauaaucauggaaaauaaauaaaugauauuuuauaguaguacuaccuacuacuauuguaguagauaguagggugcuaccuacuaugaagacaaaacagaguaagggaguggagacuaacuuaaggcagagaaagcauauucuaccuaaguuuucgucugaggagguaacauuuaagcagagaccugaauaauggaguuaauuacacaaauaucuaggcagaggaaauggcaaggaaagggacaugcucucuauauauuuggaagcaacaggaaggcuagcauggcuggagcuuacauagggaggaauagaguaauagcuagguuuagagagguaggcaggggccaaauauugaauggcucuuuaggcuacaauaaauauuuuuugaggaaauggcaaggaaagggacaugcucucuauauguuuggaagcaacaggaaggcuggcauggcuggagcuuacauagcggggaauagaguaauagcuagguuuagaggguaggcagaggccaaauauugaauggcucuuuaggcuacaauaaauauauuuuuauauuccaaguaugaugugaagccuuuugaaggcuuuuuacgggaggugacgucugauuucuauuucugaaauaccacuucaccuguuagaugagaauauagaguggcaagaaugaaagcaggaagacuaguaguaguacuuuguucuaugcuagcuuuggagguccugagagguggcuuaaugcaaaagagaaccaaggaugaggacaauaagggaagaagcaauccaggaugguucccagaugauucaguugguccgaaccacuagagauggauggcugugccaaggacugagaugguacacuggggagaagcagguuuaggggaggugcaaggaugauagcaaauuuuaaaauguguaauagacauguuguuaaauauaucaagaauuuuuuaaguauuuuauaaaaauuauagauauuucuagauuaaauacauuuaacuuucuuagccucuguaaggacuauugaccaacuuagaaauguucauuugcuucuucucuauuugacaaagaugcuaauacugccuuuagacucacuauauuuaguuugacuuuuuuguggacucuacauaacccaaagugagacagcuucuugacuugaaggugugugcuaauaaaacuuuuuucacaaauacaaguagugauccuagaaacuuuaugcauuagcacaaaguguuguauaucccaaggaguaaguuuugacauagacaauaaguacacaugaggaacauuacggaggauauaggcucacuuuguaaagaaagcaaaauuugcuauuucuguuuaacuuuuaaaauaauuaauagauuuuuauuaccaaaugacucauuuuauucuuuuucuccaauuuuuguaaaauauacugauuaguaauuuuauuucguguuaagauugauuugcuuauguuuucuuaauugaugacacaacuuaggagagcaagauaauugucauaguuuauauacuuuaaaauuuuugcuuuuuaaugacaucuuaggaauaugcuuaaauuucaugaaauaagauacucaaccuuuauguaaacuucuaauauuuugcauguaaagaugguuagccuuuuuauggauugcuuuuuguauauacuuaaauugacuuagaaaaaaauuugaauuuaccaauucuuucaaguaagcaugacuucauauagaugcuguauuuuaaguacugauuucaaauucacagaggauuuccaagggacaaaggauauccagaauaguuucugauacacuguaaggguuugaauuguaacucuaucacuauacuaacuuggaaaaguuaguuagccucucugugccuuaguguucucauuuguaaaauggggaaaauaacccauacaauuguugcugagauuaaagaaauuaauaaucauaaaaugauuggaacagugccaggcacguagauacucaguaauugguagauauuuguuaagguuauaaucaucauuauuuuauacaguuaaguuguuguauuuauuuuuucuaaguaaagcugacuuugaggauuugaaucaccauugucuauaauguucucuuuucugaguagccuuuaacaaaucacguuaaguguaaguugauauaaguaauuugaugugucaaauguaaugauguagcuuguguugugaaauaauugguugaauguguaaaagaguagggcaucauauugagcuuauuacaaauaauguugcaaaauauuuggccaaagauugaguuuuagcugucaagguuuuuaguguuggucuggaucagaacuguauaauagaaaucugauucaaauuucauauguaauaaaaaauuucauaguagccacuuuaaaaauuaaaaauagaugaaauuaauuuuaauaauauauuuuauuuaaaucaauauauccuuauuacuucagugugagauugauauuuuaaaauuacuaaugagauguuuuauauuuuuucauacuaagucaacaaaaucagguguauauuuuacuuacuauacauuucaauucagacuagcuauauuucaaguucucaauagcuacaugugucuaguauauaaaguauuguauagcaaaggucuagauauuuuuguugaaaauuccucuuuaaaagaucuuuucacugguaucuuuuuaaaaaaaucacuaguauuuaaugcuucugaaccaaaaguaguauaaguuaaaacguacaaaaggggaauucacgugagacagguaauucccaaguguuuacauaagcuaagugaaauucagaaaagcacacgcuaccaucuguauauuaaaaugcaaauauuuaaaauacuuaaaaacugccaguaaacaaguaguuauuacauaccuacuaugugcacaguaaaucuuagugauaauacuuuuguuaagcaggaauaagauuuuggggagacaguuacuagauguguguguguauauguguuaaagauaaauuguauugcauaacaguuggagauaguguuuuuuauauauauguuuuaaaaaacauaaaauaugugacuuguuuucauguguuuuguucagaccaagaauucuauguuccaaauaccuguaauuagaagaaaaaauguacauacucucacaaaaugggauuguugguugguuggaaauaaugauuuuugugcauucuuucauaagauaaugaaauuagucaacuuuuaccauugaacuuuuguuaauuaguacugucagaaaccccacaguuguuuuuuucuugcuaaugauaggaauucuugcaacuaacuaguuuacuauauucuucuucuucuucuucuucuuuuuuuuaaucucaggccguucauauucuguguguucuccaagaaugcuuaaucagugucuggaguccuuggugcagaaaguacaaaguggggugguaauaaacuuugaaaaagcaggaccagauccuuccccuguagaagguauuauugcacuuuucuuuuagacauucaaaacuugcuuuauuguuuauucaacuagaacugaaaacuuacugugauuuggccuuaagauaggcaaggccaaauuauuaagacagaaaggcuguugguaaagagggaagauuaaauaggaaagucaagguaaacuaauaguagucuaguagcaucaccuuuuuguauuaaugauugucuauugccugacauuuugaugagucaaaagccuuuucaaagauuuaucgauaagcaacuuuauaauuucuuuguaguauuauacaauugccucucaacauauauaugcuucuccuaugcccuuuaauucccaaaguguucaguccuagauguuuaacuccuuagcuacuuuuguaccagggaucaaacugauugaaaguaaaugguuuauugugggucaaaaaugaggaaccaggcuuugccauuaagcuugauucuucuaacucuagcugagucccaccuggcuuuuucuuggcuucuguaaucaugaacuauuuccaauagccaguggauauaaggaguuauaguagaaccaauggaugguuuauaguugagacccucugcauuguauguuaccuauuucaagauuuaagagucauugcugggcacgguggcucacaccucuaauccuagcacuuugggaggccaagguggguggaucaccugagguugggaguuugagaccagccugaccaacacggagaaacuccgugucuacuaaaaauacaaaaugagccaggcgugguggcgcaugccuaugaucccagcuacucgggaggcugaggcaggagaacugcuugaacccgggagguggagguugcggugaguggagaucacaccauugcacuccagccugggcaacaagagugaaacuccaucucaaaaaaaaagaaaaacaaaaacaaaaacaaaaaaaaacaaaacacacacacacacaaagauuuagagaaucauuuaaugauaauuggcagaggugguccacuaaaguagguaccugggagaagagaaagaucauagagaugaaagaaugggggcacugagaggguacuauagggaaggaaugggugauaacaauaaguugugucaugucugcuuuaacgaaaccaaacuuaaaaaaauuuuaauuguuacaguguauuuauuuuaaauuauuuuaaugcuuuguuuagaguuuguuacuaguaaauguuuacuggauuguugaagauaguugcuguuuugcuaaaauuauuuuagauuaaagguaggugcuuuggucuagauuugcuuauuaaguucuuuuuuuaggcuucgguuaaaaugauuucuaagaaauacucaauuugcaguacuuauuuauucuaguauuuauugugugccuggcacuguuuuugacauuugggauaugaugauaaagguggcaaauugggugcuugcucuuaucaucugaugaagaaaacaugccauucaucaaacagauauucaccguaaaguauguuuuguguguuccaguugggaaggcaaaggaugcugcggaccuccuuugaacuggcgaacucauaguuggaauuuguacuuauugucuaaugaauuacaaucuagucuaaauauucagcagacauaguguucugccauuuaagaaaaauaggaaaaccuggaaaaagauauuaggaauuuuuuauuaauuuaaguaauaauugauauaauuuaacuuuuuaugcuuauccccccuuaugauauaugcuuucuuugucuuaauuucuuugcuauagaugggcagccagauauaucaaggccuuuuggaucucagccuuggcauagcugucacaaacucauauaugucagaccaaauccuaaaacugggguuccuauaggucauuggccuguuccagagucuuuuuggccagaucaaaauucgccaacacuaguaaguaccagagacuguaacuauguaauaguaaccauucagcugucuuuccuauuaguuucaaauucuguugucaaagcugugauuaauuuauggggauuagacagauguucaaagugcuaugauacccuguuacuugcuuuauuauguugcuuugcuaugauaacccuguuacuuuguuuauuaugaaguaauagaaaaaaggcaucuccuucguuuagaaucuaauacuaugcuugcgauuuuuauucuuggcuucuggguucaaaauuuccucuuuagacucuaaaugaggauuugucucugggacacaauuuaggauuuaaaugaaggcuuagaaaauaauuuugauaguuugccugcaauuuuuuaggacuuagucuuaaauucauauugauauguaugguuuuaguuauauacaguguugcagauuggagguuuaagcuagaacagauuuucugauuuuguuuaccugaauuauuuuuaggaaaaaugaaguuugcugagcgaucauggugaauuaucaguauucauuauauaauucuuaaaauaauaggguacauuuauacaaauuaauauccauuuagucguguuaguguacucuuuuuuuccauauuuuuuuucuaaguaucugagggcauuaagggauauuuugugggagagcauggcagugguucuccuugauuuuaccuuuagaaaauaagaauuguauuucagagaucauuaagcagucuaauaauguuugauacaacaaaaccuuuuugaaaccuuuuguacuucaaaccuguaucagcuuuucaggauaauuuuuauuuugaguuuauaaagugauauuuccuuuauucauuagggauuuaauaaaguagugcaugaaguuaagguuuucuaaauuucauugaaguaucuucauuauaccuuuucuuuuuuucugauagaaccaucauaguuuuuuagucuggcuuuauggagaaacuuccaauuucuuuggucauuuuacuuucuuuucuggagcucuuucaacucuuacagaacagauaccguauuuguaugaaauauugucauguugguuauuuauucuauuuauuuaacauguacaggagaacauacaguaccugaguuguaauggaaagaaauccaaaaccaguaucagaacccuuaucuauuaaugcugcucuagcagucuaucacaaauucuuagaagccauagaggguagguaggacuucaauuggagaaggaaauaguaugagaaaaaaaauauggaagugaaaaagaacaagguauguuuagaggaguaacaaguagcugaguacggguggaucauaacauguauauaggacauugagaguacuauuaaacuaaccaaauugcuuaugacuuuaaaugcaggguuaaggaauauuagcuuuuaaacaguggaguucaaagagcagucgaagauguuuuuaacagacaucuuuagaaaaauugauuugguggugguuauaugcaguaaaauuagaaggggagaugaguugaaaggcagguagguuaccuaugagggcuauugauaugguucacguaagagauuuuaagugguugaauuaugaugauggaagagagaauaauaaauaauauuggaaagaacuggcaaacuuuaguaacugaaggauauuaggggaagugaaauuuuuauaaauuacaauauugaagaaauauugcuacugaaguuaaguguaauuuacaagaugugaauuugaaucacggcacuauuaguuauuaauuaguaccuuugguuaucuuuuguaagcuucaauuucccaucuguuaaguggcuuauagcuccaucucauaggguuguuuugggaauuaaacaaaaucauauaugcaaaauuuucuuggccaaguucuagaggaucuuucccuccacuuucccucuuggaucuccguauuuuuauucacagaauaaguguguuuuguggacugauucaauaaacugugugucaggugcaugcuaggcacaggagcacaagaugaguaaaacagugcuuccccucugaacauuacccaucuaugggcaugucagacacguacacaucauagaguacagugugccaacuguaauggagggguggggcagagccagaggaggugggccugacagccugguguguuuuuggaguacagagugggaagggguaugagggaagaggucuuuuagagguuguuacaugccaacucauuuuucuaaacuuuguuugcaauaugcaagggagaaaauaaguacuuggcauggcugaaguauggagucuguauggcgugguggugggaaggcagauagggaccagaucacugaagaucuuuauaugugauauuaagugucuagacccuauuuuuaggugauuggcuguuacuuuuaccgaacaguuuuagauagggaaauuauaugauccuauuuauauuucacugccauggauugaucagacagggacugauuagaaacuaaacaaagcaaaaagcauuuguacuagucuaaucugagaaaugaugaaggcccaaauuaaagugguaagaaauagaagauaacauuucuagagagaugagaguuuaguauugacagaaggcagcaacuaguaaugacuaccuaccauguuuauguguucugguaagugccuuagaauuugugauaucaguuuauccaggucuuugugacaguuaaauauggaggaugaggggaagauaucaagaauaacggcuagguuuuuagaacagguuuuguagcuugggggagaagaaacaaauuguacauauugugucugaggaaccuguggaagauucagguuaugucuaguggguaguuagauacagcagagaaauaggagccaucuggccccaacaguagauuugugaaccaccaggguauaagcaguaacugaggccaauagaguccuuuauagcuaugacauuuaaaauuauuuccucauagcucauuuuguucacaauuugugagauuuuuaggaagaggacuauuaagagguagauuggggaguaacaugccuuuuuaaaaaaaguauuacuuuuuuauaccucuagaacagggguuucuaaaauaaggguguguauccuauagaguuuaccaaaaugauugcuggaauagggaaggaaacauuagaaguucuauuuaugguuauuuuucuccuauuuucauaccauuuugguauauauuuuguuauguacaucuacauuuauaauuuguauaauuagaaauauauaguguguucaaaaacugaucaagaucuaugauuacuuuggaagucgcuacucucuauaaguaauugcuacaaaugaagacuugugagaguuucuauauacauuucuaauuuuuuggauguaaaaauuaaugaauacucaauuacuaaauuuugcguaagaccuaaaaauauuuucauuucuauagauuuucaaguguuuaucuuuuuguugugaauauuacauaacuuuagcauuacauuuucaaguguuuccuuucagcuuaauguugcuuuuagcaguaaaucaaacucuuacuagcaagacggaggaacugaguaaauuuugauaaugaggaauauuuaguuuuguuucugaaauuucauguaaguaguaauuacaagacuuuccccuuuagccaccucguacaucucauccuguagugaaguuuuccuguacagacugugaaccaaugguuauugauaaacuuccuuuugacaaauaugaguuggaaccuucaccacugacucaauuuauccuggaaaggaaaucuccucaaacauguuggcagguaagcugaacaacuuacagugaccccaaaauuuaaaugaggcauuucuuaaaaagcugaauugaaucaaugguuuauguaacauucuuuaaagguuauuaaaguuuuaaccgcuccuuuuuaacagguguacgugagcaauagugcaaaauacagugaacuuggucauccuuuugguuacuugaaagccaguacagcacugaacugugucaacuuauuugugaugccuuacaauuauccaguccuucuuccccucuuagguaagucauucuugucacuuucuccuuggcuuagcauauaaaaguucuccuaaagcgcauuucuuuguaguuuuucuugucuucuggaaaucaaugaaaauauuuugaauauucuaaaauguugaacaucuuuaagaaaauauaacaaucuguucguguuuacaguaaauuaaaagaugauauugaaacacuuuuuagucugcaauuuaauaaagguauuuuuuuuugcgggggggugggggagggaggggacggagucucgcucugucacccaggcuggagugcaguggcguauucucagcucacugcaaccuccgucucccagguucaagcgauucuccugccucagccucccucccaaguagcugggacuacaggcauacaccaucaugccuagcuaaguuuuuuauuuuuaguagagacaggguuucaccauguugaccaggcuggucuugaacuccugaucucaggugauccgcccgccuuggccucccaaagugcugggauuacaggcaugggccacugugcccggccaaagauauuacauuuuaaauuuuuuaauuaaauauucuaacuuuucugcaaguuagauuucuaacaguuagaauugguaauguaggcuuucuguuugaaaugagacauuuuguagaaacauaguauaguuaacaagaucugagugcauuuucuaagaauuuaucuacacuuuaauuuucauuuggcaaauauuuuuuaaauaaaggaauuuguuccaaaauaauuugauaaaagccuaaaguuaguuucuggguacaaucuagcuaucauuuuugaggagugcuguuggagaaaacuuaccuuccaugaaaucacauuaaauuuaaaaguuauagucaaaauauuaguacguauauuuuauagaaaacauugugcaugcuuuguuucugucuucaaaucugcuuugugucuaggucuagggagggcauagauuuuccuuguguguuuucugauucuaacuuaauuccugcauguacuuuuagaccauaauuggcaucuuuucauuuuauagaaaaugacaaaaccguaaaucuuacuuucauguuaaaaaacgucugauguuacucucucaaaaauaacaaagcagacuuuaaaaaggaaacgucuuugacuugacuucuaugugugaaaauaaugaguagugauaguuuguucacauuauacguuucuagaugacuuguuuaaagugcauaaagcaaaaccaacauugaaguggagacagucauuugaaaguuauuugaagacaaugccucccuacuaucuugggguaagaauauuauuuaaaagaacuuguuggccgggcgcagugacucacgccuguaaucccagcacuuugggaggccgaggcggguggaucaugaggucaggagaucaagaccagccuggccaacauggugaaaccccguuucuacuaaaaauacaaaaauuagcugggcgugguggcgggcgccuguaaucccagcuacucgggaggcugaggcaggagaaucgcuugaaaccggaaggcagagguugcaaugagccaagauugugccacugcacuccauccagccugggcaacaagagcgaaacaccgucuccaaaaaaaaaaaaacaaaaaacuuguuaauuauauuaugcuuaugguuuauuguggguauuauaaacuuuuauuuauugcuuuuauagauuaaaugacaugaaaauugagcauacagaugaccacuauagguauaaagguaaagagagguuucagugauuugcagaguagugaugaugaucaugaucaugagaacauuuauguacugcuuacguaggccagguacuguccuaagcaacaucauuaauuuauacaguuacccuaugagguagaaaugauuauugguucuguuacauagaugaggaaacuaaggcauuaaaaauuaaauaauuugcacaaggcuacauagcuaauaugugaggggaugaggagccugaaauucagucuggcuuagauuuaggcuuuuaaccucgaguguuguacuaccuuuuaaaauuacaguuuuaugauuauaguugucucucaguaucugugagggauuggcuccaggcucaccuguggacaccaaaagucacagaugcucaagucccucauauaaaauggcauaguauuugcauauaaccuacacacauucucuuguauacuuuaaaccauuucuagguuacuuaauauguauauacuuuuauacuguauuguuuaaggaauaaugucaaggaaaaaagagucuguauauauguucaguacagaugcaacgauccauuuuuuuuuccuaacguuuucagucugugguugauugaauucacagaauacggaauccauagauauguagggccgacuauauuuauuuuuaagggugcacaauaguuuuuguuguauuauuucccaaaucucuagaaacacuuuguaagguggauaaguguauauucuuauagaaccauaugcuuuagaggacuugauuacuucaaaauaguguaucauaguagguaaaaccaauaaugugcauuuuauuaaauacaugauuuaguuugugaaagauaacuuuuuaacaaaaguacuuaaaaucacuuauguauucuguuuugaugcaggaauauuauagcauuuggcuauaaauaaucuuucuaaaucaucccuaauauaauuaggagauuaauuucuugagcuuuaaaaaucaugacauuuuauaguucuaacagauaaguuguguugaaugucuagcacacagugccuggcaaguagaaggacaaaaaagaacaaacacuucgaacaggaacuguuacauauguugacucauuuacguuucauagcaacccugaagauuuagccaagccagauagguguuaaauaucagggcugggauuugauuucaguuugacaccagugcuuauacacuuucuaauaugucaaugauuaucauccuuuuucuggcucuauccgauucacaaaugcuagacacucuugcuagugauauuuuucaucguauaaaguacuucucagucucuccuuacaauugaaaguuuuuuuuaacuuucaacuaccacauccauaauaaauauuagauuguuuuuuccuccugcuuauguuuccuucagagcuuuuuuucagcucagcauaugauaauaauaguaaugauuaauaauuuguacccaaugguuuuauaaagugcuuuauguguauuaacucauuuaaucccaugacaacccuguaagaguagguauuguuauuauccccauuuuacaaaugagaaacuaagccacagagagccagagagcuuauuuauaaucugaucuagaaucauauaacuagugagugguugagcagcuaauuacucaaaaguagaaaucuugcauuuuccuugaguguuuuucacuuacuacccauguuuuaucagagcuaccucuagaaugugucuucuguccauuuauuccaaaccuaguuucucccagugguaccaaggaagaccaguaucuuauccuucuugucuuggggaguuauuauggccucuaauccuuuuuaacuacuucaaacggccuuucaucccacugacaaacauuuuacugaaacauaaauacgauuguguuacuuccuuauugaggaaaagaaggggaaauaauuuuuuggagaaaauuuuaagacagacuauacauggaaccauaaguuuuuaauaagcuuaauauugaaugauguuuucuuuuuuccuauagcccuugaagaaagcuguuaggaugaugggagcaccuaaccuaauagcagacaguauggaauauggacuuaguuacagugucauuucauaccucaaaaaacugagucaacagguaauaucaagaaauagagugagccauuaaguauuuugaaugguuuuggcuaggaugguuaaacagguuaaaagcuaguucuugaugguucuaauggaauuccauuauauuaauauauuacauuuuagagccauauauuacauaauucugucucacauccauggugugcuauguuuugaaacauuaauuugaaaauuauauaauaauuccuaauuuaugaaaauggcuucaugagugugguccuagacuugcuauaugugaacauuauuuaucuuuugagaaauuuagauuagaaagucauuuuuccuuaaaaaagaaaaaaaaaacucuuuauguuuugaaaccugcagauuuuucuuucagaaugggaguuucuuugaaauguuuguagaaaacacugaauuuugucauucuggccauaagucacauuaauaaauacuauaguagucaagcaguauauaguuuaacugacugugaaauuauuaauguccuaugaaauacauuauuucuccaguacuucugacauugcuaccuuaacuacaaaucaaaaggcaguuugggaggagucaaaacauugcuucuugcuuuccagggaagaacugcauaauuauuugccauauugaugugcuaguaaaaaugucuuacauaaugaugauuuuaaaaaaauaauuuaccgucaccccugaauugggaauacacauuuuuguuuagugugcauuuauauuucaugguuuagguauaguggguauuaauaaauaaaauaauaaauugaaauuguguuuguccugcuccaaaaguuuagaguuguaaugauuuaaaaucauaagacauuguuguuuaaacuauguuuaauuuacccaauacuugacauaaacuaugcuacuugaguuuuuaacuucuuauauacuuaaaaaauauauauuuaauuuauagaagaucauaaccauuaguaucugauuuauuaauuuagauuuuaucaagauaauucugacuuauuuuuacuuuaggccaaaauagaaucugaucgagucauuggaucuguaggcaaaaaaguaguacaggagacuggaauaaaaguccggagccgaucacaugguuuaucaauggcauauaggaaagauuuucaacaacuccuccagggaauuucagaggaugucccucacagacugcuagaccuuaauaugaaggaauacacuggguuccaaguugcuuugcugaauaagguaauaaucaugaauuuagugcuacucuaguuauguucuguuauguuacuggauaaaucacauuuucuguuaacucugacauucaguuuauccagacuuuaaagaguacuucuguacucuuguagacuaaugaucauuauacugucacugcuagaauuaaaacaguguacauggugugugaaugaauggauagauugaugaagaguaaacuaacuuguuuauuuuauagaugagaaaacagagguuuagaaauugcuuuaaguugcaguaguggaugguagaauucacuauaguuuuguacuuaaacugaugacccuauuagacccacagcaugauccaaaaaugcuuugugaguacucaugguuacagauaucuuuaucccagcagccuuuuuguagaaauaggcaagcugauucuaaaauuuauauggaaauguaaagguccuggaauagccaaaacaauuuuagaagaauaaaguuggaagacuuauaucaucugauuuuaaaacuuauuguaaaacuuacuacagugauccaugcaguguggugccaucauaaggauaaacauaggagauuaguggaacagaauugagucuagauguaggcccucacacacacagucaauucuuaacaaagauauuaaaauaagguaguggauaagaagacagucuuuuaaacaaauggaacaauuggauauccauaugcaaaauaaugaauuugaccauuaccucauauuauuugaaguggucgugaucuuaaauguaagaacaaaaacuauaaacuucuagaagaaaacauaggaaaaaaucuuugugauguugaguuagcaaagauuucuaaaagcacauagcaaaaauguugauaaauugaauuucauuaaaauaaaaaauaaacuuugcucuuuaaaagaaacauuaaaaaugaagagggaagcuacagcuugggagaaaagcacauaucaaauaaaggacuuguaucaaaauauauaaagaauucauauaacucaauaauaaaaggacaaacaugggcaaaauauuugaacagacauuucaccaaagaaaauaugcaaauacaaauaagaacaugaaguaacacucagccuuaucagccauuagggaaaugcaaauuaaaaccauaacgagauacuacuucauaacugcuagaaugaauaaaauuuaaaagacaaaaaauacagggauugaugagaauguggagcaacccuccuaacauuacugauagaaaauaguugauauuuucuuaagaaguguaaacauaaauuugcuguacaaucagucauucuacuuguaggcuuagcaugccaacauggcagcauuuuucauaauagccaaaaacuuguaacaguccaagugcccaucagcuggugaauagauaaagaagaugugguguguccauauaauagacuacuacucuggaauaaaaaggaacaaacuacugauacaugaauaaugucaaugaaucucaaaaacaucaugcuaauugaaagaagccaaguacaaaagauuagacguugcaaaauuccauuuauaaaauggagcauagaaagaaagcaagucacgugguugccuggggauaggaauagugauugacugcaaguggguacaacaaacuuggggaugguggaaauggauuaugaugaugguuucacaacuauaaauuuacuaacauucaucaaacuauauacuuaaaauaggugauuuuaugguauauaaauuacacaucaaagcuguuuuuuaaaaaacuucaguuuuuaaaauuuggagauugauuuuuacuuaaaugaguuuacuucuuuuauccagaauauauaauaaaaucuuuagaguuagauggugaauugagauuguuugguugagcucacuaccaaauuuucaucuuuuggcccugaaccgguacauuaagauuauaucauaugucuuuauuuuauuuuuuuuaagcuaaccaguuuauauaucuuauuuccaaaccuaugcugcaggcuagagauuuuagucucuuguaauucuauguuugacaauaaauuuuguccucgaauguuguuuaauaggauuugaagccacagacauuuagaaaugcuuaugacauaccaagacgaaaucuuuuggaucacuuaacaagaaugagaucuaaucuuuugaagagcacucgcagauuucugaaaggacaggacgaagguuagaacauaguuucaauacugguauuuuuaauuuuuuuucuuuauagucugaaaaagcauagcauggugauguaaauuucaaagaauuauuacaguacuauaacauucuuauuguaaguucaaacaaaugaaguaaaaggugaaucaucccugauucuguaccuuucuuccuaccaucacuguugccccaaauucucuucccuagagguaacaaccuuucuuaacaguuuaguuuccuuuuauagcuuuucucaugcauucaugcgcgcacgcgcgcgcacacacacacacacacacacacacacacacacccacuuaucaaacuguauacuuaaaauaagugauuuuucuuaucucaaucauuuucuugagauaauaccaguaucugaugguuuaacucuggauggccaguuucaugacauuuucugauaauuccuucuucaccuuuauccauggcaccuacuauaaaucaagucagaugagacuuuaaacguuugccaccucugauuuaagaguucuaacaauaauuuuauauaaaagaguuagcuaugcgacuuuuuuuuuuuuuuaccauacuguacuuccauuuucuacaaauucuacuauaauuaaauucuguuuauuuggaauagcgcagaagagaagagauacaucuuucacgguaagaucacacauacuuuuuuuuuuuuuuuuugagucagagccuugcucugucgcccaggcuggagugcaguggugugaucucggcucacugcaaccuccgcauccuggguucaagcgauucuccuccuuagccucccuaguagcugggauuacaggcacgugccaccaugcccugcuaauuuuuguauuuuuaauagagaugggauuuugccauguuggccaggcuggucucauuccuuaccucaagugauccggaugucugccucagccucccgaagugcugggauuacaggcaugagccacugcgccuggccacacauacuuucuguauguguggaauuaauggcaauguauguaugugugaaauuaauggcaauuuuuguuuuguuuagaugaugagaucaguauuuuaaauuuuauuuuaaaauauuuugucgcagugguuauaauugcaccaaacaaauuuagaauauguugguaaagaagacugucuagaauaacacuagguagcauucauauauaaggaaacauuauuugagaacuaauuggagguuaacuuuuuuugcuguuguauucuuuuugaaagaucaagugcacaguguuccuauagcacaaauggggaacuaccaggaauaccucaagcaaguaccuucuccacuaagagaacuugauccugaucagccacgaagguugcauacauuuggcaaccccuuuaagcuggauaagaagguaauuuugaaauguucuauuauguaauuuguuuaugguaggcacugucaguuuuauaguucuuaauuuaacugaaguaagcugaagcuauuuuccugguagaguaucuaauaaauaugaacagaauauaguuaccuucauuggaauugacacugguugugccauuuaaacauuguuuguaaauucaagaaaguuguauucuuuuuugcuaaaggguaugaugauagaugaagcagaugaauuuguggcuggaccucaaaauaaacauaaacgacccggagaaccaaauaugcaagggaucccuaaaagacgucgguguaugucuccacuacuaagaggcagacagcagaauccuguuguaaacaaucauauugggggaaaaggaccaccugcaccuacaacucaagcacagccagaucuuauuaaaccucuuccucuucauaaaaguaagaauuguuuuuuucuuaaacauuauuugcugccuuuugguuccuuuucaaggaagauauuuuuguuauagauuauagaaggaaauugauuaguaguacaaugagugaaugaauguauagaaaauuuguuuaaaugagcauguaaucauuuuuguaugucuuuuuaaugaacauuugaacauuucuuauuuaugaugcuuuauuagcuauuauguucuaacauacauuugcaaaucuuucaaaauaauacuuucgaaaggagcauuaucacuauccacagaaagaugguuuucaauuucaguugaagucaacuaauuauuaaauauguaugcuauuuuggauaaugcugugcuuugagguauaccacugaagacaggagugaucucugcccucauuuauaaucagcaaggaaggucagucauugaacagauauuggaaguauguugaauguuacgaaaaagaugucaaguauauucuggaagcauuuggcaagaggauuuaagucaaugaagucaaggcacuuaacugaagaaguuaaugcuuaagccaaaagcugugccguuugcuuaugcuggagcaauaguaugugcagaggcauaaagagaaagacauuaagggaauuuaaaaaauuccaguauagcaaggguguugggaaugagguaaggugagaacugaaagauagaagccagauuauggaaggucuuggaagcuauuuucaacuuuauucuaaggacagugagaauccacugaaaggcuuaaaaugauggugaccuaaucugauuagcauuuuaugaagaccagguugacuguaauguguguggacuauuaucagagaggagcaagaaugaauguagggaaacccuaaugaauuaauggacuuaucaauuauauauaguggucauacuuacagcauguuaacugaagggaaacaaaauauuauaugacuccugauggaaguauccaauacugccuuugaaguugucuuacccaaaaaaaaaaaaaccaaacaccaaaauugaacaucaauguaaucaaaccaauuuauaggaaauacaggggacagagaaacaugugggauaccguuaguaaaauccagauuguagaaaacucuacaggacaaagaaucuguuggguuuuuuuccuggaaaaaaaauauuuuuuccagaaaaauaaaagggguacggaaggauuuuacagauucaaauguaguuuaagagauauauaagccaguugcaauguauaggccuuaacuguacucagaaucaaacaaaaucaaacuuuuccacaaacagaaaacauguuggagaguauggacacugacuguauauuugauguuauuaaauaauugugcaugcacaggaaucaguugggaaacccggggaacagaugcugcugaccugacagugggguuucaagaagaauauguauuugagaaauaccuggacauaccacugaaggacuugguuacuggucagauguugggaccagagcaggggaggagucagacguaugucuugagagacacuggguggguggaagaagaaaugauaaaugaguuuaguuuagaagugcauauuaggucaucaaguggagauccuaaguuagaagaugaauauugaguuugggcucaggagaagaggauugggcuagagggguaguaugagaggcagguuacugccuauugcacugaauaaaaucucaccaaggcaaaaagaagaaaaaacgcucagaacagaaccuugaaagugccaaaguuaagaggagaaagcagaaaaggagauugagaaggaagaauuuuagagcuaggagaaaauaggggagaauuuaaugucauggaagcuaaagggcaagauaauugaguggguaguugucccaaauacuuuaaaaaaaaaaaaaaaacuguucaaucaagagaaauggaaagauucuguggucuuuggcgaucuuagcaagagcaguuucuguggaguaaaggggcagagccuaacaagggguuaugggaggagugagaggugagaaaauggaaacaauggcuaugaguauaaacgaccaguuaaguuuaguuguaaaaggaagaugggaaaagagcaugguaucuggaagaguucacaggguuuugaaaauggugauuuuucuuuguuuuuaauaucagagaugcuugagcauguuucagugcuggugguggaaccaguaaagagggagagguugaaaauaaaaaugagaaaaggcauacucagcacaaaauuacugagaacgcaagagggaauggucuagagcauagaugaaagaaugcucccuccauugacacugaaugugggggaaguggggcgagggugugugcaauuuaguuagaggaagguaaaggaagucccuuaaucauggcuuugcuuuucuuccgagcucugugagguagaaggugaaguauacugcugagacggaaggggauauugggaaagucagagguuugaagagagugagggaguuuaacaaucucugugggagagagagagaaaagauugugauaagguugcuagacagugccugggauccaaguagagauggugauugugaccacucuguagagcugggcccuauuucuccagcagcgcucaugauuccaaaugcaagucuggggcaagcagauagugagucaagagaugggauuuugcuuggcagauguuaugggaagacaguagaauaagagaaauucagacauuaguaaaagugauauaucacuuuuacuuacagggauauaagccugauacagaauuggcuacuuagaagggauaugguuaauaggaggaagaaaguagaggaauugcuagagucaaagucuggcugaguuaaggagcaguagcgggaguacugugaagaugauacuccuccaucucugaauuugucuggaugugaaaggcgaagguguaaguguaaguucuuuagagagaagcuggggaauggggaggccagguucuuaacaggugaucugcuuaaacacugaagucaccacagcacuucucagacuugaauaugcaugugaaucaccugggaggucuaguuaaacuacagauucucauuuauucagucugaggcagaugagcauuucuagcaagcucucuguuggugguacugcugcuuguccacacaccagacuucgaguaguaguaagaaccaagaaugaagucagaagggcuuuggggguggaaugugcauggcagaugugcuugauagcaauaacugaagcauaccuugagaaugacccugcuugcagacaacaccugcaugcgguugggaguucugagcuagggaauaggguggcuaacccaaagauccauucccuaucuauaaggaacaucugugccccuaacccauugugaagugaaugcaggccagacaggggauugaggcccuuuguuuuggguuaaaugaagguugccagguggagguuguuagggggaagagugcuaagugaaaauacgauauaaacuguauacuuuuugcaagcaguugccauuuuucugcccagccugcugccacugggccgugcaguuauccuguccagcccaccaccauuggacuguauguaaggugcuucuccugccuagcuugccaccacugggcuugcuccccuuuauguagcccccaacaaaacgccuugucuuguuugcuggcucugggucucuucuuuggcuucuugaacuuggugccauccccacuggaguugauaggggcucagcacaacagaaggaaggcuaugaacugggugccagagacaacaguggcuuacaggcuuguacccuggagauuggccuaagauagugauaaggagagacagcgugaauggcaugguugagucucacaagagugcaagggaguaauuuugcaauagcacuaggaagugaaggaaucagugacuccauguccuuuuaugccuauggagauugugcaagagaaagcaauuucuacuuuuggucuggaaaggagagcagucuccauacaggagagcuggguuucaguuaaagcauaaguuguuguagagaauauucaguaaagaggaguuugcaaaucauggaaucgaauuuaggagagagucaggaauuugggggauuugugaugaguguauaggggaauauggguaaacuaaguuuauaguuuggacaggaaaugaggacaguagagaugaauucagcugggauccuggagguuggugagcaaucagagaacuuaaaauucagcugcuuucuguggggcaagucuaauaaucugguguuaagaggaaggcuugcgagcuuucaguuuuaguagucuaauaagcugaagugggcaccagguugcucugcacugguaaauaaaugaugacuagauucucuaguuagaagguauacuguaaaacauuaccuguuuggugguauguucccugcagaauuuggaacaguuaaaggcagaaauauaaguggaaaguaaaaacuacccaguguuuacuuuugccucuaaaugauaccagauguauaaggcauaugugugaguuagggcucucuaagguagagauagaugaccgugauaauuuugaucauagauauuucauugaaguaucaagaaccuacuuguuucaauaaaauugcuauagaauaaaccagaaaacuaaaaacuacuugaaauuggcuuuauuuuuuccuccaaggguaaaaauuguaaauauuuuguaaauacuguguaugugucacauugaaaucuaccguaucuuuggcaaugcuuaaaaacuauaucacauuauuuguuaacuugcauuagucaaggaaaacaguugacuugcuguaguaauguucuuuuguagcuuuauuuacuguaugcuuugagacuggaucccauaauuuuuuccccguaucuuuguuuuuaguuucagaaaccacuaaugauucgauaauacaugaugugguugaaaaucauguugcagaccaacuuucaucagacauuacaccaaaugcuauggauacggaauuuucagcaucuucuccagccaguuuacuggaacggccaaccaaucauauggaggcucuuggucaugaccauuuaggaaccaaugaccucacuguugguggauuuuuagaaaaucaugaggagccaagagauaaagaacaaugugcugaagagaacauaccagcaucuucacucaacaaaggaaagaaauugaugcauugcagaagccaugaagaggucaauacugaacuaaaagcacaaauaaugaaagagauccgaaagccaggaagaaguauguauaauaagagacgaaccucagaucugauuucuguaugugcucaaaaagcaaaaaagaaaaaaaaagucaaguaacuguaguaaaagaauacauaugauucuagaucugucuugaacaacaucucaguuaagauccuuuauucaucugaccaacaccaaauaucuucuauuuccaagguacuagguauggugguaggcagcagggacugagagcagagcaacacuguacagauaaauugacaggaacccauagucuugaauauucugaccaacgauggaauuuuaauauagcagcuagcucacaagagauauagugaaaauuaaaugacuucaugucuguaaaguucuugucauagugccuaccacuauguuuaguaguuaaacugugauauuauaggauauguuuaggccaaaaaacuaaaguuaugaaagcucucugguauaugaacacaaaagaacuucgugggaaaaaguucaguauuauuggcauucauuuagaggauguuaacagaucacuugcccugggguaguagaaugaccugggugguccagaaaugggaacaaaucaguccuuggaguucagacguuuauagcccuugcagaguuucauaugaaaacuuuaaacugaaauaacacucuuaaccugucugguuuuuacccccacuucccaguuacccccauguuagcuguuagaauuuuaaacuguaaggauggaguuuuguaaaggccacuuguucuuauuuuuuagugauacuaccauaaagcuauuuacucauccuuuuaagcuuuauguuugauaccuuaauaggaacuuuuacuuacaaagcaggguuugauuaguuguuuuaucuuuguugcuguguacuuacuuuuacauauauguuaaaauauaaaaucucuaaugaguggugaaauuuuuauguagaauguuuuuaucucaguauaucuuaauaucauaaacugcaaaagaagaauauugaauaagaauacaaaugaaaggcacuuaauuuuucuuuuuguuucuuuugcuuuaagaauaugaaagaaucuucacuuuacugaagcaugugcaaggcaguuuacaaacaagacuaauauuuuuacaaaaugucauuaaagaagcaucaagguaaauaaacuauugcauauaaugaaauggugaugaaaugaguccacaguuuauauaggcaguauuuuaauaguauccguuuugcacuuguauuguuuauaaauguauauggcauaccaacauauaaauaaauucuuauucuuuuuuaguuuauugaaagaaauucacuuagaaaacagccacacauacauucuucaggaauuauggaccuuuucucccuacaaauuacuggauacuuggagaauucuuguuauucuucucuguagcuuuuugauaucuuuacauuaauauuuuauaaccuuuaauuuuucuccuuuauacauuaauauuggugacuaaaaauaacguacuugagugucauuuauuuuuacaugggaaaacguaauuaaggagacaagaauuggacaaaugggccuuauucugauuguuucaguagcccaggaucauuaguacauuggcccucuguaucccuggguuccacauucauuggauucaagcaaccacagauugaaaguauuuggaggcggggaaauggaugguuguaucuguauugaauauguacaggcuuuuuuuuucuugucauuuucuaaauaauucagucuaauucauaucguauuuacacuguauuaguauuauaaauaauguagagauuauuuagagcauaugggagaauguacauagguuacaugcaaauauugggccauuuuauacaagggacuugagcauucguggauuuuaguguucauagggaggccuagaauaaaucccccauccauaccgagggaucacuguguaaagaagguggauaaagguuauaaaugguaauuaagaagugcaauuaacuggaaaacauaguuguaugaguuuaaaaacauuuuuuauuuucccuucaagauuuuggggauuuuaguauuauaagaaaacuuggggcuuaucacaucccaccuucuaaauguaaacacacuuauacuuugucccccugucucuucuaugcuacacaugaagauuuuagauaaaguugguuuuguuucugguuuucuuuucuuuuuguacuuuuggaguggcuagagcauaggccaguuugcaggaucaagauaaggcuauaacuuuucauguaauuuugaguauuuaaccuauuaugcucuuuaugguaacauucugucagcuaaaaccucauuaggaauuuauauccccgguaucuguacuucacuucugccaccuuuuagagaguuguguaguauuaugguggcuauuuauauuagcuucuaaguagcaaggaaguaggaauaaaauguccagugucuugggauauucuuaaaaccgucagcaguuacguauacagaugcaauuuuagucuguccauauuuguuacugaaaaucuuuaaaaguuguuacuugaacuuuaacugcuugcuauacucuguauuauagaugucuauccuugauuugcuagcucucaaauuguaauagaauaccaugguuuuuaaaugcugcugaccaauuuucauuucuucuuccauuuugugggagauuauauucauacuuuguucacauuccuuucaauauucagcuuacaaagagcaugagaagaagcuauugaaguauuugcuuggggagcccaaauuucacuagaguguuugcagcccuugaauauauuuugaauauauuaguuuuuuguuuuuuuguuuguuuuuuccuuuuucuuuucgguuguggaaggaacaaccucuuucccauuguuuagcccuagaguguuuuagggacaaacuauaauacuguacuaggauaauaauuugcuaaucuuucaacauauuuuauauugucguaguauugauuuuucuauuuucauuucacuuugaaaaaucuucccaaaauuuucucuccuuucuuaaaaaaauuauacugauauauacuauucauuaaaaaguaauugagaguacuauuuauuuuuucauacagguuuaaaaaacgaaugcuaauagaacaacuggagaacuucuuggaugaaauucaucgaagagccaaucagaucaaccauauuaauagcaauuaaaagaaaauagaauguggccacuuauuucacuaucuucuucaaauacaaaguaaauacaagacuguugugaucuugcauucauuuucugacaugcauuguuggcuauuugaaauacuaaaagcaaaucuacagauccuuuuuccaucauuuuacagugaccuuuucuucauuuugguuuauuuuuguaaugugaaaaguaucacucuaaaaaacauuuuuaauuuaacaaacuaaaaauauuccuccaaaucucuugcuugucauugacucuugcgugucaauuucccucagguucuauuuucuuaaaccaaccuuuaaaauugucaccucuguuaagguugaacuuugccaaaaaaaaaagaaguuacuuuguaauuuuuggggaaaaaagcacauacauuaaaacuagguaauguuuuguauauacaguuauuuuggauauauuauuguaaguuguacaaauguauuuugaagaauauuuaagaaaagcacuuuuguuauuccaucaauaaaugcucuauuuuacucuugugugguuuaggaaauaaucacauuuaaaguaaucauuuaaaaacauccuaagauaauggaauuuuaaaggccuugcuuuuuagcauuggaaaaauacaccacuugaaguucauguuuguuaagccuaacuguaauuacauguuacauaaucugcauugccuuuuuacuauauguucguaguuuuuguuggccaugccaacauacucccauuucugccuagauuaugggaaugacuuuguauggggcagauagacagauacuuuaaaagcuauuuaaaaagcaaacaacuuuggauauuauugguuuccuuacuucaacaccuuuuccuuuaucacuaggauuguggauggcacgaagcugaagcuguuagggagugguagguuuggaguacaguacaugcucugaaauaucuagccuuuagcagcuucaugccaugcuugcaaaagcccacaacaaauuggaggccuccuuguucugcucugcuguucucacacuuaaacucuguuuuauuuauaagcuaaauggaaaggaaacaccuuuaagaugacuuugcucauuuugcauccccccugaguuucacaggauaaggaaaaccacgcuauucauucuccacccucaauucaacauggccuagaguauccguacugaggaagcaaucuuauggccugacucacucaccauucaugaucacugcugugccuuuuagugguuugggggguaagcaguagaaaagaaggucaaaauagauuuggauuaagaguaggcaaaauaaacuuauaacauuuaaaaacugaaguauuuuuagguuuauaauauugaaaaucacauacccuuagcuuuuuacacuuuaucagacauuuuuuuaaauuucaaggguauagcaaaaugaaauuauaacuuuaugaagaaaagcauugaugaaaguggagaacaugcauuuagucuaggggauuugaaacucucccaauacugaagacaaacccugucaagaaaaagaagaauuuaauauuauauaguauuuucauaugcaguucuuuaagcuuuguuuacuucuauacaaauacuuuuaaguaaugcaagauaacauuuaauagauggaauuguuaagguaauugccuguagucacauugcuaaauucauugagaguuacacaaaauccagaauauauugucuguuccuaaauuauauauauuuagauucuggaauuacuaggaggaauuagaagucauucagauaaaaauucauacuuaacaagaguaucuaggaaagagauucagcccaucccaauauugagcagcuuuccuuaucagaaaguuuuauuuucuguuucacagauugcucaugaccuuuaauacauuuuucugaaugaacccuggagggaggugagaaguagcaguuuuguucaucucuucuuuuuguccuuuaucucucugccacuguucucaccucauccuaaaaccuggucaggaggguuugaaaccuaucagaacuaaagguuaauaucucaucucccucaggcuuuuuucauuuaaaaaaaaaauggguauauuaguuaaauuagaauacuuguuguagaauuauugucaaaggggaagggaaauacaucuaggggaaacaucaugucuuuuaggcccuuuaugucacugaaugacuuaaggcucgacaaaugauauucuuggaaaguuuaaucuugagguuuucaaaucuuuuuuuuuaaugucucccauguuucucauuugcugauugauucauuaguugcucuuaguaagauuugucaguuggaaauaaugaaggcugagacucauuucuaaacucuuccauaaccaucaccagaagagcagccacuguguugugugauguaggcuaaugccucccagauagagguaaagucacaaggacuauuagaauuccaguggauuguggaacugguuuuggauuauccuuauauuuucauucugauuacugaggcaguucugaaaacuccuaccauugaaauaguggugugucuuuuccuuguuuaaggauuuuacaucauuuuuaugcacuugaauuccaaaaucagaaucucucuuuuaccuaucaaccuuuauuggcuauuggcuuuuggcaaugaccuuucuguucaaauguaguccugucucuuuguuuccuuagggaguagaaccuguccuuuuucucaucuuucauuuuuuugacguguccuuucuaagagaaggcucucugccgccuguucugggugauaagugauauuuucaucuaaucguuaugugguugggaugaucauggugaaauacuaggaagacauacucuguugauggacuuuuucucuccaaauaaucccaaauagauuauuuucuagugaaugguuuauaucuuucucgucacaaaaauguuccuuugauuucuagcacaagguacagcaggaugcaaaugauucucagauaaaaugauguugacaguauuuccuuaacaauuuauguaaaacuaugcauaauuuucauucuaacuuuugacauuuuucuccauaaauaaaaguaaugccugauguuuaguuaaaguagauccaccuuugcuugauuuuauuagucuuguucuauccuauuucuuuuuaauacacuguuuagacuugccaacaacucuuaacugagaaucucuuuuccuuccuaggcuaaguaauugugagugggggaggaagaacauuaagagaaauaaucuaaagacuuuguucaauauugucgaagccuaagaauauuuguguguccuucugauguacugaggcuuugccgguaccacaccaucuuuggauuaccauaagguuauguaguaggacuuaaaaguacuagggcaaacauuugauuuuugagaaagaucaacagaacaguauagaaauccaggugcauucauuagaauacuaggaucacaagaggacuacucugguguacucuagugaccugaaaaaacucuaaaaugauaagaaagcuaggggacaaagggaaaaaagggcaagauuuauaauuuauuuuacuuucaugauuuuuccaagugucuucagaaguagaaaccuauagcauuaaaaaaaaaaaucuacauuaacuauauaugagcugagagaaugagaagguaaaaaacauggaggauaaguuuccuuuguacuuacgaaauaguccccuuucuuaggauagaagauagcaacuggguagcuucugaagcaccauaaaaacagcuagaaagaaugcuuauuuuugaggggauaguggacaaaugagcccuuguugcuagagagacacugauaaauuaucugaauccugucaaaaaauacuguaauaccuguguuagguucucucaggaaauagaugaauggccgaucugcuuuaaaaauaggaauccgagaccuuuucaauaacaacagagcugcaggaaagaaagaaaaauuccauugcauuuucugugcauuuuuaagaaaauaacuauugguuaugaaguaaguuaauuuuuuaagaaaucaaagcauccuaauggcauuugauuguuuacuguugugaugggggugcagaugggaaaauuaaagagaaaagaugccauuuagccaauccugucuccuguuuucaacacauuccauggaauaaauuccuuauugaagguaacuuucagaauuauuuuuaugggauggauaucucuucuuccccgucauuuuucaaaaacuuuuuguuuucuuuaguguuccuuuuuaaaaaauacuacaccacaccugaacuuggggguuauggaaagauucagaagugugaagauucaacuagguaaauuucagaaagguagauauggguaagcagugugacuggguauucucugaacauaccuguggcuccagaugccuuggugccuuccuccaaaacuucaaucuuggccuuguggauugcuucagaaacauaaaagccaucuuggccuaaccacagaaaaugauaaaaaugugaguugcucauuaacauuuuucuaacacauuuagaacacauucuuuaaaaauguacuuacaaaauuuauaguauccaaugcugcuuacuguguagcuagggaaagaguggaaaauucuguuuuuguuuuuacuggaggcucagguagcuguuuggaaaauucuuaagacucaauauguuaccaaacuuuaauuuguuauauauauuuaauuuguuaaaauauguaaucgcucccaaaauaauauucagagcacugccccauuuuuucagugguucauuuucagaaaugauucuaguuaaaacuacaaucccuccuucagccaguauuuccuaaacuucagugaucauaggguauguguuaaaaugcagauucuguagcccgggaaucauuuucaccaagcuucagagaucauuucccuugaaugccuuuuuggacugcacuuuaagagccacuuuuaaaugacaaagucacagguuuuuauuacaggcuuuauugaggcacaauucagaguaauaugaaugugucuaguguugcaugacuguauucuguauacuuagguguaucaguuaugcaauuaauuugccucaugggcuagaaucuacaaagcaaaugagagguuaguauaaauguucuaugugcuaacaguuucacagauuauaaguuuagcaaauaggacuaagugauaauuuagaggaauuggcugauuuuuguaagcuaaucauuaaccauuuuuaaacagcuccaaagaugaaaggauacuugaugacacaguaaaaaaugaaagauuuagaaccagaagaaacuuaggaaaucauucaguccaauccuuucauuuuagagugagcugugaacucaccugagaucacacauuugaaaagcagaguugagaauauucugauugaaagcccacucccaucccaccccucuccuccauucaaacacugccgccuuucagaaaguguaugcuagucagcuccaacaugccacugggagguaucuguggcaugaauguuaaaaugaucaguuugaugaacacauauugugugagggagcuuuguuucaucuuagacuaacgcuuaaauugguuuguguuugucacgcacacacaggagauagcccaugaaugccaugagagaauaaaaccagaccaaaauaaagaauaugcggcauuccauccaucuuguaagaugugcacaggauguugggaguuggcuauauucacuguaaggaacaguuauuuuccagcaucagugaaggggacaggaagggccagaggaaguaaaaaucaauagaaacauucacuagugucacuuguccuaaaaucagcaaagaauuugauuuauuuuagcaguuggucuuuuucucuagggucuuuaagaaacaaauuucacuaucaauaauuagccccucuuacuagcuaauuaagcaaacugaaaugcagugccaaaguuacaaagagcuuuaggguuaaagaaugguuauuugacagucaugagaggcuuuuacuaaucuccgagacuucaugacuauauaggauggugucugaacauuuuaaaugaauguuggugaaauaagcagagauucacuaugaaaccccuuaucagcuaaaauacaguaaaugugucuguauuagucugggcaccuuggcagugugagaaaugagaccaguugauguggaugagucugguuagaugggccaggcuauuucaguauuuugaaacugcaacugaagaguuucauuuaaacaguuucucuccaucagacuauaggagugguccaauaauugacauuuauauguuugcacagccauaaaccaagguccauagccuaugucaugccccagcaucagcaucuuuuaaauuuuaucucugguaagaguugacauuucaaaagaccaacauaugcgauaaaaaugagaauaugggagucaucuaugguuuugcauuuuuccucccacuugaucuuguauuacagauuccuauuauuuuuuauugaguagcuauugaaauauuacagaacuaaugaaaugaaccuagaagucaagcacaaagggauucuccuggucuuuuucuacuccccugaaguguugacagcugcuuagugccauugagggacauacgcccuauuuucccaaaaguuguucucaagauuguuuauagguggcauucuguaaaaggguuccaugauuaauuauaugugggagaugcuaaacaguuuugcacuuuuguuuucaguaggggacuucuuagagcugcuaaucugcuaacuuuuauagugaaucucuacaggacaauuauaauacauagcguuuaaccauagaaccacccacaccauucucugucccagauuuacaggauuagcauuuugggaacauacuuugggaaacuguagcccaccauaaacucgcuugcuccuacaauacaacauucuauauacaaagcaaaggggugauacucuuccuacccucccuccuggcauacucuccacucuucuuccauaacaucuucuauggguuuuuaccuuccuuuuuagacuauuagcuccuagaagcauaaaugaugucuuaaucauuuuaaauauuucuuugcccaacuuacauuaaaaauacuugguacauuaauguguuuaguaaaugcuggaugaauuaauaauagacaccccuuaccacuauacgaauggccuuaauguucuuuaaccuuguuaaacuuguaaggaaaugcugauugguguuuguagaaccauaaaggcguggcauagaaugggucaucugcaagucucagccaaaugauuguuucagugcuuuguugguggacaccguuauucuuuguguauggcuggucauacucaaaagguuaaaagucuucaaaacaugacguuguauaaacauugugucccaacauuucauccucagcuucucauaaaucaggauaaacauaucauuugcuguuucuuuugucuuuacaauuauuugcuguagccaguguuaguggcuuuuaaaauguuauugccagaacuugcuucuaguuuaucuuuuucaucuugucacuuaguugcuaacacuaaguguuagggagagggggcuagagagagaaacacauagcacccggcccaggagagggagagagagugcuaagaagaaucugaaauggccuuugaaauuaggcuaugguuaguugcuuucuccauuugucuccucuagcccacucugcaccucuuucuauugcaauucugaccagacaucugguguggcauaaguuaacuuacauaacuuccauacucaaccaaacaacucugguuuguucauuuaagucauaguaacagagaacuuguacuucuuaccgagcagagauuggaaacuaccuacuuauaaaagccaagaacaagacaguuucuucagaguuucaaguuugugcacaaggaguauuuuguggacuaggaggcaugggucuauaucaaagccugcugauccuaaagccagugggauugcuuaagaagaguaucuuuagcuggcaucuucagugugagugaaacuggaauuacucuuaaaagcugcauaacaucuaguaucaaggagacugggggggaacuacacucugguuucagcugggccuugagauaauauugaaugaguccuuaaggcagcaaaaaaaauauuugaugccaagaaggaagagauaagugacuuguaaauggggaaagagaauuugaguaaaaugauucugggcuuugggaccgaaaggccaaauguuugcuguggugguuggaguuccaucaguaguacaaaacugcuugguaaucccucguaaacuggaagaagagaggagaggccaguauuuucugaucacuuacucucuggcaaggucucugcugaugucauacuauaaguaaaugauuuuguuucuacaauuaagauguguggugagugguaguuaccccauuuuaggaaugaggaaacuauuuguuggagagauuugguggcccugucucuagaauauuaaguugaaagcccauuugggcagagaagugguuagucucuugauuauguuuaaagaaggacauuaagaagcaauaauuugguuggcaaucuuuuucuauaaagggccggauauuaaauauuuuagccacugcaagccauauggugucugucucaacuacucaguuuugcugcuguagcaggaaagcagccauagaugauuuaugaaugaaugagaguggcuauguuuuaauuaaacuucacaaaagcaggugguaggccauuguuugcugaccccugcuuuagaggaacaaaacuucaugagagaaaauuaacagacuggcauguuuugucaguaggaaaugugaaugcaagcuucauacuuggcacaugauaauugcuucauaauuauuaaauaagccagaucugccugccuaccuuucugcugguuugagcaaauauaaguagauuugaauagcguuaaaaaaaaaaaaaagguuucguaucaaaaaagguacuuuuaaaacuagguuauuuauuagaucuugccagaggaguuuguggaccuuggaagccuuuaccaauaggggagcuacaugauguguguuaagaucaguccuguuugaggacagaggguugauggcacauuaggauguacuuuuaggacauaaaagggagagcuuuaggaguuaugaagggacagucaguaagcccuagugauucacggaauacagugauguagaagaaaauacagcgauguagaagaaaauacaguuuuuaacucugaucaucaaaaucaccagcaacaacagggaugccauggcugagcucuggaguugcaagaagacacugguuagauuuugcacauuaucaaacauagaauucucuuaaguucuucaucccuugcucuuuccuugcccuccaaucuuuucacuucaguauuccuccuuugcuugaaaugucagauuaugccugugucaguaaggaaaguuucuguuugagucauuugaccaagucaacaguauuuacuugguauccaacugugugccaagcaucguuguggacacaaugcccaaacuugacuauugcuuugcuaucucuuugcguguucaggcaaugaguacagagcugguagauuuuaaacucuguagaauagauucucacuccuguguuuuauuugauaaguaacugucaaucuggucacaucuaaagcccaaaccaagacuucucuuguggaucaaaaucucaauuuuccugugauuccuuaagaaggaagauucugagccaagauuuagaaaaguccacauuaugauguucuagaauucaaaauagugauuuucaagcccuucagguaagggaaaugucaaggccaauggaaauaccagcuacaguaucaucuuugcacagauaauuuacuauccagaguagaaacaaaccugagccuuugaguuggcaauaguuuagccaauggugucuugagaggauuguagaacauagguucuggcauucacucccuguuuauauuugauauaaauuuccuauaauaccauaagcaaacagcaccuauugauugguaguagcaauucaacuuugugcaaagaaauucaaugugguugguggaaaggagaacauuuuaaggcaagguuguaagaguauggguaauuugaaaaaaggaaauuggacagaugagggaagguuucaagacuagcuuauuagaagaggacagagaagguauugggaaggagggaggaaaaggguguagaaacaaagggugacugaagcugaugggacagcaggaggucauaaugaagaaucuauugcugcagcaaugccuuggguacacuccuagucaugacgguuagagggagggucuguuuacugugugcuguggacauugaccccauggugaaggucgucucugaaaaccaugauuaaggccugaagaaacaucccuuccucacaagaucuaacccaaauuugacuguuauuagaagcaacacauucuuauauaaaacagagcaccuuucuuauucuuuuacauaauguugacucugaaaugagaaucccuuaaucaaaguaugauaaaacugccccaaauacacggcuagaacguuuggaagaagaaccguuuuuaccugaaauuccuuucaaguuagcuuugaguggaucaaaaagaucggugacuccccaagaauuuaaaaugcuuuuuaaguugaauugauuuuggauccuaaaccuaaaaggcaaaaacaaaccaucaacuuucaaaauucucacucaauauacuuucauacacaccacaugaaguccaaaaucccuaacuuggaagucaggcuggcuccaccagauuuauuuccagcuucaucuuccauggcgccuucccauaagcccuaaucugaccacacagggcucuuccccaccucuguacucuuguuccugcuguucauucuaagucuucccauugacuuugauugucuuuuaguuauuauccauuuuucaguuguuaccuccuccucuuuucuucagcuauuuugugaccuuugguucuuaaagccccauuaauaccuuguucugcucuuacgauauauagaacauucugcuuccuauuagugucauuuauguuauuguaaacuaccugagaaaaguggcuaucccaauucauuuuuuaaacacuuuuuuuuuuuuuucugagauggggucucccuauguugcccgggcuggacucaaacuucuggccucaagugauccaccugccuuagcuucccgaguagcugggacugcaggugugccccacugugccaggcuccaauucauuuguauuucuuaauaaaaauuaauauuuaaugagugcuuacauuaugcuagauacuauaagagcuuuauguggauuaucagacauuucaucuucauauaacuauguuauuauuauccucauuuuacagaugggaaaaucaagacuuaaagaguuuaagaaacuugcccaagaugacauaaugaguaugugauggaccucgauucaaaucaagccugugugugugcagagcccaugcucuagucaccuacauuuugcuaccucccaucucguguggcaucucacauauaguaggugcagaaaagaggcuguugacuaauugccuuauugacaauuaauagaguauuuuauuuaauagaguguuuauacuggauaaaauauauuuucauauuugcugugugcacuuuaugccuuuggagcacagugggaaaagaauggaacuuaaagccuugguuuuccuaguaaacccuuugagcacaaagaaucacuacaccaauuuuauauuuccccagggacaaggcauuuaaaaauuuacuguugaaggauacuuuaaaagggcugcugauauuauuuuucuuugaaaauaaaaaagaucaaaauggaaauuagauggucuuuuucuauaaauaauacagaacuugcaggagaguaaaaauauugaacaagaccauuuaauaucaaaggucuucauugcuauacaagacaguaugacucauacuuuaaacaaaaguaucauacuuucucauaaagguauguuuugaaucuucagaauaguuuccaaaaaagaaauauacuuucuccaaguaugcugacauuucuccaaaaaacuuuuggacuaucucuuacgaaauuuucuuaaguacugaaaacacauccuuuuugaaaacucuaaaugcugaaacagugguuaugagcauggacuugggaauccaaugccugaguuugaauccuggaucaaguaacuaccugcaaacuaguuacuuuaccuccgugggaaguuacuuugcuucucuuugucacaguccucacuugugaaaugaccauaauuguaaugcguguuuguaggguuguaaagauuaaaugaaugaauccuuguaaagugcuuggaacaauccccagcacagcccaugcacuuauuguuaccauugugauuuuuaaauuauuuuucaauuauguugagaaagaguuaauuaagggcuauuugaaacuaaauaugauuaugguggguaauaaaacuggauaauaucauuuuucauaaacuaaaaacaucaguaaaagugagauaugacuauaaaagauuagagugauugucuuguauggcuaugaaggcagauccagcagaaaugcuacaaaaauaacuugaguaaaaaaauacccuuuaccaauaccagacaaggauauuacaagaaagacaaauuacagaccaauauaccuuaugaauauagaugcaaaaucuucaacaaaauacuagcaaauuaaauccaauaccauauaaaucucaccaugacaaagugggauuuaucccaggaaugcaaaguggguucaacauaugaaaaccaauuaauauaauauaccauauuaauagaauaaaggacaaaggccacaucaccaucucaauagaugcagaaaaagcauuugacaaaguccaacacccuuucaugacuaaaaacaaacaaacaucaaacauacaacaaacuuuggauagaagguaacuuccuuaaauugaugaagggcagcuacaaaaaccccacagcuaauaucacacauuacaguaaaagacugaaaacuuucccccuaagaucaggaacaagacaagaauguccacucugaccccuucuauuucacaugguacuggagggcgaguaggacaauuaaaugagaaaaagaaauagaaggcauccagguuagaaagaaagaaguaaaucuaucucuauucacagaugacuuggucuuauacauagaaaacccuaaagaauccacacacacaaaaaaaaaccuaucagagcuaauaaaugaguucaguaagguacagcauacaagauuaagauacaaaaaucaauuguguuuguauacgcuauagaacaaucugaaaaugaguaaaaauuaaaaggaguaaaauacuuagaauaaauuuaaugaaagaagugcaagacuugcauaaugaaaaccacaaaacauuguugaaagaaacaaagaaagaccuaaauggaaggaaagauauucugaguucauggcccagaacauuuaauauuguuagaaaguaauacucaccaaauugaucugcagauucaacacaaucccugucuaaaucccuccugcauuuuuggcaaaaauugacaagcugauucuaaaauuuauaugaaaaugcaaggggcccagaauagcuaaaacaaucuugaaaaagaagaaaguugaaggacucaaacuacaguaaugaagacugugugguacuggcaaauauacaaauaucuaugccuauaggauagaauugaaaguccagaaauaaacuuagacauuuaugggcaauugauuuugacaaagaugccaagaaaauucaguggaggaaagaaaaaucauuuuaacaaaugauauugggacaaagggauagauacacacaaaagaaugaaguugaaucccuaccucauacuauauacaauaauuaauucaaaauggauuaaagaccuaaauguaagagcuaagccuauaaaguucuuggaaaaaaaacauacaccuaaauuuuugugacccuaacuagacaguggugucuauucaauauaauauggcaucgaaagcgcaagaaacaaaagaaaacauagauuaauugagcuucauccaaauuaacaacuuuugugcuucaaaggacaccauugagaagugaaaagaaaaaccacagaaugacaaaguauuuacaaaucauauaucuguuaagguacuaguauccagaauaaagaacuauuacaacucaauaauaaaaagacaaccaauuuaaauaugggaaaaaccucugaaauagacauuucuacaaaaaagacauuucuccaaguacaugaaaagaugcucuaccucauuagucauuagggaaaugcaaaugaaguccacaaugagauacuacuucacaccaacuagaauggcuaaaauaaaaagauggucauuaacaaguguugacaaggauguggagaaacuggauuccacacacauuacugguaggaauguaaaauggugcagugacuuggaaaacaguuugauaguucuucaaaauguaaaauguaggguuaccacaugaccuaguaauugcauucuuagguguauauccaagauaauugaaaauauauauacacaaaaaaaugugcacuugauuguuucugguggccaagaaguuaaaacaagccaaaaugugucuaggcacucaaauaucuauaaauugaugaauagguaaacaaaauguacuauaucaauacaauggaauauuauucagucauaaaaaggaagauaguauugauucaugcuacuaugaaccuugaaaauauuaugcaaagaagccagacacaaaaggccacauauuguauaauuguacaauauguaauuguauaauuucacuuacaugaaauucucgaauaggcaaaucuauugagagcaaauagaucagagguugcugggagguggggaggggagcugggagugacugcuaauggauaugggguuucuuuuugaggugaugaaaagguucuggaauuaguagugaugguugcacaacuuugugaacauacugaaaaccucugaauuguguacuuuaaaauggugaauuuuauaauaugugaauuauaucuugauuuuuuaaaaaagaaacacuccuagaaaagcauaaaccacacaccaugauaaucagcagcuccugggaggaagggcaaaacucauuuugaauaugugggaucugguggauuuuaagaagauauauauuauaucuaauaucaaaacaugcucaugcucagccuucuauguugaccuaauaaucaaauguuuuauucauuacauacauauuuggcauuauuagucuuucuugugggacaucauaugauugugguuauaaacaacccuuaacacauucuugguuuucuugauuauuccuuuaguaugcuaagcgucccucaugaagauuaacagucccuaugcacuuuuuuuauuuauuuauaaauaaaagguuacuuuggaagcuagacaccauaauucguccagaaucuacuagugcacugcuuggugaugucuaaccugaaagcacaucucauagucacacaauuuugcauugcuacccacagugugcaaaauuuuuuugcucuuguuaaacgaaaaaugccugcugacugcagagcaagucauacuaaaagaagaaugagugauuugagagaaugagagguaaaucccugccuaaaagcugacuuugugucuaccgugauccaaaguuuauaccuaaaucuagaccuaagagaguuuuuacuuuuuuuguuuuguuccccaaaggauuuaaagcuagcuuaaaaacaaacaaaaaaaacuugguuaguuuuacuugugaaauaacuucauuuuccuaaa

SEQ ID NO: 21520 - RNA, 26418 nt, Homo sapiens
ggagaaaaauuuuauaaucauauaccaguuaaagggacuugugccaggcuauaaaaggacucuuacaacucaauaauaaaaagacaaauaacccaauuaaaaaaugagcaagugaucuaaagauagcuguccuaagaagauaugcaaauggccaauaagcucaugaaaagaugcucaauaucauucgccaucagggaaaugcaaaccaaaaucacaaugagaugccacauuaccccuacuaggauggcuaaguuaaaagauagauaauaaaaagcacugagggauguggagucaucagaacccucaugcccuguugaugggauauaaaauugugucaccacauuggaaaacaguuugggagucccucaaggguuaaauagaguuucauaugauccagcaaaucugcucccaggcauauaccaaagagaaaugaaaacauauguccacacaaaaacucauacacaaaaguuccuagcagcauuauguauaauagucaagaaguagaaacgauccaaauguccaccaaucgaugcaugauaaauaaaauguaguacuaccauuccauacaauggaauauuacccgaugaaaaaauaaaguugaacacaugcuacaacauggaugaacuuugcuuauaagaacauugaaaagaaaaugccaaaagaaaaaugaguuuuagcucaaauuuuuuuuuaagaggccuagccugcucaaguuauccuguuaaaaaaaaaaaaaaaaaaaaaacucuucccauaucuaaggugaaaauaaaaaacauuuuuaaaaguuuaauauaaagaaugaaauaauuucaggucaaguuuauuauacagaaauuauauuaaugggugggauaaauacuuuacaggagagggucacacucucagacacuuuggcucccaaagggcuuggagcuuuugugaggcugagcaucuuccaaccaggugcaugcacugguuugccaacauccucaccacgcccaauccagccccuucacacacugacaucgccuaccugggcccuccuuguggccuuaaguuuuaucuaaccaguguacacaacauauuuauaaccaauuaauacgugugagucaugauuuguuuaaaaugucagcuuuugugaacugaaggggaugggcagaaggcaggaugcuguccuuggucaggaaugugacccagauuuuaacacugcuccuaggaaaaaaaaauauuuccuuuuaugaugccacuuccugggacaugaugagcugaagauuaaaaacucuucagagaugugcgagaaaaaacaagcccagggaaaagucugcaggcaugguggaggaagaaauuagggaugaaaucgcaaguggcagagcaagcaugaccaggcugaagucagcagagacaagagggcagcgaggcccagccuccucuucccucucccacagcguuuagggccacguccauggcgccaccccucuccuuucuucccaacugaaaagggugcccucuuuccuucuuuucugcagacgcugaugagaauuaaccagaggaacuuccuccacagcaacuauaacaggacauccucauccaguccuccuaucucauuuccugguggggaaacaggccuggcaaggaaauaggccgaaaucacgauuuaaaaaauguuguguuuaaguacucuggaacccuguguucagaggaaaucgugcaagaauagaucaaucagagcugaucugauggagacggaggauccagccacacagaggcccugcauuaacuguauuuccuguacucuugaugcucugguaucuggggccucgcugaccuggacagacugauccucccaggcuagccaaucccccaaucccuagagauggcaagcaucuggcugaaagcaugccuuuccuauggaaaccaacuaauccggagcgauggcgccagcugccuccuucacauggcucucccagggcugucacaccccaggccaacauucaccuguccugacuaucccggggccagguaucagacaaaaagggcagccccuauccugagagccacugaaauuacucaagccagcuacccuuaaaccugucuccccugcuuacucugccuugcccauuuccuccugaggaaaccagaggaagucucuugcccacacguuccccucccuccuuccgccuucugacccaccguggggcuuuccuauguggccccuccucucagaaccguaaguaacaaacucuccuuuccauggcaguccccuccucauccaauggcuuuaccacaccucgaugagaugguuuacaacaggcccauucuagaaguaaacauuauucccagaaauccuggaauagggauucagaaaauucacauuguggaggugccacgacucgggagagccuggccagcgaggugccacccgaauagcuccugaccaugggcacagaagggaccaaacauggagagaggcacagccuggagucauggaaaaggaccaggcaggacaggaggaagagccuggcaaggaggcaggggcgcaauagugcccaagcagugugggcauuaggaagagggcagaaagaaaacagugcuguggcacaagaccggggcagccccgggccagcucagccauccaguucuuccuugacacugaugugcaaggggcagaugcgcaaaggcucuggaggcccggcgccccgugcaccccccagguagaaguaggggcgaaccuccccaaagcgggcguggaagguguacagguggcaguggcgcuccgcgucauagaaagacagcucgcccuccucacacuccagcuccacacgcaggcggcgugggauggccaggaccaggggcgacguggcuggguccgaggucacgcaguggucccccuccacgcccugcgugcggcagacauaccagaagcccgagcgugugucgugguagcagcugugugaguggcccucagcgcccgaguccuggcgcacacguaccacgcccacccuccagcucugcagccccccaagggccaccucccaggcgugcgagcccugugagaagacacgggagcccagcaggcagggcgccgaggagaagcguuccggguucuccaccugcacgcgguagccaugguuggugacgcuggugaggucgucagacacggagagccagccagcugcgguguuggggucaaagcugaaggguacugcaagcagaggcggaaauggggaaucagcaaaccugaggucccuuaggccacacguggauaucuccagccccacaaaccaaccacugugucacaccuggccccaaguccaugcaaggaguggcccagggcuggagugguggcagggguugggcuguaucccccagaagauaugcggcagucccaaccccugguaccuccgagugugaccuuauuugggaauggggugguuguacacauauuaguuaagaugaagacuggaggaggguccccaauccaauaugaccuguguccuuaaaauaaagaggagacagacacagauacacaggggagaaugcugugugauggcggaggugaggaucaaagugcugagggggagccaauaaggccaagaauggccaggagacaccaggagacggaagaggaaaugaagacucuccucuacagguuucagagggggccugguccuuccaacaucuggauuuuggauuucuacccuccagaacugugagagagucaacuucugucauuuucuaguuugugguccuucguuauggcagccacaggaacucauacaggcagagacucuuaacacucacacgaccaagggauguuaggacagcacggcccauucccugagucagugauauuccuccccguaaaaccaggacacuguggcucaugugggcugcagucgccuuaggagaggcaagcccagaugcaggaggucuuuuaucauacaaaacacaguucugaauaggcaagaaagccaguuucccucucugaagaagggaccaagugucaggacccugagagaaggcauucuaccaggaggguuggagguguugggcagaguggaaaagaccaggguacaggaaccugccugcgagggacuggcagagggaucagcugagagaggaggggagcucugaggaggugggaggugggcccggcagagaccagcccuggugccucuuugcuaacaugaagggcuuccacccaugcuugggacaccugccggcacccccgcucaccagauuccacagaugcaagcaucuucuuccagacgcgguacugcagggagcccagguacuugcagacaucgauaagcaugccgggcuggacuggcucuggcuccauggugcagaagagucuggaaaaguacaauggguauggugggcagggccagagccaugcaaccugggccgaacugggccaacuggaaaccagcaacaggacuuguucccuucccucaggcccaaguuuccuggccaccuucuccaagacaagacuggacugggcuacgaugggagaugggccaaggccaacagggcugccaucucccuucagcauucaauccgagggcucacccugccccaacuaggagaaauacaaacaggagguucuccaacauggcugccauccuugcaggcagaaaucacacuuacacauccggcucaugggaugucugaguuggaagggacccuaaggaugcucuaguccaacaaucccaagguguccuccagccuuugcuugcacacugccagugggaagugagcacagggaacucacucccuccaaaagcacucuauuccaucuuugcacagcucugacugggacacagcucuuccucauucaucccugugaacccaacaaccaucaacacaaaccaccauggccuaaggcucucagagggagggggcugaucaagaaacaagccugacauugacuggccccgagaaaugcaagccacaugcaggauaguguucuccuucccugcacggcagguggggacccuccacacucaggagaacaacacugccccagagccaacuugaacuggaugcugugagagggcucucuccaccuggccauuguccaccucucccucuaaaaccagggccaguagcucaugugugcuggugcacccagcugguuguuaccugcuugccccggggccacuggaguuugcaccccugguauuucugcccacucuuccccuccccuccaccagcuuuggcaacuuaccggcguuuucggcucuuguguuucugaaaaaauaaaaauaaaaaaauaacacagagacacagauguagaggaaauguauauguuucugaccucaaaagaagucaugcauuccauggaucauaagucuuaauauugucaagauguuaacaauaacaucccugcuaugauuugaacauauuauccaaaaguucauguguugaacacugaauccccaaugcgacaguguugggaggaaaggccuaaaaagaggugauugggucaugagggcagagcccucacaaauggauuaauaccguuauugugaagugguuuaguugucaugagacuggguugcuauaaagcaaugagcaacuacucugucuugcacucauuuccuccuucugccaugagaugacccacaccaaaugccagagccaucaugcuccuggacuuccuggccucacccagaacacugagcugaauaaacuuguauuguuuuauaauuuacccagucugugauauucugucauagcaacagaaaacauaagaagagacuccuuaaguugaucuacugauucagugcaaucccuuauccuagcuggcuucuuugcagaaacuaaaaaacugauccuaaaauucacacaaaauuucaaggaacccagaauagccaaaaccaucuugaaaaagaagaacauuggaagacucauaaucuccaauuucaagacuuacuacaaaucaacaguaaucaagauaguaugguacuaauauaaaaacaggcacugagaucaauggaauagaauugaaaguccagaaauaaacccucauauuuaccaucaaucaauuauuuacaauagugccaagaugauuuaauggaggaauagucuuuccaacaaaugguacugggaaaacuguauguugacaugcaaaaaaaaaaaaaaaaaaaaagugaaguuggacuaacccuuacuauaccauauacaaaaaaaaaacucaaaaugcaucaaagaccuacaugaagagcuaaaaccgauaaaaaacuuguaucuagacuauauaaagaacucuuacaacucaacaauaaaaagacaacccacauuaaaaaugggcaaaggaugugaauagacauuuguccaaggaagaucuacuaaugaucaaaaagcccaugaaaagauguuccaagucauuagccaucagggaugugaugacaugcaauacacaaggagauaccacuucacaccuacaaggaugguuauaauuuuuaaaaaacaaauuuuggcaaaaauauggagaaacuggaauccacauacacuccugaugggaauauaaaaugauacaguugcucugaauaauggccuagcaguucuuccaauaguuaaaccuagaguuaccauuugauccagcaaaucuacucccagacauauuuccaagaaaaaugaaaacauguccacauaaaaauugcuaccugaauguuuauagucauauuauucauaauagccaaaauagaaacaacccaaaugaccacugucuuaguucauuuuguguugcuguaacaaaauaccacagacuggguaauuuauaaacaauaguuuauuucacucgugguucugaagcuggaaaguccaagagcauggcaccagcaucugaugagagcccucaugcugugucaucccauggcagaaggaagaagggcaagagacuacacauaagaccaagagcaagagagcaagaggggcccaaacucacuuuuauaacaagcccacucucucaauaacuaacccacucugccaguaacaacauuaacccauucaugagggcucucaugacccaaucacuucuuauuaggcuccaccacccaacacuguugcauuggggauuaaguuuguaacacauaaauuuuggggaacauauuuaaaccacagcaaccaccaauugauaaaucaaucaauaaaauauaauauagccaugugcaacguaacgauguuucagucaacaaggaaccacauauaugacuaugguauggucccaugagauuauaucacuguuuuuuacuguacuuuuucuauguuuagauauacaaauacuuaacagugggcuccaguugccuacaguauucagugcagcaacgugcuguacagguuuguagccuaggagcaaaaggcuauuccauauaaucuaggugugcaguaggcuacaccauguaggcuucuguaagcacacuccaugacacuugcauaaugaagaaacugccuaauaauacauuucucagaacauauccccaucacuaagaagugcaugauuauauaucuaugccauggaauauuauucagccauaaaaaagaaugaaguacugauagaugcuacaacaugaaugauguuucaaaauaugcugacugaaagaaggcagucacaaaagguuacauguuauauaauuccaugcauuugaaaugucuacaacagguaaauccauauagauaguauguagacuagugguugccaggggcugcuaauucuaguaauuaccacucuguuagacucaauuucgguagcaguuuuuaugugggaggaggaacuggggagugacagcuaaagcagggcugcuuuuggaggcaugaaauguucuaaaauugucgugaugguugcacaacucuguauauacuaaaaaucacugagugguacauuuuaaaugggugaauuguuuagcauguaaauuauaucucaauaaaguuguuaauaaaaaauaaaaaagagucacaaaccaaaaucaucccugaaagcacucugaguacugggcagacaauacucccaauucccuaaacagaauccucgagacacacagcuuuuagaucccacaaaaugauuuuucuuuuucuuuuuuuuuuuucuucauuuuucuuuuuagagacagcucugaacacagaaugauuucauaaucagggacauuuuugagacaggagacuucaugguuccaggcuuugagugagguggagaacuccuaaaggacccacccaggagaugacacugccugaacagauaacugucccugucgccucccacuccacucuacagcgacaccccuuccacagcagucagcuguuuuccagguacaagagacaccucaccacccuggccaguuuacagaccagcuuucgagcccagaaauuucccuguaggaaauuuguaaggaccacuggcucauggggaggaaauaaaucaauaaaaggaaaaaaaaaugaauaauacuguuuuuuuaaagagagaauggaaucauccuuuucuuaagaagacagaaagccaaggcauuauauuuaaauaaaaaauuuaaauaauugaaugauuuuaaaagaauucaucuuauuaaaagguagagaccggaaaaaaaaugagaguaagagagagggcaagagaaaggaagaaagaagagacaggagcugggcacaguggugcgccaguaguccaacuaccugggaggccaagguggaagcaucacuugaggccagggauucaagaccagcuugggcaacauagugagaccccccucaccccuaccugacugguaaaaaaugaaaaaaauuaguugggcaugguggcucgugccuguagucccagcuacucaggaggcuaaggagagaggaucacuugagcccaugaguuugagguuacacugagcuauaaucacccacuguacuccagccugggugauacagcaagacccugucucuaaaaaaaagaagagcgaggaagaaauaacaggguuucaaggaacuccgcccugauaagucuuuuuaguuucaugacacaagcagagcagguuacuugugagcuccuccaggccaguacccaggaagcuccaggaagaugacguuggccagggcuggugggcuauggcucccagcugguccuggaacauguggcccugucacugaauccagacgcugagcuccuuaccaugagaaaagaaacgucguccuccuucaucuccaucugcagccgcucgaucucaugugccagcaccuccgucuccucugugagcugcuucaucuucucgucggccagaaguugcuucugccuugucuccucggccauggcauccagaauggccugcuccuccacucucaagaacucgcgaagcuuaucaaacuccugccggauccggccuuccagccaugcagccuccaccuacggaagacagcaggaggagucaggggucagauguggagaggacauccauagcccagcaacuuucccauuuuuagcaaaggaaauuuauguucaaauaaaucauguauagaaccccuacagauaaaauaucaacauaauaguuuauaagcacaaauuucuaaguuccgauuucaaaugggaaaguccaacaaccuaauauuagauuguuuugacaggguuuuuaaaaauaaaaucacagcuuauauagauggcaacuguaguacuauaaccucaucuacauacaauguucaguuccuucuuuagguugcaccauaacaagggaaguccugaaucauagaaaugaauggcugcgaauagcaaugauuuuuuuuuaaguauuuaccuuccaaucuuaggacuuaaaauuugucugauccagaggcuuuaccaaaagagcaguaggaagcauucauuuuaaaacaaucauuaaaauaauauacacacuccaaaucacaaccacaaaaaguuuguuuuuuuuuuucuuuuugagacuaagucucgcucuuucaccuaggcuggagugcaguggugugaucuuggcucacugcaaccucugccuccuggguucaagcaauuuucccugccucagccucccgaguagcugggacuacaggcacacgccaccacgcccagcuaauuuuuguauuuuuuaguagagaugggguuuugccacguuggucaggcuggucucaaacuccugacuuaaggugaucugcccgccucggccucccaaagugcugggauuacaagcgugagccacugugcccagccucacaaaaaguuuuuuaaaagggaagauaaaaccauaaauguaaugaaagaaaaagcaaauaaauauuucucagcuuggaauaagaaagacauuccucggcacaguaugaaacugagaagccuugaagaaagaaugagauaacugaauacacagaaaaauaagagguguguauggcaagagacuaucauaaaguuaaagacaaaaauacaauuccaugacaacuguuggaaaaaccauucaaaaugugugcuguggcaauggcagguuaguaaacucaucuuuggacugaaaguuaaauacagaugcuccucaaguuaugaugggguuacaucccaauaaacccaucauaaguugaaaaauaguuaagucaaagcaaugaauacaccuaaccuacuaaaaacaucauagguuagccuagccuaccuuaaacgugcccaggacacucacauuagccuacacuugggcagaaucauccaacacaaagccuaugucauaauaaagcacugagugucucauguaauuuauugaauacuguacugaaggggaaaaacagaaugguuguauggguacucaaaguacaguuucuacugaaugcauauugcuuucguaccacaguaaagucaaaaaaucauaagccagggacuguguguauguuuacagcucugaaaauauacgaaaaggauucacugaaaaaaugaaaauggccaaaaaaauugagaaugauccacucaaaaagaaaugacaaacuaggaaauauauuugcaacauuuaugacaaauggcuauuauuauuaauguacaaagcacucuuacaaauccacuaagagaaaagacaaauauuccaagggaaaaaaagaaugugaauuagcauucacagaagaagcauaaaugacuauuaugcuugugaaaagauguacaaacuuaccaauaaucaaagaaaugcaaaugaggacaaacagcaugguuaaccuaucaggcugaaaagacugauaaugucugcauuggagagaguagaauccagggugauucucuuuuuuuuuuuuuuuuuuuacauuuaaguuccaggauacaugugcaggacaugcagguuuguuacauagguaaaugugcgccaugguggucugcugcaccugucaacccaucaccuaggcauuaagccccgcaugcauuagcuauuuauccugaugcucucccucuccccaguaauucuuaucacacaaaaacaucaagaacacagcauggcaggaaaaaccagcaagugcaaggucaacuccugcccacucaccgugggcaaugacggccucacuguaaaggaacaaacaccagaacuuucacuuuccucaucgaccugauaacugaauuuaauagaaaaaguacuaaucaggcuggaauucuaggggcuucccaugugaccucauuacccuuagccucagcaaaaagcucaggacuccuacacucccugggaugggcaggcagugccaccacacagacagacagauacucccuaaguauccccaacccaguccuguacaaggcaagccagucauauggcuuuagccacagaaggaaaccaaguaagagaacaaugauaaagcuacaugacuccacgaugacuacuggaaaaacaacucaacaaacuccagcaacagcagguucguaaucgcuauuuggaguuggaauuucaacauguauuuauggcucugacaucggaugacaaaauaaucuacugaacaaagugaaaacucucucccaccaguuuguuggucuauuagacaucagaaauguuaaggacuugucucuguugggcacuuguaugcauuaucuuaucuaaauuuuuuuuuaaaaacccuaguaaaagggaauugcccucuuuuuacagaggaggggauuagcuuggaggggguugagggauuugcuggggaacugggcuuagauuuggaaauaggucugcuuugcgguuacugcccuggcacccagugugucacauaauccuuucuuccacacuguuccaccagcucuguggcucaggguaaacuccacagccaaauguuaaugaggcucuuuccugggacuaauccucaccuauggacacaugguggaggggaccgcaggcuccugaggacagcgcccagcaaccuggaccaggcauggcucagcuguggcuaagaugagucuaacagagugguaauuacuagaagcaaccacuucagaaagccaaagaccagagccaagaucaacagucagaaacaagguugccaauccacacaggaccuggaggaagagagggugccaggcagaacaaccagaauggggacagagggagcccacucauucauuugauuaacaguuauuggucaccuacccacuucacucauucaaucaacaauuuuuauuggucaccuauugugugccaagaacuccucuagauaacuggcaauagugugcccuguuuucauuauauuuugacaggaagggauaaaaagcaaauagaaaacaaaagguaauuacagguaaugaagugucauuaagaaaauaaaccaggaaauuaugccaucgaguaaaagaggaggaugaucaggaaaagcuucuuuaagagaacaucugagcugagauuuuaauggcaaagaugcugggcauguguucuggggagaagacuuaguuugcuuaagggacagaaagaaggugaggcagagaaguaaaugagguugaggauaggcagggucaggagauggccuuggaggccaugguaaggaaucugggugguacugagggugacuggaagccacuggcaguuuuaagcagaggaggggcacggcugguguuuuuuucuaaacgaucaccccaguccauggaaaggagaaugcacaagaaugaaagcaugaggcccuaggcaggaggcccagugagagaugaugaugaccuggaccaaaagguggaggguuuuacagaaauaacauacuuuggagauaggggaauaggauugcugauggaguggaugugggaacugaaagaaaacaagaaaguacaugagucccaggucaucauugaacacacagguggcagugauaugaugcaugugccauagugcagaugguguugguagcuuuuuaagucacuccuguggcugcuggcaugaccacgccugggucuuuagaggggccaaggcagagaagccacagucagcauccaggacguggcugcacaggaccaucagagguaaggcagccgaccucuacccagcggguuaugugagccaaagccacggcugacacaucuucacuccuccccagacugcccugaguggacccaaucuucccacuuggccccaucguucgcucaccugauugugcuuggcgauggccucauaggagcgccgcauggcccagaaggccuuggccuucucccgcagugcaugcuccauguuccugcacuuggccugacaugggaaugagagagagggaggaagacagguuagggcuggaggcugggcagagagggcagacacaucacauuuacaacugggacuccacuucaacacaaguguaacucaacugcauuugccuaaccccauccaugccaagugcucugggcacaaaugguaaguaagguccugauccugaaucagacauccaugggauaaagagcccucagacauccuguagcccagccugguacagacugggagauggggcugagaagaagcaagcugcucucucucauguuggucacagcacaggccagaagagugucccaugugggccaaaagcugguucaugcugggucugaaucccugagcuguguggacaacugcagacaguguggucauagguucccucugcaguuuccuaaacugaaugggucugcaaucucuaaugugaggugacugacaauggggguggagccagucauuucccacgggguucaguuaccucccaugaggccucaccucaacaugcccaacaugccccuccauaccccuccugcauccugacauucuaacacugcuuguaucgcacggaauacuuuaaucagcaggcacaaauacuuuugguuuaguaguuuuuguuucuuaaacuuuaaugauuguuucugauguccuuggacaacuugaagaaccacuagaguguuuuagguuggauuccugccucuuguaucuuaggccuaucauuuuuucucccucauuauccuuuucgaucuacauucucagaaagcuucucaaguuuuuucuuaagaaaaauaauucaaauaauuauaaaugguuaucauuuauucaguacuuacucugugccagggacaacaccaauuacuugagaaauuaugucauuuaaucauuacuucucccuaguagauaaguaauauuauuggccccauuuauagaugagaaagugaggcacagaagggaaaugaccagcccaagggcacacagcuaguauguggaaggacgugaaccuggacagcuauggaggcagcugcugagacagcacccagugaucccucccuccugugagaugagaguguuuuaagcugcuaaaugucggggugacuggauaugcagcaauaaauuauacagaugugucgcccaaagccucauucccaucuggaccugauuuagaugacaaaucuggacuuugggcugaugcuguaaagggaugagauguuuggagagcuugggagagggccagugcauuuugcaugugggagggacaugacuccuuauggggcaaaggacagauucaggcaggcagccucuaaaguggccccagugacccucaccuccugauacucaugcucuugugaaauccccuccucugugggugacuuguuucuaaccaaaagaauguggcaagugauacuaagucaccucugagguuaggcgacaaaggcuguguacacccugccuuccucucucuagcuugcucacugggaugguagccagcugcccaugugguaauuugcccugggagugacugcuggggcaagaaacugagaguggcuucugaccuacagccagugagggacucaggcucucaggcuaacagcccgugaagaccugaauccugccaacaacuacaaaugugaguguaaauaaggauccugcccuagcugagccuucagaugagaccacagcuccauaccuacagccccucaugacagaccuugaggcagaggcacccagagcuaaggcaggcccaauuccugacccacagaaacucaaagauaauaaauguuuguuuuaaggcacuaaguuuugggcaauuugcuaggaaauagagaacuagcccauugguuagaacuagcccacagaacccugacugcagccccucaugagacaccuugaggcagaggcacccagagcuaaggcaggcccaauuccugacccaaagaaacucaaagauaauuaauguuuguuuuaaggcacuaaguuuuggggcaauuugcuaggaaauagagaacuagcccauuugucccacucaguagcccauuccuuuaagucuuucacuacagaaaacaaaaugguuacugauuucauuuucugcaguucuguuuuauuuucaacucauuuugaucuuuuaaucuuaagugacaauauuuaagauuuuuaaacuuuguuuucuguaguauaucaucucuaauuugcaugagugcccccacaaaaccacugaaaugucauuccaauguuuuauuuuauagaaugagauuuuugauacaaaaucauguaauacaguucaaaaggaaaauuuagugauuugccaaauuaguuaagugacaggagugaagcagcuguccauacgcauuacccaaaggugugcaggccccaaaacaacacaguucagccccugcccuucaacccuggcccuuaggaauuuaugggacaauaaggaugggaaggggauagucccuugaucuucucaaacuuuucaaucacuuggagaguucugguuuccuucagaaaagaccaauccuaaaauggcccuucucugagaugucagcugaugagacuaaccaacaauuauauuacuauugcuagcaagcaguuacuauuaagcauguacuagacacaaggcacuaaauuaugcacuuuacaaacauucuauuuaauucaauuauuuaauucgaauucucccuauaagguuaagcacugugagucccauuauacagaggaucaaguuagacccagaggagguaaccuucuuguacaugucuccuggggacacaugggaacucguuucuucauaauauauuccuggggauaaaacugcugggccaccauaugugucuucacuuuacugcguaaugccaaauuguuuuccaaagcagugguaccaauuuuuacagcaagagcaauguuaauagaaaauguuuauugaccacuucaauguuuauuuuuaaguacucaguaaaguauuguccauuuuuccauugcguugccugccauuuuccuaacugguuugugggaauuuauuauauauacacaauguauguccuugauuaguuagagguguaaugaauauuuucuacuucaucauuuaucuuucuuaauugaaauauggccaaauuuauuagucuuuuccuuuaggauuaguauacuaguuuuaagaaacaccucccuacacugagaucacaaaaacaaucguauuauuuccucaaagcuuuauagcuuugcauuauuauuguauagcucuguaguauuuucucaaagcuuuauagcuuuccuuucacauuuaggucugauguggauaccuggaguuuauuuuugcacauggugugaccagguagcucauugucucagcaccauuauuuaaaaagaccauuacugcccacuggucugcagagccaccucugucuuaaaucagacacagaucuguuuuuugguucucuccaucuguuucucuggcccaucuguuuauccuugugccaacaucacacagccauaauuucuauagcuguaaaaaagagaggauuucugauagguuucucuucaagaaugucuuggcaauuuuuggcccuuugagggucauauaaauuuuagaaucugugaaguugcauaaaaauaaucauguugagauuuagauuaguacaauauugucucuauagaucaauuuggggaaaacugaaaggcuuaaauacugacuuuacuaauccacgaacauaauauaucacaccaguuacuuaauguucuuugauagcucucaacgaaguauauuuuucccuaucagaguuuugcguaucuuuuauuaauuucuuccuaguuaucuuauuuuuuauauuauuguaaacauauuuuuaaauuaaaaaaacccaaaacagggucccccucugucacccaggcugcagugcaguaguagcacaaucauagcucacugcagccuccugugcucaagugauccucccaccaccucagccucccaaguagcugggacuacaagcaugcaccaccacaccuggcuaauuuguuuuaacuuuuuguagagacaggcuggacuauguugugcaagcuggucugaaacuccuuggcucaaacgauccuccugccucagccucccaaagugcugggauuacagguguaaaacucccugccuauauuuuauuuucuauuugcuagugauacauagaaauacaacugguuuugcaucuugauuuuggauucagcauucaccuaaacuuauuaauacuuaugauuuaacuguagaaucuuuauuuucuacacauagaaaucucagugcaaaaauaugcaaccauauuaucuacacaugccaguuuugcuucccuucuuuccaaaccuuacaucuuuuauuuauaauuauuggcuuacuucauugacaaggcuaucccacacaaaacugaauagaguuggucauaaugcgcauuccugucuuuuucuugaucucaauaagaaagcuuucaauguuuugccauuaaaugugauauuugcuguaaguuuuuuugcuagauauacuuaaucaaacuaaugaaauuccuuccauuucuaguuuccuguuuuuuuaaacacaaaaagaugguaaauuuuaucaaauguuuucucacugagauaauuauauuaagcaacacagaauuagguuucguuuucuuauccagucagaucaacauuuucauuuaacuggaguauuuaacacauaauuaccgauauguuugcauuuaaaucugccaccuuguucugagcuauuugucuugcuuauucuauuuuucuuuuucuuccuuuccuuuuuuaaaauuuacuacacauuuuuuauuccauuuuccccuucugugcaucuagugguucaccuaggaaauaugacauguaagaagugugaauuugaaugcaucuaaacaauauuauuuuguuugcuuuugguauuaauuuuaacccuaaauaugcuuagauuacaaauagaacuaccacucaaggggccugccuguagcccaaggagcacaugaaugagcagagaugggcaguagcaggggcccacaacagaucuggagcaucccccagcccaagcucaggagagcaaacaagcuucgauguuagcaucacauuauaacauuaagauuuuuuauuuauuuauuuuauauuuuuuacuuuuuugagauagagucucauucuucuuguccaggcuagagugcaguggcgcaaucucggcucacugcaaccucugucucccagauucaagcaauucucuugccucagccucccaaguagcuaggauuacaagugccugccgccaugcccaacuaauuuuuguauuuuuaguagagacaggguuucaccauguuggccaggcuggucuugaacuccugaucucaggugauccgcccgccucggcaucccaaaaugcugggauuacaggcaugagccaccgcguccagccuacguuaaagauuaguuauaaacacacacaaaauagguuuuuauucauacuaaaggauccagaaugugaucauauagacuacaugauuucccaaaaaugacaaguugauuccuuaagcaacaaauuucaauugcauauugaagaucuuaagcacuuuacaaaaucacguuacccacaauuuucauuaacaggacaggugcucugugguauagcuggaagcaggaagguaggggcaagggaaagaaugaauuucauugcacaaggucuucauagccucuuugcaaggacuuaccaaagugcuagaguugcaugugaaaccagcucugucuggccugagccagguuuucugucuugugagacuugauacacacuguugcucugccugguucccaccugcuucccccaacuaacccaacaucaccuugaaaacucggcucuaguaccccucauuuccuccaggaagccccccgaucuugccagcucagguuccauuccagggcaucacagcacccuggccaccucugucucagcacucacuauccaggguaauagcuucucuuuccugagggcaggucuuaaccuccagguccucucuaccuugcauaguggugcucgguacacuucugcagaaggaaugcuugcucugcaaggugagagacuuuguuuuguccccugcauguccaagucccugcacaaaguagauguucaguuaaccaccugcccagucaaugaguacauggaaugccuguguuuuuucugcuauauaccuugccuccuggacugaagguuaggagagcugguuuggagccuugucuuugucacuauccacuggugaguugguaaaaaguuccuucucucuucggcuaucaggcuccucaccuuaaaaaugaaagcagagaagucucuacagucucccaaauuucacgauuuguuuucaggcagauugauguagcagccaagaguucuggcaccuggccgaccagguucaaaucccagcaccucuaccuaguagcaggugaucuugaacauguuccuucacuucucugcaccuccauuuccucaucuggauaagagggauaaaaaauacuaccaagcucaaaggacugcugugaggacuccacaaaucaaucccuauaagaugcuuacaugagaguggcaggcacaugcugugcauucggcauagcucuuaagugccaccuacaugccagguaaccuaacuguccugcuggauaugguccagguuucuuaaaugaacaguaaaaaugcauggagcuuucuuaugcaacuccaaaucagucucccagaucugucuuuccccuuuguguucagaccuccuuccaaagcaagugucugccaugcagcccacugcuggaggccaucacucaggagccucagugugcagggucuagugagacaccccccacucccaauaccacugggcacaggccuggacaagcaagcaagcaacaauguccucuggugcaaccaaagagcugguaaguccucaccuagaagcuggggaucaggaugggggugagugguuaggaaauggggaaaagcauuggaagggggaagaccuggaauguggcuuaagagguaucgagaguacccuuggguuagauccagccagauggacucuaagauguugacgccagaaggggagagagggcuggagcugggacagggagaggcugguggcaaagaauggucaucaugccaguccugcaagauggauaagacaagggucugcacaaggcagcucagcacagggcugcuguagaagaugcaagcuggagagugcuggacugggaggcaggaaaccugaguucugauccuagaacuuuauuuauuuauuuauguaagauacagggucucacacuguugcccaggcuggaugcaguggcccagucauagcucacugcacccucgaaugccuggccucaagcaauccucccaucucagccccucgaguagcugggacuacagguaugugccaccacacccggcuaauuuuuuucuucuuuggugcaggaucuugaacuacuggccucaagcaauccuccugccucagccuccccaagcacugggauuacaggcaugaaacacacuggccuugauccacuucucauuacuuagauguaaccaccuccucacaagauguaaccauuccaucacaauagaaugacgcacggucugugucugaggauguuuucauuuaauggcaaccuaaaccaaaccuaagacaauccuacuccaagccacgacauaaacagcgcugacacaugcuuucaguucacaacuucaucaucagcauucguauuuucuuuuuuucuuucuuuuuuuuuuuuuugagacagugucuugcucugucguacaggcuggagggcaguggcacgaucucggcucacugcaaccuccaucucccggguuuaagcgauucuccugccucagccucccaaguagcugggacuacagguaccugccaccaugccugguuaauuuuugcauuuuuaguagagaugggguuucaccauacuggccaggcuggucucgaacuccugaccucgugaucugccugccucggccucccaaagugcugggauuacaggcaugagccaccacacccggccaccauucauauuuucuuaacagcuuacuugauaucaagacaugacuuucaucgucuuguccugauaaggaaagaagagaaauacacauagcagguaaagaaugugccggacccaaaugaaggccaaucccguaacaagaaagcuccagagcucuucagagaaauuugggcggauuaaguagucacuuggaacagaguaaugggagaaucagaaguaucuuggccaggaguagagauuuuguuccagcaaaauaaaacuuuagaauuaauauuuuaaguggaauguuauugauuauaguuuuguauucagucuguucacuuccuuuuguuuuauugcuuauauguagcaugagcaagugcuauuuauaccagguuugcauuuguaugcauguaaauaauaacauaauuuaacucucacuggcuagacuauuuuuuccuuuaagaagaaugcauacuuguucaaguuugagaaacgccagacuaggauuucugaagguccuuccaagcacuguuccuugcuacagcucugcuguaaacaugaugccaggcucccaaaucucaucaguccuuccaucaugcgccacugcaccuacgauaaaaaucccagcuccuaagcagggcccucuguguccugugggaucuguccugcaguuccucauccccacgugaaccaucucucagucacugcacacccccacgcugugccccgccgccacacccccgccacacacacacacugcucgccgccccucaaucagcuccucucagcgaaaucacuuccuuggagacuccuucccacaccccaccaaacaagagcagccucccccuuacaaucucccaccacauccuguacuguccuucacaggaauguugagcugaaacuauguaauuauuagugagaugauacaaccaugcccacaaaggcaaggucuaggacuguccgguccuguccuggacacaguacuggcacacaaccaguaccuucugccagcccugacaauggucaacagccacuccaaccccuaacacacagucagcugcccgcugaagucugagaugagagaaaccucucucaaaguccaggaccagugugugaacugaacaaggcuccaggugaucuuuagagcuacuugcucugugacuuuggacaaguuucuuacccucucuaugauucuauaauugucuauaaaauggggauaauagcaccuaacuguagcaagcugaauaauuauuuccccgaaaagauguccccauucuaauccccagaaucuuguauggcaaaagggacugugcagaugauuaaauuaaggaucuugcuguggggagguuauccuggauuaccugggugggcccaaugucaucacaggguccuuaugagagggagguaguagaacuggucaaagaagucaaagugacaacagaugcagaacggaaugacacacuucagagcuggaagaaggggccucugcaagcuggagaaggcaaggaaauaaauucucccuggagccuccaaaaggaauguagcccugcagacaccucgauuuuaggacuuccaaccuccagaaccauaagagaacaaacuugugcuauuuuaaaccaccacauuuauuacgcaguaacaggaaacacaggaccugaaaauacguuuuugugagcauuaaauuuguugacgugugaacacugaaaagcaucuagcacacagugagcacugaaauguguuagcugggaugauuuugacuuugcuguuccucacauagauaguuggcaaaguaaucuuucucuaaaacacacaucccaucacaaacuccccuguuuagaaucuuucagagcuccccacagcacaaaacggaaaacccccucagugaggcacacagcuucuuacccagucccuucuuaccaagugguggagggaaucuucccauaccgcucccccacaaccaccuaccuugaaucacacagaacuacaucuugucuauugacugucuaugcccccugcucaaaugagaauuccaugaagcuaagaagaggccacagcacacaacagccaucaguacccauuugucuaguaaaugagugauuugcacccugcaucaggcugaccacaccuggcucucauucuucucagauccauuugggacuagacuacucagccccugacaucauccugaguguccacugacuugacaccaucauucuucugcuaaaacccccagcugcuguucacagcaagggugagccaccggccuccuggauccuccugcacgucccuccucauucuaacuacccuuaaauucccucagugccuagaaagucaggcuuucccacuucuggacccuuccaaaugcugcugccucuaucugaaauacccucuuucaccuggcuaacaccuccucuucccucgggucucugcuggaagcuccuugaggcuggaaauggucuaucuugucuccugcaguaucccugggaccuugcaguaccaggcaucugcuggugcauggcucucugcucuugaauccuggcuuggccccagccugggggcucugccuggguguucucagcccugaccccagcaucuccugaucagcaccucggccagccaaauaggcaucagucaugaccugaaccaugaucccuccuuuaccugggccccagaccccuggcuggccagcacuuauuccagcugucccaaaucaggaucugucacuucugccaguggaaacaggaaaagcauugacauggacccauguuaaacaaaaaagaugacaggaguaacaggguuacucauugagacaugcguacugacagcauccuuacauuccccuucaauuaaacuuugucaaaugcauuuggagcggaacagacuuccguauuuaaaaagguauugcaaaaaaagaaggcagggccacagagggggccagaaaccaggcacaggggacucgggcagcuccuccucuccaguccaugcagcuucgggccagcuacccaguguucucccaauuggggcucugacucaugcauuagcaggugaugaaauaaauucaauguuucacauucuggguaauuuuuaaaaguaacagaggccaggcggaguggcucacgccuguaaucccaguaguuugggaggcagaggagggcagaucacuugaggccaggaguuccagaccagccuggccaacauggugaaacccugccucuacuagaaauuaaaaaaaaaaaaaaauuagccaggcguguugguacaugccuguaaucucagcuacucgggaggcugaggcaccagaaucgcuugaacccaggaggcggagguugcagugagcuaagagcacgccacugcacucuaaccugggcgauagaggucucaaaaaaaaaaaaaaacaaagggaaguaacagaaaauaucagagugccauggacauguucagaaaacuuuuguuucaacugauacauauguucugggucacaagggaaaaugcauugcuuccuaugggcuaagauuaaacguuuuggaaaaugcugaguuaggcuaacccuuaucuucuauucauuuuuccuuccuauaucaaagaauucuccauguuaguuuugcccuguaaguugcuccuggguuuauguauagucacuagaacucuagauauggagaugcugcuuuauaaaccagaauaggccagccagccagggucagagaccucucacucagauaauacaaaccgcgggaucagcuuggcaaguaggugacugguuugggggaaaucuuaagacuccacaccccuggccaggucuguggcuccuccuccacuucuaaauugagugugccaagcuacagggcucgugggcugcacccacauccgugccgcuuaaagggaccugggccacacccggcuggcacaaggggugcauggccugggcccuucagaagcaagugucgcugucuugggaacaucauguaaccucaucugucacuuuccguucgcauucucuucucccagcacgggccccugggccgaccuugaagaagcagccagcccugagaaccugggucggagaggugggguccugcaugcugggagcgagacgcgggcacacugggcucuggcaggcaggaggggcgggagccgcagagccaagggauuccggguuccagacccggcucggccgccucgugcaaaucgcugcucuuacccgaaagucgugggcaguguccuucaccggcugcacgcggugccccuggugucgggggucggccuggcaggagcagcacagcagcuccuuguccucgaggcagaagaggcugagcuguccgcggugcaggcggcagacacgcgagaagcgguagcugguccagcgcgcgcccucggccuccucgcgcagcagcuucuccaccagguuguugagggugugguuggugcgcaggucggcgggugacgcgcggucuuugcacacugggcaggugggcgacaccugcaccucccagcagcggcucacgcacccgcggcagaaguuguggccgcagcgcagagugacugcgucgcggaaggggucguagcagacggcgcagagcaacuccuccuugaaggagcgggaaggcccgggggacacgucgggacuccgcuccauggcacgagcagccggcucgggcgcccggaacuuuugcuccggccccucccacccgcccggcugccaacgcccgcgacccgagugcugggaaucgcccagucccuuccccuggaacgcugagagaca

SEQ ID NO: 21521 - RNA, 142815 nt, Homo sapiens
gcuagaggggaaagugaauggcgaaggacugaagggauccccccuucggguccccggccgcccuguucacccucguucauccuccuuuccgaagcucgcucucgaaggcaggagcgaccggcgccuuuggcugaggaggaggagaaggaggaaucgcgccaggcggagcgucaggucccguuuuccucuccggcgucuccaauacaaagauuacggugcagaaggaaauugcacucgucuccuccgcgcccccgguacccaacacaaugcaccagccgccugaguccaccgccgcggccgccgccgcugcagacauuagcgcuaggaagauggcgcacccggcaauguucccucgaaggggcagcgguaguggcagcgccucugcucucaaugcagcagguaccggcgucgguaguaaugccacaucuuccgaggauuuuccgccuccgucgcugcuucagccgccgcccccugcagcaucuucuacgucgggaccacagccuccgccuccacaaagccugaaccuccuuucgcaggcucagcugcaggcacagccucuugcgccaggcggaacucaaaugaaaaagaaaaguggcuuccagauaacuagcguuacuccugcucagaucuccgcuaguaucagcucuaacaacaguauagcagaggacacugagagcuaugaugaucuggaugaaucucacacggaagaucucucuucuucggagauccuugaugugucacuuuccagggcuacugacuuaggggagcccgaacgcagcuccucagaagagacccuaaauaacuuccaggaagccgagacaccuggggcagucucucccaaccagccccaccuuccucagccucauuugccucaccuuccacaacagaauguugugaucaaugggaaugcucauccacaccaccuccaucaccaccaucagauucaucaugggcaccaccuccaacauggucaccaccauccaucucauguugcuguggccagugcauccauuacuggugggccacccucaagcccaguaucuagaaaacucucuacaacuggaagcucugacaguaucacaccaguugcaccaacuucugcuguaucauccagugguucaccugcaucuguaaugacuaauaugcgugcuccaaguacuacagguggaauagguauaaauucuguuacuggcacuaguacaguaaauaauguuaacauuacugcuguggguaguuuuaauccuaaugugacaagcagcaugcuugguaauguuaauauaaguacaagcaauauuccuagugcugcuggugugaguguugggccuggaguuaccagugguguuaaugugaauaucuugaguggcaugggcaaugguacuauuucuuccucugcugcuguuagcaguguuccuaaugcagcugcagggaugacugggggaucgguuucaagucagcagcaacaaccaacaguuaacacuucgagguucagaguugugaaguuagauucuaguucugagcccuuuaaaaaagguagauggacuugcacugaguucuaugaaaaagaaaaugcuguaccugcuacagaaggugugcugauaaauaaagugguggagacuguaaagcaaaauccgauagaagugacuucugaaagggagagcacuagugggaguucagugagcaguagugucagcacacugagucacuauacagagagugugggaaguggagagaugggagccccuacugugguggugcagcagcagcagcagcaacaacaacaacaacagcaacaaccagcucuccaaggugugacccuccaacagauggauuuugguagcacugguccacagaguauuccagcaguuaguauaccacagaguauuucucagucacagaucucacaaguacaauuacagucucaagaacugagcuaucagcaaaagcaaggucuucagccaguaccucugcaagccacuaugagugcugcaacugguauccagccaucgccuguaaaugugguugguguaacuucagcuuuaggucagcagccuuccauuuccaguuuggcucaaccccagcuaccauauucucaggcggcuccuccagugcaaacuccccuuccaggggcaccaccaccccaacaguuacaguauggacaacagcaaccaaugguuucuacacagauggccccaggccaugucaaaucagugacucaaaauccugcuucagaguauguacaacagcagccaauucuucaaacagcaauguccuccggacagcccaguucugcaggaguaggagcaggaacaacagugauuccuguggcucagccacaggguauccagcugccagugcagcccacagcagucccagcacaaccugcaggggcaucuguccagccuguuggccaggcuccggcagcagugucugcuguaccuacuggcagucagauugcaaauauuggucagcaagcaaacauaccuacugcagugcagcagcccucuacccagguuccaccuucaguuauucagcagggugcuccuccaucuucgcaagugguuccaccugcucaaacugggauuauucaucagggaguucaaacuagugcuccaagccuuccucaacaauugguuauugcaucccaaaguuccuuguuaacugugccuccccagccacaaggaguagaaccaguagcucaaggaauuguuucacagcaguugccugcaguuaguucuuugcccucugcuaguaguauuucuguuacaagucagguuaguucaacugguccuucuggaaugccuucugccccaacaaacuugguuccaccacaaaauauagcacaaaccccugcuacccaaaaugguaauuugguucaaaguguuagucaaccucccuugauagcaacuaauacaaauuugccuuuggcacaacagauaccacuaaguucuacccaguucuccgcacaaucauuagcucaggcaauuggaagccaaauugaagaugccaggcgugcagcggagcccuccuuaguuggcuuaccucagacuaucaguggugacagugggggaaugucagcaguuucagaugggaguagcagcagccuagcagccucugcuucucuuuucccguugaaggugcuaccgcugacgacaccccugguggauggcgaggaugagagguaagaucaugucauauuucuggagacauucaacagauuugaaguuaaucuauuuaguagcuauauguaugcacaaaaugacucuaaaacauuguauauuguguuuuguaugugaaaaaugcauuuuuaugggaaguuuuauagagcaagaguuauggaaugguuucagagggaguaggaaauaauaguaauauguaaacaauauuuucagaauaguuguugagcauguguucacauuaaaaacagguuugggggcgccaagugguuuuauuaucucuaaaaugcuuuuuagaaauauuauggaaagcuuaauuuuugcuaacccacauaauaguuaaucuauuuugagcugcuaaaauaaucucuugggggguugugguucccacguuuguucuccuuuacuagacaucccuuuuucauuucuacuguguuugaucuuagucugugaaagauauuguugccuacuuuuccuagucagauaugguaggaaagaugacuuaaucuggguuauauagguugcccucauacuccaacugaccaacuuuugcguacuuauuuaauggucauuuuaucugaacaguaaaggaaugggaaucuuauuuugugggaaaggaggacauaaacuaucaaaauaaccagacuuaucuugauaguaugcugaacauuuuuucuuuugcaugguagaucaaggugguagccauuuuaaagaacagagaaaguaagucuuggaggauugaauuuauagaggcgugaaaauaagaccuuggucucuggcuaaucuacuccaccuguuccuuucuuuccuuaccaaaaagauacagaaagccuaaaguacauuauuaaaccaagcguuuuuucacguagauuggaaauaauaugccaguaacgcuuauugaaucaaauugugucuuugaagcugacuggcuaaaaaaguugugaaaucuuucauguugauuuuuaaaguaauguucuuuucacaaauuuuccagucuguuacuaaccuugauuaaaaugcuauuauaggaguuaugaaaagacaucauuuucacgguggaauuuggaguaagcgugcaagauauuuaauuauuuuaguauuaguuggaggguuuugugauugaacuuucaucaagcgaauuuaagcauuuauauucuauauguauguuuguggguuuugcuuuggaaaaauugagcauauugcaaaauaguuguaauuuuagaaaaagaaaacaggucaaauguuucagugagguuuguguuauuuaguuguuuaaaagguaagauaaagacaugguuaaauugauaaaaucuuaucuuucaagauuuuuauuauuuuucuaauagucagguaauuaaaaccuuguuaccuaaccaaauguauucuguauuauuuguacaaaacuguacucuaaaagauaaacuuuuaggagguaguuuccuuaauuguuccauuauuauuguuaaaccuuuaauuuuaucaugcuaauacucaacuaauuuuaaaagaauuaccacaaauauuaauguuuuuuaagucaaaagguuaugauuugagugaagccucuauaaaaacagcuauauuauguggaugcuaaguuuagagaaacaaaagacggguaaaauacacaaacaaaaacacucauuuugaauucaaacuugccaugauuuuguaauugccauuuguggucuccuggcuugacuuucaccucuuuuuccuccuauugguaggacaugauaggauuuuccacagcuugcccuuccaggcaauuaaagucagaugaugcuacuuucaacuagaguuuuaacuauaggaauagggucccaguuuaagauauuaauauaaaauuaauuuuuccagauaauaauugagaaaaggaauaauaagguggaaauuauggaauucuagaaagggacaaaaagacauacugagaaauaaggaaauauagcucuaauacaaguugucuucagacacuguacacauucaauuauaauuauguuuagcagucucucccacaagaccaggaguuccucaagagcagggacuguuuugaauuuacuaccuauuugggccuugguuaguuaacaucaaaguuucgugauuaaaaaccagaaaauuuuuguuuuagcgguaucuuaaauucugugaaaucggaauguagcccuaaaacaccuuguaagaucagaaaagauauauauuauauucuuuauuguguuuuacugaagauuauuuaucacuacaguuuggaaaaaaguuaauuuucauuuaaauuugcccuuggaagauaauuuaagaauaacuacaagagaaaacagugauaugauuaaaaaacaaacuuuuaaaaccuuucuucccaugguagcuucuguugucacuugcaucuucugggcuuggucaccauuagucucaggagagagggaauacauauauaauuucaauauuaugaaucaggaaauguguuaacaauauaauuugggcaguaggacagaugaggaugguuaucuuuuaaucaucuuuugaaauaauacucuuaacacuuuagauuauaaaauguuuagacauguggaaagugccuucaguugaucacugggagagacuauaaacauggaucaggaugcuaagauuauguaucuuguuuuaaaaaaaaucauucuuauuuaaaaggucuuaaugucaggccgugugcgguggcucacaccuguaaucccagcacuuugggaggcugaggugggcagauugcuugagcccagaaauuugagaccagccugggcaacauggcaaaacccugucucuacaaaaaaauacaaaaauuagccaggcaugguggcgcaugccuguaguuccagcuaccuggaaggcugaggugguaggauccccugagcccuggaggucaaggcugcagugagcugggaucaugccacugcacuccagccuggguggcagaccaggacccugucucuaaaaaaaaaaaaaaaaaaagucuuaaugucuuagacuguaacaugaacugugaauucaccuuuacaagaaugggaaaauacagguauugcaucuuuuauguuuugugauuguuauuagcacagccucuuaacgugaaaugggucaaacuucuauucauccuucaagacucagcucagauguucucuuuaaagcauucuuuucacucaggggacauuguuuccuuagcacuuuuuaauauuccucuauuuaagcacuguacacauucaauuauaauuauguuuaccaaucuuucccacaagacuagauguuccucaagggcagggaugaauuauuuuuuugaauuaauuagcaggcauuucuccugauuuuuuuuuugucaugauuuaaaguuuauauugucccucaucuuaagcacaauugugagagaugcaggaucauauaauuuaugcaacaaauggaaaagaacugaauaaaaagacuugcuuuuuuguaucucucaucaacauuuuuaggugaauugauguaugucugcaaaguacauugccuguuuuauaguagguccucaaauauuuaagacgcauguguguuaccuauaaaauaggaguaauacucauuuugccugcuucucaggauagcaguaguaucaguuaaaauacuuuguuaacuaaaauacgaaauuauaauuuuuaaaguuuuuuuuucaagauguacaugcacaguuuaaagauaguuuaaaugguuuuccaagaaauaaauggaagagcuuccugcacccuuacuuuccaguuuuccuuuccuagaaacaaucacuuucaccucuuuuagaugauuauugugguauuuaccucccagucucuaaauaacuugcuugucuuaccacuagauauguaauauagccugcucguuaggagcauggacuguggaguuagauugccuagauuugaucuuucuugucauuuacuaguuuuauguaacaucgggcuauuuauccucuuuaugguucaaucuucucauuaaaaaaaugaugacaauaguaguuaccucauuggguugauauaagaauuaaaugaauuuggaaauucccuagaacuuugucuaacucacaugcccuauguagguauuuguuaaauaaaauacaccuuucauuucuuuuugucuguauuaacuuccuggauagaaaaugaagauuuaauuuuguuguuaccauauaccuaccuggucuccuuuuuucccaguacccuuccucccaguaguuaucaauauugauuauucaguauucuugucaaauauuacuuuuccuauccuguacaguguuuuguggcugcuucccugcuccauccccaccugucuauuauagaaauggguuuuccuccacucccagguuuucaucugucagcgcugucuguuuucuccaaguugccccuccuuuccccacccucuucccauuuuuguauguuuugggcucuaccuuuccuguagaaccuuuccuuagaugucugguaagucuugauugucugcuugcaaauaaguguuaaaggauuaaagagcugauuagagauuugcaguguggggcuggccaugguggcucacgccuauaauuccagcacuuugggaggccaaggugagaggauugcuugaggccaggaguuugagauuaauuugggcaauauagcaagauccugucucuacuauauauauauaauuauuuuuaaaaauucuuuuuccguguggcuuguugacuguuaacuuuaccgcagaguaaucuggcuggaguucauugucuuuuuuuaccucuuugccuaguuuucucuauauuuaucacuaaauccacuuuucaucagaugccucuuaggauguuccaauaucagauauuguuaacaauuuuaucuuucucaggaaguguuauaucccacugaccuccauucuugacugguugccuucuuggcuugguacacaacuauuauucugggauuccuuucacuuugucuuguguuggaucuuuauuuuccagagacuagugucuuuauucuuaguuugcuuguuuuaaaauggcuuuaguuuacucugacacuuucuuagguaaagaauaccagguggggaaguuauguucucuuauauuuugugccauugccuucuaacauccauauugcuuuugagaaaucugaagccauucugauaucuuauauauuguaugugaccuguguauuuuguuuuuccuucccuuccuuuuccuucuuccuuuucuuccucucauuuuuaaaaccucuaaaaccuuuauaagauuuuauguuuccaguguucugaaguuuugccaugauggauuuuugugugggucuguuuucauucacugugcugaguacuuggugaacccuuucaguuuggaaacaucuuuucauucugggacuuuuucuugagucagguuguugauuaugucuuucuauuuuuucucucuuaaacuccucuuauuuggauaacggaccuucuugacuggucuucuaauuuucuuguguuuucucaacuacuuuucaucuguuuuucuuuuugcucuauugaguuuccauuucccuuaucacauauuuaaauuccaagaacuuuuuuuuugcuccuuuuuaauaguauacuauucuauuuuaauaaugauaguauuuuuucuuagcuaucugaauauauaaaauguuagcuuuuuuaaaaaguuuuuuuuuucuuucuaugugguguuuccucuagguuuuauuuucuuacuuuuuauuugcuuuggucuuuaucuuucaucuuauagccuuuccucagauaguugguagucauguguaagaguaaggaauuaaaaugcuaauuagaaauucugagcguggcuugucaauuguuagcuuuccuguaugguaaccuggcugugguguuugguuggaggacuucuagugucgguuucuucuuguauauccuccuagcugguuagaucccuauaagaaggcucuucugauuucuugcuuggaauugaaggccuuucuacaagcauucuguggggugggcagugagggggauguggaaugaaagguuuugggggauccccagauacguuucuucacucaacccuguuuucaguauguucugcauuuugcugugccugauuuccuuaguccugugauccuauguuuuaccuucuucagacaauauuccuuuuuuuuucuugggauuagggagggacaguugggaaucuguaggacugguugcuucuuaaacugacuucuaaacaaucuuuuuaauuuuagcaccuucuccccccacaucccacuuauauagaugugguacugccaauuccugagucuuuuggggauuuugcaguuuaaauuggguuuguuuuuggcauucuccauuguuugcuaaagcuuugauuuucuaguguuugcuaagucauuugucacucaacugucugcuuuccagcuuucaaauuuuuuugcuauugucuuuucaucugccucaguuuuugugggcuuaugucuuuguaucuuaacaaauugcuuuucugucauuuuagugggguuuuagggaaggagugaaaaaauagauguguguguuuaguaucauuacacaucuauuucaaugguagaauacuguacuauuaaauguaaugaaugaugcuaauuuuaauuaagucauagcuccaaguuaguucucuaaugaauacauaaauuuuaagaguggaauuacuuaguuuauauuuguuagaaauaagaauaguauguaauucagaauuucaguucauagaagugaugaaaaauguuaguauuagauucaguuaaugucuaccauauuuaaccacucaguaaucuugugaauuaaguuuuuuucuauuuuauuggugaauaaacugaaacuugcugaguauuuagagagggcaaguugucuaagguuacauacauagcaguaaagcagagcuaggauucaaggcuguuuuuccaauucgaaaucuagugccguuuuuacuucuuauaaagcuaauaagagguaaggccagugcccauaaggaauuuuuaagagugucugaaaaccuaaaaaauaggcaggcuucauugcuuuguguauucguauaacugauggaauugccauagaacauaacauuucccugcaaguccuuggugagaaaaaaguggguaaagucaucacaguggugugccuggaaugcauuagacauucaaauguuaaauguuaagguggacauguuuuauuuauuuauuuuuucuuuugaaacuuauguggaaauuuuaggaaaaccauuuuaauuuuuuaauaauuuagaucagcuuuugcagcauuagcuucagaaauacaaaacauguaaauuuuauuucuuguuuagaaaguuuaauuucacaccuguaaucgcaucacuuugggaggccaagauaggaggaucacuugagcucaggaguucaagaccaaccuaggcaacauaguccccaucucgauuuaaaaaauucgauaaaagagaaaguuuaauuuaaaaauaugaagcuguuaagcaugaccuguucugaugcugcaguauuagaacuuuggugguugguuuuugccgucucacuuuuguuaagguugaaaaugucaugguaagaacaugcuuuauuggcucauuaagagaaacuacacaagguugaaaaauuuuaaaguaucuuuauacugauuuuuaaaaaauuauaacaacuuuuuagauucuagguuaacuuuuuuccuagucucacauauauucaaaagcugcccuccaccacuccauuucuucuuuaccagucaauuugaccaggaaaucuugaccuuucagcacgauuaggccuaguugaccuuuguuugcccuccuugaaacacucuauuuugcguuuugugauaaucuuccauuuucuucccacucuucuggccauuccuuuucagucugucuuucagguuucucucuucugucagacucuguuuccuagguuuucugagucuucuuuauacuuacuaccuuuucccuagguaaucauugguucccauggcuguaaagacaguuuguaugcuauuggcuucugaaagccuaucacuaguccagacuucucuucuuagccuuagacggguaaagucaucugcuuucauaacauuuccgcuugcauucucauaggcuuaucagucucaacaggucauaaauguaacucuugauuaccuagccccucaaauuuccuucuuuaguugucuuuauuuugauaaauauaauuucuuaaugcaguucuucacuuuagaaaccugagagucauucuugauaguuucuuuuccuugcucucuacaucuugaucauuacuuuaaaauauaucuucaucuuuuuuuuccauccuuauugccauugcucuaacauaacaucagcucucauuuaaugcacugcauguaguagcuuccucacagagccuccugcauaugucuugucuuuuucuaauauuguaucuuacagucagaaucauauucuuaaaauggaaaucuguucagguaacuuacuuggccagaaccccuuuuaagccuuuccauuuauuuuaagguaauuucuuucugucuuugcuuacugauggcuucaucaugcuucuuucucccaacuuucuucauuccaguuguacuugaccuuucagaaaguuuuucaguuuucauccauucuucuucuaggccuuugcacaugcuguuauuuuagccugaauauccccuaugccaucucacuuucauuccacuuuaaagcuaaacucacuuuuugagaggcugccucugacguaccaaucuaaacuuagguuguuuguuaauaacuguuuaauagcaccuuguucuuuucuuuuauaaugcuuauuacaguucguaauuagauuuuguuuucaugauuaucugaugauuuuaagcuucuugaauaggaauggggauguuugaugugcugcauauauucaaagccuauuucaaugccuauuagauaaaaucugcuuaaucaagaaaauauacuguuaauauugucauaagaaaucugcuuaaucaagaaaauauacuauuaauauugucauaagaaaaaccaaggagaacuucuauuuuuaaaaacagaaagauaaaguucuuuaugaucaugugauaacacuauuuucuccuuuaagagagaauuaacugauuuacuuuuugcuguguuugugagccaaaaaaaccaaugcuuagguauaaucaaauaugguucuuguccccaaggaguguauaauauuauaagaagauauguaugcauguggcaguuauuuggcaauauaagggcuaaguaauaguuuuaagcaacaugaaauauuaaauaaaauaaucagaaacuuaagaguuggaaaucuugaucucauucaaccuaugaaggaacaaguuuugguuaagugaauucgccgagacaguuuuacaaauuguuucuuagacuguaccuggaacuuggguuuucaaaaugacauaagcaaaguucacagaugguguagauuugaccuuugguaggucagaaaagcaguguuacuugaagugacuuuucacaaguuuuagggugaaggaaaaugugucaggugggagaauauuaauaaaaauggggggaaauaagaaaaacaccugggcagcaguaaggcaacaguuggauuaagugauaggaaaugacugaagguugaauuggggaguuaaugauuggcccucaacacuuguugacuaaaugguguucagggaagauuaguguaaaaggaaucuguaguuuggauugaagugggaagcaggaagaaccauguuggauguuaugcauuucuauaauuuguuaaugaaugaaggaaauaaaugauggggauagggauuuucauuguaaaauguucaguacaggguuucuuugcugagcagauuccacaauuugacaaagcacuguauucacuuuccugucuucucucucaaagcaauauguuaauucuucucauuuugaaaaaggggguaacaaccccaaaacccaauuuccccaaaaauucaugacccagccucaguuuuaaagguuugaaggauaagcaguuauaaccuuaagacaggguuuuuggcaauuuaauuuuuuuuuuuuuuugagauggaguuuuguucucguugcccaggcuggagugcaaugaugcaaucuuggcucauugcaaccuuccccucgcggguucaucgauucuccugccuuagccucccaaguagcugggauuacaggaaugcaccaccaugaucggcuaauuuuuuguauuuaguagaguugggguuucaccauguuggucaggcuggucucgaacuccugaccucaggugauccacccaccugggcccccaaaguguugggauuacgggcaugagccacggcucccggcucaauuuagcguuuuuauagaguuuauccauaucugaaauucaaagcagaugugucccaaauauguuugguagugaaaagaaguccagguaaaugcgaacuaauaugaauauuuuaggauugguuccuuauauuagugauuguagagacguuugccagcuuccuuuucauacuaaacagauuuccauugucagucucuuccaggcaguagagaggaggaauuauuuuuuuccugucuacuggggacuccuaggucucuaccaaaaaggaagugguguacaucuuaaauuauuuaaaaugugaaaaacauuaaugcuacuguugauacuaaaugugagcauuuugguuauuuugcugauauuuaaagagccacaauacuaauguuuauucgguucuuuguuggugcccuuuugcacguugucauuuucaaaguauaaggauauauacauguuuguagauacauauauaaagaaauauaauuuuuuggucuggacuugguggcucaugccuguagucccagcaguuugggaggcugaggcagguugauugcuggaguccaggaguuugagaccagucugggcaacaugguacccuaucucuacaaaaaaaauacagaaauuagcugggcaugguggcgugcacgccuguugucccagcucccugggagguugaggugggaggaucgauugagccugggagguggagguugcagugaggugagauggcgccacugcacuccagccugagugacagagugagaccuugucucaaaaauauauauauauaauuuuuuaaaggucauuuugaaauuguccuuagaugauuauaaaaucucuuagguaucugaaagaauguaauuuauuuaauaaguaugugcauagcucgcucucucuccuuaaggagagccagcaguugaauucaagaauaaacguguguuuguauuuaagaaaaaugacaaaagauuccuucuauuacuccuguaauuuuugguccuuuacuucaacuuuuuuucaccuauuuuaaauuuauuuuguuucaaaacauuucugucuuuguaagcugcuuuaaauauuuuaaggaauggcuugggauggaaaucuaaucgcauuugggaaaaguauaacaagguagaaaauuauguuuaggagagguacuaauaaaggaguauugggagucagagaaguuaagaucacaugcuugaggaggaguuugauagcuacuggguuuaguaagucauuuuaguagagaaaacauuaagcaaagagguucaaaguacaccgauguuuauagaaaagaauauaagacauaguccaaguugguaucagaugggcuuuguauacauaaggcuaacuuugaaaagccuuaaauguaagauugagaagucuggauuugauuggacauggaauggagggcucuuuuuuguuuuuguaccaugcaguggccugaucaguacuauguuuuaggaggguacuggcuuuacuugggaugucuaguugcuuccuuccuuaauugaguaugagaaacucaauaauuccuuuuuccucagugguagaaauggaggcauauucucugucauugucugagauaaugguuugaaucagucccuuuggccuaauuaggaaaaguaaggagguuaggacccaguccacauaugguaacacuccacuuaauccagagguuaaaccagcuguggaauguaaggagcccaaaaacugcuugaaauugcuaucaaagccauguccccuccucucccuggucccccgacgccccgggggguauuuuugcauagcauuucugauccuuuuuuggacuuccauuaagucuccuuauguuuacuagcuuuguuaucuuaaagcagaugagacuagggagggaaaagaaaugggauucugaggcauguaaguugacgucaggaaaguuagcaauuuauagccugacaugaagguaggaguuagaaauuuuaagaaaaccccaaagaacugugauaggauauugaauauuugcuaguugaaaguuagauuauguucguuauauuguuuuaaggaaucauggguguaagaauaaauuccaaaugauguuaaugacugagcuauggacaaguauaaaccauguuuuagucguauugccuccacuguaucauuuaagcauagacaaauccuuuuacuccucuauauugcuuuuuuccuguucuaaaauaagacaaguuguuucauacuuuuuuaccuuuuagggcagcaagguuauucucuaagacauucuuaacauauguucuaaauauguuacaaaaauaaaagcuagaccuuuacauacagaaauuacgaagaauauuuguaguaauauucagaaguaaaauuaaaaguuccuaauaggugcuaagauuuaaguaauugguagugauaauuuuuauuuuuaguuaaauuagugaaugacauauuagguacuaagucugcauaagguauuuuguagacauuuaaugauuuagauguuuagguauaaugaagauccccccccaauuuuucucuuugaaauauuuuuauuaauuaccuuuuuauuuuuuuaaaaagagacgagguuucaccauguugcccagggugggcucaaacuccugagcucaagugaucuucccaccucagccucucaaagugcugggauuacaggcgugagccacugugccuggccugauuaccacaguaaaucaaauacuauaucaaggaaaacugacuuuucucauuguauauguuuuuauuuccuuuuuuagaaauugacaaccaagccaacuugguuucuuucauaaggaagcuuuuguuugugccuaauauuaaacuaauuuuuagagacugggugugguggcucacaccuguaaucccagcacuuugggaggccaaggcgggcggaucacuugaggucaggaguucaagaccagccuggccaacauggugaaaccacaucucuacuaaaaauacaaaaaugaggcagucaugguggcacacaccugcagucccagcuucuugaggaggcugagguaugagaaucguuuggaccuggaaggcagagguugcagugagcugagaucacgccacuguacuccagccugggcagcagagcaagacugugucucaaaaaaaaaaaaaaagaaauuuuugggcugggcacaguggcuuacaccaguaaucccagcauuuagggaggcuggacaauugcuugggcccaggaguucgaggcugcagugagcugugauggcacaacuguacucuagacugggugaccaagugagacccugucucaagaaaaaaaaaguuaauuuuuuuucuugguuguguccucuaaacaaauuuguugugguacuuuugacaaugaccaguacaucuuccuguugaggaaauacacucccauguuuuaaaaauuacuuuuuaaaaaaggugguacuuagugaaauuugucuuagugaauuuaauuuaggaaaaaaugcugcuuuauaaguuauguuuuuugcuuuauuuuugguuaagguuguuccuuuggguacaagguguggugugagaugugugaauugagaaaaucccugguuugggcuauagacuguccacugcuuaggugcucagauaucugagucuuuccuuuucuuccucuuuuaaaagguuuuuauugcuguaguucaccuaaacuuuucuuugagagucaaacauggagccaagucuugucuuugguugaugguucauuuuacuguagaauuuggaauaagaguuuuaaacuguucuucauuuucaauguguuauuuuccucuauggagauccaccaaacauucaucaguuauucucugaaauaauggauagcaggauuuauacauuuguacaauugguuauguuuuauuauuaggaauuuuaccuauuuugagguuccaggcaggaagggugguacagaaagaggagauggaaaugagaauuucacccuagauaacuuagcgguuuccuaccuccaucucugaaucccauaauaacgaucaugauaucacacccuaauccuuuuaggaacaaguauauuuaauacuuggugaagguacauaauguuuauuuuauuuuauuuuuuugagauggagucuugcucugucacccaggcuggagugcaguggcacaaucucggcucacugcagccucugccuccuggguucaagugauucuucugccucagccuccuaaguagcugggauuacaggcauguggcaccaugcccggcuaauuuuuguauuuuuaguagagaugggguuucgucaucuuggccaggcuggucuugaacuucugagcucagacuguccauccgccucagccucccaaagugcugggauuacaggcaugagccaccacgcccagccugaagguacauaacauuuaaauuggcaacuguuuagcuccucuuuuuuguaagcuuguauaagauugauaauaaauucaugggagaccugaggauuauaugacagggaaaugauucaaaaauuuuuuuuacuguauuauugguugauauguuacuacaaauaaaauauugugaaguuaaggaccuuggucacauuaacuacuaagugauggagcuagucaguauuccauuaggugauuucauuccaaaacuugcacucaaccacauucuggagguuucuuuuguccauugagaagaacaaaaggugacagcugacaacuauaaaaagcagucguuagccuauugaguauagaggcauuugacacuauagacuuuccugguuauuucggucacuauuuuauggaguuguccaguaaugaguguaccuaauaauuccuucaaucuuuauuauuauuuucucuuaguacauuuaaaaaguauaguuucuaccccagugguuaaauucuccaaauuuauugcuaaaaaguaaacuuuaaauuuggaaaauuugcugaaguaaauugcaauuucagaaaaauaagugaauauggagacacccaguuucaugacauaaauauuucaauaaauuauuagauuacuggccuucuaguggucucagauucuauaagcuguugauacuuaggauauuuuuuauaagcuuaaugcaaucaaauuaaaauucuauuaaaauacuuuuaaaguagaaaccuaauuuuaaucaguugaauaauagcacauuuuaugaaucagauuuuuaauuuugagugguuacaacuuaucuucacaucauauuuauuauuggaacaagaaagugauaauuuuccugugaacucacuuggggaaguauaaaaaaaaugauaguuuauaugaaugcuuuaauauucauuugaaaaauaggauuuagcuuguccuuuugcuuauucuagaagguagaauuaacuuuuuguuuuguuuuguuuugagacggagucucgcucugucgccagacuggagugcagugacgugaucucagcucaccgcaaccuccaccucgcagguucaagcaauucuccugccucagccucccaaguagcugggauuacaggugugcaccaccaugcccagcuaauuuuuguauuuuuaguagagacaggguuuuaccacauuggccaggauggucucuaucucuugaccuugugauccgcccaccuuggccucccaaagugcugggauuacaggugugugccacugcgcccggccacuuuuucuuuuuuuguaauuuuuuuuuuuuuccuuugagacugaguuucuaccuuguugcccaggcuggagugcaauggugcgaucucggcucaccacaaccucugacucccggguucaagccauucuccugccucagccucccaaguagcugggauuacaggcaugcaccaccaugccuggcuaauuuuguauuuuuaguacagaugggguuucuccauguuggucaagcuggucucgaacucccgaccucaggugauccgcccgccucggccucccaaagugcugggauuacaggugugagacaccaugcucggccuugaaucuuagacaucugcauuaggucuucagagguggcaugaucucggcucacugcaaccuccgccuuguggguuuaaaggauucuccugccucagccuccugaguagcugggauuacaggugugcgucaccacguccaacuaguuuuuguauuuuuaguagagacgggguuuugccauguuggcuagacuggucaugaacuccugacccuaagugaucugcucgucuuggccucccaaaaugcugggauuacaggcaugagccacugcaccuggcuacaaaaauuuuuuaaaguauucagauuuuuuuuuuuuuuugagauggcgucucauucucacccagacuggagugcauuugcacgaucucgguucacugcaaccuccgcuuccuggguucaagugauucuccugcaucagccucccuaguagcuggaaguacaggcgugcaccacugcgcccagcuaauuuuuguauuuuuuuuaagagacgggguuucaccauguuggucaggcuggucuugaacuccugaccuugugauccaucugccuuggccucccaaaguacaaggauuacagguguugagucaccgugcacggccccaagagaugguggugguggugguuuguuuuuuuuuuuuaacaguagaacuguuuuuuucguuuccauuauuuauuuccugauucacuuauaaauguuggagcuauugaagcaauuggaauuuuuuugaauuauaguuaacaauaguaaagauguaucuuaaaagauauaguagcuuuauuuaucauuuaauaguaauguaauauaagccuuacuuguguguuccauaauuuuuacuuucugccaguaugaaauagccaaaagugacugaaagccaguaauuuucacaucccgugcaagucgauugcauuucuagauauuuuacuuauuuaguaugcucuugacagccuaaaauugccauucuccccagugucagcauucauggagaaaagagaauuuuuuuucauuuuguuagauauuauuuuaauaccauaucaaaacaccuugacuaaugaaaaaagcuuuucucucaagcuuugaacauuuuugaaggcauuucauacuuuuuuuuuuuugguauuuuaauguauaaauacagaaaccuaucuugcaugggugggugccacauguaaacaucaauggcuaaaauguucucaaagugcuugaagacaaggauggcuguacauauuuguuuauuuauuuauuuauuuauuuauuuuuagacagggucuuuugcugucgcccaaguuggagugcaguggcacaaucucggaucacugcaaccuccaccucguggguucaagugguucucccgccucagccuccugaguagcugggaugacaggcucgcgccacgacacccagcuuauuuuuguauuuuuaguagagacagaguucacuguuggccagucuggucucaaauuccugaggucaggugauccauccuccuuggccucccaaagugcugagauuacaggcaugacgcaccacgcccgaccuacguauuucuuauuagucuuuuguuguuguuguuugcuuacguuuucuggaaaaaaaaaaauucacaagggccuaagaauaacauucuggcauuuuugcaagacacuugugauuauugaaucuucuuaagagauaauauuuuaaaacuggauuaccuuuuauaaaauggacaggcuaagaucaacuuuggauuuuuuuuuuuuuuuuaauuuagaggucuaguuaucuuuccaguuguauucagacucuuagcccuuagggaucuacaaguggcuuauuaggaaauugauccaauauguagaaacaaaagcuucuaacaaguggacacauuggccuaacaaaaaccaaguuauacuauauuugaguucaugaaugucugacuuaaaugccauuaguaccauucauucaguaaucugaauuaggcuuaacacaugagaaggggagaggagacaagagaaauagggaguugaagaccauuagaaggaguggaagagaaggaggggauuuggugauaauaauuugguaaacauuuggugcaguuugcggucagggucacuguguccucauugccugcaucagcgaauuuaucuauauaaaaauuauuuuagaaaaauuaccuaagguaguuuaagcaauugucuuuuagccuagaagguuuuuaacaguaccucuuuuuuuuuuuuuuuuuuuuuuuuguuccugguauugggaugauuuauuuacuucaaaaauacucauucaauauuuauugaaugcuuguuacauaccuagcacugaacaaagauacuaaggguaugaagaaaaaaaaagacaugguuuuggucugcaacaguuucgucuaguacacucaagcaucauaagaucuugauuuaucuucucaauuauccaaauaaguuuauauugugcucaauuguuauucuguauaugguauacaugacaguuuuucuauucaaaugaauugaugcaucuggacuaucgaugaauaagcauaaugagguagaguuuaaugaacguuagucuuggcaucagcccuggcaucucaucuuauuucugcuaccucuucauuguaugaccuuuguaaaugaguuaacuuuuuuaagccugauuuccauagcuguuaugugcagguaauagcuacccgugcuguuguugugaggauaaaaggagaaaggcauauaaugcaccuggcucaguucuugauaguucuguaaaucgauggcuguuuuuauuacugugcuaaguaagagugauuccuuucuuaagcacuguaaguuaaaauggaaagcuuguuuacuuguucagaggcguuauacauaauuuucuaaagcagcgguucuguaccuuugugacauuuuuggugcagucuuucucaccugggguccauaagacaaucccuacaggaaaagagugccuacucucuuaguucuaagaauggcauauaucuagcaccaucauucuaaaugcauaagaaaauagcgaauucauuacauacaguggagcgaucagggauuaauucuuucgcugacucucaugcugccaggacaguauuauaugugauuauugagcaguucuuugaaauuccuaaauucacaaaaacauaaguuguuguaaaagcaaccuuucccuuuuuuuaaauggggguggggaauacuuggaagaaauacagcgucauguagcaguuuguuaauacucuaaaauagaaccauuaccccaauuaagugauucucaacuuuuucauucugaaagauuguuuuagaugggcauuaugcccugaagaccaucucuuccaugcucagucccauaugggcccgaaaacuaucuccuuagaaugaaugggauuaagcuguuuguuuuaaguaagauuauaagucaauaucugguuuuuuaaguuucaaacauucauugaacuggauuuugaaaucuauaaaguuucaaaacuaguuuuuuucuaauacugauucuaaaagugaaaaaaaaaaauaguauuagagcccagaaauuugggggaaugcuuuuugucuguauauuuuggaaguugacauuacauuuuaguuuauugaagaccgauacauuuugaagaagaaagacgguuuuauugaaauccaacucuuucaucauauaauaccuguuacugaccuggagaaccaguguuccuugaaacacagauugagaaauguucguuugcuucauuuuauauaugagaaaugucguuggucauguauagucaagugacggcaggccucaacugcagcccaucucuacauuuauuauucugcuguaacaguucccuuucuguuuaccaccuuauuuucguuuuguuuguuuguuuguuuguuuugagauggagucgcgcuaugucgcccaggcuggagugcaguggcacgaucgcggcucacugcaagcuucgccuuccggguucacgccauucuccugccucagccuccggaguagaugggacuaaaggcgccugccaccacacccggcuaauuuuuugcauuuuuaguagagacaggguuucaccauguuagccaggauggucucgaucuccuaaccuugugauccgccugccucggccucccaaagugcugggauuacaggcgugagccaccacgcccggccuaccaccuuauuuucuauuaguauucaauucauauuagaaauaaaaguauaauuauugucaugugagaguguuuguaacaaguagagaucuggcagauguuaaagaacacauuuugagaagugcggcacugacauauuugcaggcucuuuuaauuggcccugucuuuguaaaugguuugcagaccuuagugggggaauagacuuucuaugugguagcauauuccugacggaaaucuuguacauaaguuagaaagaacuaguuaacuucauaaauguagggaaaugaucaguuuguuacgugcuucaauugccaucaguaugggauauuuuacuagcuuuauguucucuguuccucauguuggagaguuaacccuugaugguguucgugaaguaaaggagccaauugaacauucuugucuauuauuuauccauuuccuagguuaugcuuaucagaaaaaugaaauaugaaguacagaaaggguugucaaaaauggagaaaccuugaagucauuuugagaauaagauuugcuaaaagauuuggggcuaaaagaugguuauugggagacauuucugaagauauacagguaaauuagggaaugaauucaugguucuuuugggaauuccuuuacgauggccagcauaaacuucauguggggauaacagcuacccuuguaaaggagagagguguauaaugcaccuagugaaguucuuggucguucguaaauggugucugcucuuacuacugugccaaauaagagugauugaaaguguuggucuuuuuuuuguuuuuuuacuuuuaauuuuuagacacagggccuugcccuguugcccaggcuagaguguaguggcacaaucauagcucacugcagccucgaacaccugaccucaagcauuccucccaacucagucucccaaaguguugggauuacaggucugaaccacuguacccagccuaugucaaaaucuuuaaaauaccagcugauggcggccgggcacgauggcucacaccuguaaucccaccacuuugggaggccaaggcagguggaucgcuugagccuaggaguucaagaccagccugcccaacauggugaaaccucgucucuacuaagaacacaaaaauuagccaggcgugguggcacgcuuauguaaucccagcuacuugggaggcugaggcacgagaauugcuugaaccugggaggcagaguuugcagugagcuaagauugugccacugcauuccagccugggcaacaacagagugagacucugucucagacacacacacacacacacacacacacacacacacacacacacacccaucugauugggguuuuggguuuuuguuuuaguuuuugagacagggucacacacacacacacacacacacacacacacccccagcugauugggguuuuggguuuuuguuuuaguuuuugagacagggucuugcucugucacccaggcuggaguguaguggugagaucuuggaucacugccacuucugcccccaggcucaagcgauucucccaccucaguuucccugaguaaccaggacugcagguacaugucaccaugccuaauucuugcuuuuguuuuuugagaugggauuccauucuguugcccaggcuggaguacaguggugcaaucacagcucacugcagccucaauuuccccaagcucaggugauccucccaccucagccucuugaguagcugagacuacaggugggcgccaccaugcccgguuuauuuuuauuuuuuuuuuuugagacuggaucucacuuugucacccaggcuggaguacaguggcagucauagcucauugcagccucaaccuccagggcucaagugauucucccacguuggccucccgaauagcugggaccacagaugugugccaccacacuuggcuaauauuaaauuuuuguagagauggagucucacuauguugcccaggcugggcugauugguuuugaaggaaguagggaaauaaacuuuucuucuauuuagaaauacuauaaucugguauucugaauaauauuuuaagaaguggcuuauuaaaaacugaagggaauguacacuagcuucacuucuuuucuuuuuuucuuuuuuuuuuuuuuccccgagacagaguuucacucuuguugcccaggcuggagugcaauggugcaaucucggcucacugcagccucugucucccagguucaggcaauucuccuuccucagccccucaaguagcugggauuacaggcaugcgccaccacaccuggcuaauuuuuguauuuuuaguagagaugggauuucaccauguuagucaggcuggucucgaacuccugaccucaggugauccacccacccggccucccaaagugcugggauuacagacaugagccaccgugcccggcugcuuuauuucuuaauggagcuugccaaauaaagaacuugaguucuaguaauauuagcacuuucaaagacauaaacuaagauccguuguggcuuuugugaaguuuuacugauaguuauuacaauguuaacuagacuccacauacuuuuuaaaucaaagcauauuuuuaaaauuguuaauuuaaugguggguugauguucuuucuuaauaccuuuucauuuucuuuuuggcaacauuuuacuuuccagacguggauuagucgcuaucaaaauuuuauuccuaaaauguuuggaaaguggaaauagcuguggaaacugugaauagucaguaagguagcaggauucaaauuauuuuuuccaguauugacauuuagaaugucauguuggacauuuaaaauuuuucugguuuguagccucauuacuguauagaaaucaacuaccagaugaguaguugacagacacagcuagcuugguugcuugcuugcuguucuugccgccgccgccuucuucuuuuuuuuuuuuuuuuucuuuuuuuuugaggcaggguuuggcccuguuccccaggcuggaaugcaauggugugaucucagcucacugcaaccucugccuccuugggcucaagccacccucccaccucagccucuccaaguagcugggacuacaggugugcgcaaccaugccuggcuaauuuuuuguagagauaggauuucaccauguugcuuaggcuggucuugaacuccugagcucaagagauccucucuccucagccuccuaauguguugggauuacaggccugauccacugugcccagcccaggcuuucuuaauuucugaguuugcugaaaugggcccuaaggcugaggaugccuucugagauugguggaagcuacugauauuuccuugucacuuuaggcucaauugcuguauaaguuauaauaagauagaguagauuaaaggauuuauuuguaaguagauguguucugucuuuuacaaaaccuaccccacuuuauugauaaagaauuggaaagcgcccuguuuuaacuaaaauguugauugcuucugcagaugucuaauaucauauuuauauuuuuuauuaaauucaaguugagauaaggcaaugaccuuuucaucuuauuauauacggaggaacuugaauagauauauuguaagcuaucauaaguaauacuuaaaauauauuaaaauucaggucagccacagcauucauacagauuauuaucuauucuguaauaaacuaaagacuguuucucugggucuuuaagcagaauugagcucugaaucuaguuuauuauugucagauuauuauuuuaaucaugcuuauaacaaauggugacuuaaacuguugcuauaauguuuacauuauguuaggauaauaaaacuuauuaaauuaugaaguucuuguacauuuaaaagucuaucuuauauauuuguuaugcaaaucaauagauauguaucagguaaacuagaaauucuaguuagaaaaaauccuuuuugugucuugguuuuugaagauacuuaaaaggugaaaggaauuucugauuaccauuuuaacauguuuagauaugggcuuuuuaguuucaauagaaacaucuuuuccuagauuaucuugcugguauuaaguuguuaaauuuugcuacgcuuuauuuugaaguuuuacugucuuguaaaacuccauauuuuuacauaguuuuacugucuuguaaaauucccuauuucuuagguugauagaaauggcaaaacaaguuaacuugcuuaagcuuagcuugcuuaacugucaauugauguauguuuaaaugaauuugaaguuguuucagaauucuacuuaaaacaguauguuuauucuagcuuuuaucauacacuaaguauuuauuuauuugagauggagucucacucugucacccaggcuggagugcagugacgugucucuauuuuaguagagacgggguuucgccauguuggccaggcuggucucuaacuccugaccucaagugaucggccugccucagccucccaaagugcugggauuacaggcaugcgccaccgcgcccagccccagucuauauacuaaguauuuaaaaagaaguacucaguuguuaaucaaaauaauaugauuuggaaaaauguaaauuaaaccucagaguccuagagucaaacugguuuugaauuuccuguucuuuacuagacaugugaucuuaggugaguuaguucaccacuuugugcuuuaguuuccuuaucaaguaaaguugugauaauaauauuccauauaugauaggguuaugcuaaagauugaaugaggcaauauauauaaaaugcauaauacagugcauaauaauaaugcacacaguggcaaguuccuguaguuccagcuacuuggguagcugagacaggaggauugcuugagcccaggaguucgaggcuguagugugccgugauuguacccguaacuagccacugcauuccagccugggcaucauaggaagaccuuguuucucuuuuuuuaaaagcauaauacauuaccuaccauauacuaagcucucaguaaguuaaaaauuaaaacaaaaaguuaugaauauuuaccuguaaccaacuuuguaagugaagguauuaauacauuggaguuuaucucuugaauuuuaauuuaaaaaaaggaaggaggauauuuauggcacuaaacucuauuuccugcgaaaauuuuugaagaaacaaaugaggagaaggucuucaguuuuaauaaugcaggaauaaacauacaugauaauguaaauuggaaagaacuuuugcuuuuuuguucaccuguucuaugauaugcuugcuguagucuggaguuaauuuccacacuugcuauuuaauguaaacauuguuuuucuauuuguaggaaagauuuucccuuuugaucucucacauauuaucuucugaauuaaaguucucuagagaacuguuuaccaaagggaaagaaaaagacuauuaacaucugguuacuuuucugauauuaguacagaacaugacauaaugcuaucauuuccauuaggauuagcuuuuaaagaaagauuggacuaaauuuuucaucugaaugaaaaaucggagauuuauguuucuuaauuucucaguggauauuccauaggcgugucgaguauggaaccauauucaggauguuuuguucuauauuuuuaauuuucuauugaaauaauuuuagacuuaccaaaaguugcaaaaauuuaguacacaggcuuggugugguggcucaugccuguaaucucaccauuuugggagacugaggcaggcacauuacuuaagcccaggaguucaagaccagccugggcaacaugaugaaacucugucucuacaaaaauuagccaagcaugguggugugucccuguagucccagguacuagugaggcugaggugggagguucgcucgucagggaaguggacauugcagugagccacgauuguuucagcgcauccuagccugggcgacagagccacacccuaaguacauacauacauaccuacacacacacacacacacacacacacguauuucacacagaauucccauauaccugucacccagcuuuccuuaauguuuguaucauguauaaccauaguacagaagucaggaaauuaauaccaacuacucuaggcauuuuugaauuuugaccuugucuacuaaaugaucuuuuucugguccaggauccaguuuaggaauucauauuguacuugguugucauaucuccuuaaucuccuuuaaucuaggccugcucuucauucuuucuuuccuuucaugacuuugacacuuuugaagaauacuagguaguuucauugguccuuaaucugugcguuuuuggcaaggauaugacagaagugaugguauauucuuauuaguagauaaggagguacaugauugugauccaucccauuauuggugaugucaucuugaucauuugguuaaggaggugccugccagguuucuaaacuaucaaguuacuguuuuucacuuuguaauuaacacaugucuugggaauauuuugagacuguguaaauaaucuuauuucucaucauacuuccauuaauuuuaguauccauugaugauucuugcuugaucagaaucuuuuacauuuaauuauuuaacaucuuuuuuuguuucauugacugauacauuauuuuccuugucauaaauggauaaagacccaaaggaauuaauguaaaggcagccuaauucgcaaaacguaagugguuuuguugcuauggucuuucuuuucuuuuuuaucuauuuguauuuguauuuuuauuuauuuauuuuuuuuuuugagacggagucucgcucugucacccaggcuguagugcaguggcgcgaucuuggcucacugcaaccuuugccugcuggauucaagugauucuugugcuucagccucccaaguagcugggauuacaggcaugcaccaucacaccuggcuaauuuuuguauuuuuaguagagacgggguuucaccauguuggccaggcuggucuugaacuccuggccucaagugauccacccgccuuggccucccagaaugcugagauuacaggugugagccagcacgccuggccuggucuuucauguuuucugaguuuucuaagugcacucuuaugaacguaacgcaacccaagauccuagaaugaaaaaauacaguaggaagauuauccuuuuuuuuuuuuuuuucaguaccuuauagguccaaaaugugcugcuggccauuauaagaauaaagcuaaauauuucaugcuagcaagacgaagaagacacuagcgagguaaaaguaauggauagguuaauuaugaaaaaaguauuuguuagagcaauuuagagaucuucuuaaaauuacuaagguuuuuuuaaugacauauacuagccuuuuucacuuuaaggagucaguggcaaauuuaagcuuuauuuauuuauuuauuuuuugagacagaaucucgcuuguugcccaggcuagagugcaguggugugaucucggcucauugcaaccuccaccucccggguucaagcgauucucuugccucagccucccacguagcugggacuacaggcgugugccaccacacccggcugauuuuuguauuuuuuauuagagauggguuuuaccauguuggccaggcuggucuugaacuccugacuucaggugauccgccuaccuuggccucccaagugcugagauuucaggcgugagccacugugcccugccaaauuuaaucauuuuuauauuuaguuuucuugacccuuagguugccuuauccuuuuuuauagucaauauaguuuaugcaacuguguuucuaugauugccuuuuaucuuuuauucuauagugaauuaacuacucuaaaauauauauauuguagauuguuucuuuuucaucuguuuuacuucaucuucuaccucaguggagcaugaacacauuuggguuaucuguugguugucuuuuaacaaauacuugauauuuauaucuaguggacuaacuugaauaccgguaacauuuucagaugguauauuuuccaaaagguugaagagaaaauauacagauaauggaauuuggcuagauguugagcucuaaaaaugcuuuaauaguuagguuuuucuguuuucauuacagcuuucuucucuuuuaggaaauuacuguccaugauuaagcacauauccucuugaugguauucagccccuuaaguucagacuuccuucccguugguuuuuuuuuuuuuuaauuaaaaaaaaaauucuuuuuaacacacaacuuugcucagagucuucccuauuuuuuuucaaaaaauguguauuccauuugauaauacacacaagauuuaugguuuagaaauaaucuuuaccuccagugucaguacaauaccuuaguuaacuaauuccgaagaacuuggguggguuuuuuuuuuuugccuuuuuguuuuguuaucggguaagaucucucccuuuuugaaauuggauauucuggcaguaucugguuuuuguacuacuuuuaaaucucugaaaaagaauauuagaaaucuguaauuguugcaauuuggcuaacauuuguaucaucucucaggauaauaccuuugaaauuucugcuaacuauacuaaaaaauuaauccuuagaaguugacgaccccaaaaagagauggauacaugaaaguuuauuuuuuauuuuuuauuuuuugagacggagucuugcugugucacccaugcuggagugcaauggcacagucucagcucacugcaaccucugccucccaggcucaggcgguucuccuccuucagccucccgaguaggugggacuacaggugagcgccaccaugcccagcuaauuuuuuguauuuuuaguagagacaagguuucaccauguuggccagucuggucuugaacuccugaccccaggugaucggcccaccucagcuucacaaagugcugggauuacaggcgugagccauggugccuggccgaaaguuauacuuuugauaaauuuuuuguuuucuuuaggauuagaaaguugaacuuuuuagugucuacuuuagauaucggccacuugacaaaauucuccuuuguuuuuugaucaguaacuuauuuguaaagcauuuacugaguuaccuauuccgugugccaagcacuuuucuagggucuagagauaaaagacacacugcuucuguuaagcauguucuuuccuuuucuucuuacugccagcuaggacuguuuuggauacuuagaggaauuugugaagaauuuguuuucuuuguagaagugccuuagaaccaguaugaaugggugauaauagguaaagaauaaaaagauacuuccaauguauguagaauguccagguuaaugaauaaucgguaaauuuauaaaccauuaaguucaacuuuagaucagucaguuguagcacauuugaguagaaaucagucuuuguagaaacauagugccuucuauuucauagcuuaaauagguguagccuucccuuaugcuuagauauuagaaaugcuuaaaacuaauaagcuguguaugcucauuucauaauuuaauauugagaacaaauauugcaaacagccuaauuugauguacuucucauaaaauuuucucagugguauuuauauauaaaauacugcuucugauuugaauauacauggauuuucaguaagaaucuuuaaaaauuucauuauuuacagaaaauguuaaaaugauuucauugauguacugguagguuaauagaucuauaacagccauuugagguagcagcuuagcauugcugauuuuguuagcuuugguuugaaauuuuuucucuagugguugaaauguaagucuugcaguguaauaaauauuucucccucuuaaaauaucacauagaagaauguuguccacuaaaauagaauuagguaagggcuuccuguaucauuuuuaggagcuuccaucaauaauauucucacaaaggcugcacuuucuuuuucaaauaaugaccccauuuugaaagcaucuuuacauuuuuuauauaaaugauacauuaucaaauucagagucuucauaaauuauuaacucuuaaagcaagcucucuuuaccagcucuccucagugauuucaaaauaauuucuacuuagagaaaucugcuuauucauuucugaguaugaguguugaauuauuauguuuugguacuucaggcaaaauaaagaaguuauauucugaaagcguucugacuuaggggaaguuuguaaagauucauuuucuccagugagcucucauauuuaacuuguuguguaacuuaaccuucggacauuugguuuuuuaaaucuaaguuuguuguacuuuuuaucuauauuauacuguggugugugauaaauaaagauuuggaugcauuuaacguaaaguuccuguuguaggagaaauucuaaauuuagaccaauauuaaucugagcaagaucugguuuuuugugaguuguuuuucauuuucaaagugaaguaggccuguaaacuuaaaaaugaaaauuacgagguguauuuccuauaucaaaauguaccucuuucuuuuugccuguauuuucacucaccuauauauuauuauggauuaguauucaagaacugaaggaaaacuauuggaaaguuaacuauugaaaacgacuggaaaggaaacuaaaggaaauuuggaaaaucguaucuuaauuauaauuucugaauagguuuuaaacuauuuuaaaguaguuaaguuuuacuuagauuucauuaauuuagaaaucuuagauaauuuucaugguugauauugagcuauuacuauaugaaaaagaauaauuugucaaggaaauugauuagaaaaggcuagaggaugauuguuuaauaaauaauuuuuaaagcacuuuuauagcaccuauuugcaccauauagguacugugaaaauguauguagauagcuccaacguacugauuuuaagccuuuuuccucuguuaaagagccacuccuuaacaacuccagcuguggaaugcuuuguuaaucuacuaggguguuuuagacucuugaaacuacuuaauuagauugcauuuguuaagauucagcauucagauccuuuuucuaaucugugcuccuuucuucuuaucauccaucauauaccuccucauugugauuauacuguaaaauacuuuuuaaagccuacugaucuaaagauacagucuuuuaaauacuaaaaggcuuuuggacuuaaaaucuguuggaagcuuaaauugaaaaaauagcugccacuuuaggugcauaaaguacuuucauaauuauuugauaccucuuguuagauggcaguuucaccuucuucuuuccaguuucuuuuuucuuuucuuuaauauuugguaauugcagauuugaugguuaaauucauagguuuucuuuacuuaggccaaacugucauuucucauuuguacagaauuggauaugucccugugcagaaggguuagcucauucuuuucaucuuuaagcuuuuaaaauuacuuagucuaaauguuguuagguaauggaauaaccauuccuuuucagcuuuugguacauuuccaaacuggcuggcagagccaggaggaagugaaggcauuagaaacacuaacuuugguugguugcuaccgucuuagugcugagacuauaaccuuuguugguugauugauagagaacaagagaacacaauccucguuccacuaacagguaaggaacccuugugauaacuaguugguaugagagggagauuacuugauagcauuucauaaaaacuuuaucccaaaauauaacauguccuagaaauaggauacugugacugacuguacuccguagaacaaggauacgcagcaccuuuauauuuagaauaagaucugaaauuuaauagggauguauuacucuguaccacaaagcauaauugaucuguuuuccaaaggcaacacuguuaaaauuuauccugcagucccuguaacuuuaaauauguaucugccuaucuuauucuccuuucagcuuuuccuugaucagaugcuaugugcuuugaacuuccuucucuuauuuauuccuauaauaaagcuaacuauuuucuaguaucuuugccaucaucuauaauuuggguauaucuuacugcuuuaauuucuauguuauagccauuaaugauuauuccugguucuucuugacccaaaagaaaaugauuaugcauuuuaaaaaggauuuugagucuguauugccuauauccacuauucugccuucccaguuuuaaagcugagugcuugaagaauaaaucuuuucagugacaguagucauaagcuuucauaaaauauaggcuuagcuuuguauugcuauaauaugggccuauagugugauuaauucuuuaaguuaaugaagacuugaacucagagaagaaauucagcuucuuagacuuucccaaaguuuaguaguauuccuguuaauauacuugguuuuuucuguuucuacuuuucaguccaucuucuuuucuuugacagaagaauuaacugggacuccuccuuugauauaucugagguugugugccuuuucccugucccuuaaagacaacuaugaucuuguuuccagucauaauuuaucauuuuugauuuggucuuccacucagaguugagugguuuaucacagaguguguuauggcuuagaccaauacaggucccuucuuaauaguuacugaggaauuaaucauuuguggugacagacuucuaaaauucaaauuaagaaggcacuaaagaaaguaugcccaaagguagcuccuuuuuauccugaggauuaagccauuacaaacucaaaugaccagagaauguaauuucuuaauaagaauuuuuccuuaaaucuauauucagcucucuauuucagugcuucucuccuaccagaggugcaaggagugauccuagaaccacagauacagccaagaccacggagagcuuuugacgucagggguccacuuucuccacugaacccuuggagacagaauauccagcuucuggagagagugggaaaggauaauaaacaagugggugcuuuccauuauuuacuuggguuaauuuauagauuggaguguccuuccauugcccauuuaauucugugguaaacuccuuggguucauuuaagaaccaggugggacugcaaucuguuuuguuuuucugagaaugcuaacuaguacucauucaaaaaugagaccuaaaauuuaauuuucucuccagauaauuaaagcaguggaugauuuggggcacaugauuugacgaaugccuauguaguccacaggaauuuuaaaacgggaauaucuacccauuuuggccuuugugguauuaguggacuucuaagugcucuuuuauauucaaguaauuuaaaagguucuguauuucaucuuugggcaaacuggacauuugaagucuaauuuauacagucacauguccaaguguuauccuacacuguuagugagaaccuuuuggucuucuuccuaccucaaauguuaggacuucauauuagaucuuuuaaaagaugcaaugauaguacuauuaugguuuuacugucaauucuaggcuccauucuuuaauaaaacauaaguaugaaugaauguaaguuucaggauacaguaucccugaaagcuauguuuaauauacucaaaagucauuuucuagucccuaggaauaaauauuuaugguaaaagaacccuuuccuagauuucccccauggcauuaagaugguuuucucuuaguuucuuugaugccaaggguaggauuugauuccaggaaguucuuaucaccuacaauggguagaaugugaacuuguuaccuuuggcaaguuuucauuuuuccuugguggauuccuucugugacuccagguaucuugauaaugggagacugguuuauuuguucuuuaauugcccagauuucuuucaacugguaaaacaucauacuucuucagcaaaaggaauucuucuagcagagccuucauggaugauaucugucacacaugccagcaccugcaguuuggaaggcaguggugaauggauccaugcaauaugucuagaagacacaaggaugagccagccaccugaucuugucauuuauaaacuuuuaagaauuacucugguuuacuuuuggucugaaaauggaaaggcccaaauaaugaaauaaucuuuucagauuggaauuuuacauggccaugaaaauauuucuuucuauucagaagacugaaauagaggaagcuugagagacuccuuucuuuuaaaagcggcucucuguaucuguuucauuuaaaacauuugugggauugaaaaucaccuuaaugaaguaggcaaacauuuuuuuaaguaguagaggaaguccagaaaacuuaaugaaaugguuuuuuuuguugccugacacugaaaguaacuaguaaauaaagggugaacuucuuaauuauucgaaaacugcuuuuaauauuaggauauacucuuuuagcucaucuucgcuggucuugaggcuuauuauaauugucaaaucaacaaaguuucuaauagagaaguagaagaaauaucuuuugagauguaaguagcuuggucugucuucuaaaguaauacauaccuguuaaacuugagguauuuuuuucauacugaaggcauucuaaaguuugguacugucacaaaacaguaguuuacagagcagaagcacuuaguauuagaauaagccuguaggugugaaggaauaaguguugcaaaauaguuauuuauccaagcugucaauuaauugauugaaguaguuaucaaaauguuucuguuucuuucuuugguaucuauuaacuggucagucaaaagcuauuaaagaauguuuuuaaagucaccuaaugcugccaguuuguuaaauuugguauacauuuuaagaauagacauucuagaguuauuaauauggaagcagcuaaaauguuuuaggaaaucucaaaaguuuuagaagccacauuugcuaaagcauaaccugcacuuagucuuucuuggcuaucuguauuuuuuucucauuaauuauaaauaaauuuuuguuaaguauaguauuuaaaaguaaguuuaaagguucaauuugaacugaaauuuccccagagagcuuugaauucccauaagugauuacagcuuuuacucccgacuuguuuuuaguaaauguuaauaagacaauugguuuacaaacacauauaaauuaaaaaaaacaacuguccaucguuuuaggaagaacugaaggaacuaaaaaugauauuugcuuggaaauuaaguuaguugaacucuuugaaccacaguagaaaccgcuuuguguggccugugagauuauaagcuuuuuguuucagcuuugaagaugaaaagugauuuaaucucuuaaucucaugcuuugauugaauuuuagcucuguuccuuaaaauaugcaaaaggaaauguaagugcauuucuagucaccucaugccacuacaagcuauuuauuuaaaagugaaacuuuuuguauauuauugugaacugauuuguuuauuuaaacuuuuauuuuggugaauuuaccuuugaguuuuuuuauauuuuaugucacaaaaugaaguccuauauuuuucaguguuuaugaauauuaauauaaacuauuuuuuucuagaaugacuaauuguguaauaucuguauuaugugauaauuugaaaucuaauaaauauuuucuccaugaaaaaaaugcacuuacugauaauggcuuauuucuguuucaggaguagaaagugaaaacugcaacaguauuuuuaaauguauuuuaauuuucugugucuuucucuaaauauuucugaauauguauucuuucuguguguuaguuuuuuuuguuuuuuuuuuuuuuuuuuuuuuuuuuuuuuuuucagaaaaauacuuuuuugaacuguuaaggugauucuucgugggggucaccagugaauguaugaaauaggugaucuguuuuguauguuuuugcauuuuccugauuagcaucaucuuuccugauuaguuuccagaauuggacuuuuuuagaugcaauuuuuguaccucaauuuugcaaaccauuaaaacucucuugaguuaauacuguaaauaucaagaguaauuugaccaagucuuuuaaugcuagauugaucaaaauauaacucuuacagaauagcauccaaaaacaguuccuuuacccagaagaacauuugaaaauaauggcugauuagagaacuaugcaauucauaagaacuguugaaaugaaaaauguuuuguauuuuaguguucuacuugcgcaaauaauuguagugggagaaaucuuggccucauagucucuuguuuuuaaaucuuaucaagacagcauggagaaggguaauauuuaguuuuauugauucuuguuuuuauagcuacauaauuuuacuuaauugaagccacaggaacaauuuaccuuuucuaugcaggauuugcuuagaagcaagaggauuuccuuucagauuugaagaaaaguuauugaagaaauggacccccaaaauuaaaaauaacauuaagaugggguccuaggcaagaaguaaaaauugaauuaaugacaauugguggauuaaaauguaauaauuuggcuccccaaagaaauuaauacucugaaagaaaucaaauuucuaaaaggcaguuaugauuuagaauagcuguuguauugggggugggggaaaggaagcuaacauucuuggcuuuauuaaccugguaaguuuggaaaaaaaguaaagauucugugcacaaaauuuuguuuuuagaauuaaagcuauuaaaagguuuacagacacaguauauuucaaugaaaggcuguauuuuauuugaauauaaaaaaaaucuauaagcuuuuccuauauguguaugaaaggguagguugggcauggaaguuaaaauacacccugcauuggaaaccugaaaaauauugcaaagauaauggugacaugaguuuuuaaaaaguaauuuuuaaaacauagacucuccucuacaucaucaguaaccuucaaaauaaaaauacuacagaauguugaauuuggcuuaccauuguauuuuugagguauaggaacauaggcuuaugguuucaccaucacugacgagguuaacuauaguauaaaaaucuguuuugauuguucuuuaguaaggaaacaaaugguuuuuuuuguuuguuuguuuguuuguuuuuuguagcuucuguuuaaaaaaacaugacaagcagugugacugcaaaguccugacuuuauagguuauuguaaauauguacacagaucuuauuuucuuugccauauugaaauacucugacaaaugucagugcuuagauguccuaagcaauuuuuuuacuuuauuuuuauccagguauuuuuguuucccuuuaaaaauauuucauaguaauuuaguccuaaaaugugaaagacuuguuucaaaauucagcacuuagguacucuggaguguuuuuuccacuaauauguacaucuaagguaauuagauuacugcauuaaaaauguuagugaacuuugaaguauucaucggaguuuucaggaauuaugaucaaagggaucucugcugaagagguaagguauggcauagguagaaaaauauucaaaauauguuuaauguuuggauuauaauguaaacuacaacagguauccuuggguuuucagauagauggagaauuaggaaaauaauuuuucuuaaaacucucagagaagugaaauugauaaaccacaaauuuguuuuuguguggcuuuggagugcauuuagaaacauguccacagacauuguacucuguguauauguagccuccaauauuccaaggcauuuccuaccccugcucucagcauuuaugauucauauuuaauuucucaagccugagcacuguaaaaauacuguacuuugguaaguugaguauauauuucaugagauuauugccuggaauauuuuuggcaaaauuuuugcagauuuuggcaaagcaaaaggaaaguacaaucuccuuuuggcuguuuguauuaaaaucuagaacuuagaaaacaauugcuugacuuagaacuuuuauuuugguuugagaaauuaaggaauucuguaaauguuuacuuagcacuguaacucggaagucuuguacugaggaucaagaaauaauauuguugccugguauauaaaauaauugacaggagaaagugauauacuauuauucucuagggaauauuaaguagguucaaaggguuguguuaggauaauagcauaucuagaaacaaagaaaaaugcaauauugaauauggacaagauaggaaaauagauuaggacuuuucccccuagaauuaaauuacuaguguaauuuacucaauaaaggauaacaucgaaaaaugcaguaauccugcaucauguuuuugaguucuuuaaaaagaacugcuaguggacauuuuuggcuuuuuuuuuuuuuuuuuuuuaagacggggucucacagugucaccuaggcuggagugcaguagcaccauuauaguucaccaagugauccucucgccucaguuuuuucugcuacaggcgugcacugccaugucugcuuuuuuuuuuuuuuuucuccuugagacagggucuuacucugucgcucaggcugcagugcaguggcucaauccuggcuuacugcagccucgaacuccccagguucaggugauccuccuaccucagccucucaagcugggacuauagguaugcaccaccauacccagcuaauuuuuguauguuuuugcagagauggaguuuaugucgcccaggcugagaagugauccucccuccucagucuccuaaaauguugagauuacgggcaugggcuacugcuccuggccuggcuuuucuuaaaauaauuugcuauuuauuccaccuuaccuuuugauguagaaaaagugauaaugugaaucaacaugccaucauuaccuuugcuaaguccuuugugauagaacuuggcauuucauagcugauuccauguacauucaggauacuauuuuuguuuguuuguuuguuuguucuggagacaagagucucgcucuauugcccaggcuggagugccauggggcaaccucagcucacugcaaccaccaccuccuggguucaagugauucucccaccucagccucccgaguaccugggauuacaggcaccugccaucaugcucagcuaauuuauguauuuuuguagagauggggcuucaccaugguggccaggcaggucuugaacuccugaccucaggugauccacccgccucagccucccagagugcugggaaaggauacucuuugcuaagaaguugauucagaauuugcuuccaugccuuuuuuuuuuuuuuuaauuuuauuugauacagagucuuacucuuaccuaagcuggagugcaguggcaagaucucagcucacugcaacaucugccuccuggguucaagugguucucgccucagccucgugaguagcugggauuacaggcacggaccaccaugcccagcuaauuuuuuguacuucuaguagagaugagguuucaccauguuggccaggcuggucucgaacuccugaccucaagugauccauccaccucagccucccaaaguauugggauuacaggcagcggccaucaugccuggcuaaucaugcccucaagugaaccaccaugccuggcccccgcucccaugccauuuuuacuugaaaauuacuuuagaauucucuaguuuagcacccuuauuuuacaugcaagauaauugguauccaaaaauaccacauacguuucuaauaccacacucuuuuaaacaaauugucuguaguacucaagucucuucacuaccagauguaccacuuuacuacuuacugcugcuuguugauccuaguuugagacgacagagcaagucugaucccuuucaaaugugacagccuucaagauagcuauuaauuucccaucaauuccaagcccaagucuucuacauauuaaguauccccauauucuuaccucuuauucauguagcaugcuuuugagauccuuaaagauuuuguagaucgacugggugugguggcucacgccuguaaucccagcacuucgggaggcugaggcaggcggaucacaggucaggagaucgagaccauccuggcuaacacggugaaaccccgucuguacuaaaaauauuaaaaaaauagccgggcaugguggcgugcgccuauagucccagcuacucgggaggcugaggcaggagaauggcgaggaccugggaggcggagcuugcagugagccgagguggugccacugcacuccagccugggcgacagagcaagacuccgucucaaaaaaaaagauuuuguagaucuucugugagcgcacugcagcuucuguuagugugugacaccaaaccagcacauuacagaugugcucugccugggcuuauaacacgugaccuuauguuaccuuuggccuggaauacucauaccgcuuucuccuuaaauauuuauccaguaaagugcuugauuuuaugcauguugagauucuccuaggcaaagaaauuauagugauaugaaaaaguauuuuguuucuaaaaauuaggcuaguaguccguaucugcaaaguauuuguauuuugcacagcuuauaaaagaaauugacucaguguuacagccacaaccuugagaaaucauaaauacaaaaguacaguccccauuuaaguuauuuucaguuugcuuuaauucugacuuuaaauuguauauuaaauuguguaaacauaaaauguuauuuuucggguuguauuuacuaauuuaaggguaaccaggcuuguuggagacacuuguuaugugacugguauugagaagaaaauaaacuugaguuuaguaacauaauuaaaauuaguggaaaaguguaggacauauaucaaauagcagaagauggugaagaaguaguccugaaaguuugagaauauggccuaaguucuaauucaggcacagucuuguguugcauauugaaauacagugcaaacauucugcuauagcaacauuauuuuaguauaauagugcuuuuaauuaccauuuaaaauauuuaucauuccucccccaaaucuugaacuccuggaagacaugagguguuuuauuuauuuaaugguugcauguacaucuaaggguauagauaccccaauuugagaaacacugguugaguuaggauauauccugucuugccugauuuagaaagaauuugggggaaaauaagaacaaacauuuacauaccuacuaaguguaccuuugcuagaugcuucagguauauuuaccuaauuuaauugaguuaaccugugagaaaggugauaauuuuuucauuuuacacauaaaaauguugaagcucagaguuuacaagaccuggccaaggacauauaaucuguaagcaaugaagauggcauuccaaggcagaucuguugaucuauuacaccauugauaaugcauuugcauauucucagaauuucauauagaaccucagugucugaauuaaaggguuauuuuaguauuuuuaauagacuuuuaaaaaagagcaguuuuacauuuauggaauaguugaccaguaaguguagagaguucccauuuaccuccuccucccucccacaguuuccuguuaccaucuuguguuaguguguuauauuuguuauaauugaugaaccaguauugaucaauuauuaauuaaagucuauaguuuacauugggguucaugcuuucugucgugcaguucuauagguucugucaaauacaugucacguauucaccauuaguaucauacagaauaguuugaccuagaaauguccuuuguucccuuauuugugugauggcuggaucauaugguaagucagugcuuagcuuugcaguacagaaacugccaaacugucuucuaaagugacuuuaccauuuugcauucccaucagcaaugaaugugauuucuguugcuccacauucucaccagcauuugauguuaucauuugguuguagcuacucuaauagguguguagugguaucucauuguuuuaauuugcaauucccuaaugauauaugauguugaacaucuucucauacacuuuccacucaaucugcugagugucugcuuaaauuauuuacccauuuuaaaaaucagguuuguuuuuuuuuuuugaguuuuaagaguucuugauauauuuuggauaccagcuuuuuaucggguguuugguaaauguuuuaucccaaucuguggcuugucuucucguucucuuaauauugucuuuugcaaagaaauuuuaauaaagucugccuuuacugggucaugauuuuggugguguaucuaaaaauuuaaggccaccuagauuuuccccuguuuuauauccuacagauuuuuuuuuaaguuuugugauuuacauuuagaucuaugacuuggucucaguuuuugugaaagggguaagguuuguguuuacauugauuuuuggggggaugagggacauaugauguccaguuguuccagcaccauuuguugaagacuguucuuucuccaugaauugccuuugcucucuuuucaaaggucuguugacuauaugugguucuacaucugggcucuuuauuccauuccacugaucuuuucuuugccaauaucauacuguguugaauacugaagcuuuuuacuaagucuugaagucuggagaguguaaauccucugacuugguucuucgguaucguguuggccauuuuggaccuuuugcuuuuccacauagacuuucaaaucaguuugccuguauccaccaugccaggauuuugacugggauugcacugaaucuaaagaucaaguugggaagaauugacaucuuagcauuauugaguauuccuaucuauaaacauggaauaucucuccauuuuuucagaucuuugauuuuugauuagcauuuuuuagcuuuuuccuuauauagaccuuauaugagauccuauuuuguuagauuuauaccaaaguguuuaauuucuugguguuaauguaaaugguguuuuaauuuccaauuccaauuguucauugcugguguaugggaaagcaauugacuuguguacuaaccuuauauucuucaaccuugcuauagguguuaguugcaggaaucuuuuccuugauuccuugcgguuuucaacauacacaaucauaucaucugcaaacaaguuuuauuuguuccuuuucaaucugcauaccuuucauucuguuugcuuauugcacuagcuaggacuucccaguauaauguugaauugggguggugagaggagacauccuugucuuguucccaauauuaggggaaagcauccuucuucaccaacaagaaagacauuucucaacaguaagugagauguucacuguagguuuuuuuuuguugauacucuuuaucagguugagggaguuucccucucuuccuaguuugcccagaguuuuuaugaauggauguuggauuuuugucaugugcuuuuucugcauuuauugauaggaucacaugauuuuucuuuagccuauugauguaguagauuuuauagauugacuuuugaaugucaaaccagccucguauauauggaaaaaucucacuuggucaugguguagaauuuuuuuuauacauuguuggauuugauuuguauuuugucaaggauuuuugcaucaauauuaaugagagauuagucuguaauuugccuuucuaguauuaucuuuuucuaguucuguuacaaaggccucacagaaugagcuaggaauuguuuacuguuucugcuuucuaaagagauuauagagaauugguaucauaucaugagauaccugguagaacucuacaugggaagguuauuaaugauugauucaauuucuuuaauagauaugggccuauucaguuuaucuguuuuuucccaugugaauuuugauagauuauucaaggaauuugcccauuucaucuaacuuaacaaauuuguggagacagaacugcucauaacacuuguuauucuuuuaauacccaugggaucaguagucaugcuuuuugauuugugguauuauuuuuuggugucuuuuauuggcuagccuggcccuaaguuuaucaguuuuauugaucaaagaacuagauuuugguuuuguugauuuuucuguauuaacauguuuucaguuucauugauuucugaucugauuucuuuuucuguuugcuuuagauuuauauugcucuucuguuucaguuuuccuagauuauugguuuucagucuucuuuuauaugcuuucaguguuauaaauuucccucuagcacuguuucugcugcauuccaaaaauuuugauaaacuauuuuuauuuucauuuaguuugaaacaauuaaaaaaauugaggcuucuuugaccgauguuauauuuagaaguguauuuuuaaauuucuaaguauuuuguggguuugcaacuaucuguaaauauuugguauguguuauugauuuuuaguuuaauuccauugugggcugaaagcuugguuuguauucuuuuacauuuguuuuauguuuuuauugcccagaauguggucuguuuuggugaacauuuaugugagcuugagaagaauguguauucuguuuguuguuggaugaaguagccuauagaugucaauuagauccuguugauugauggugcuguuuaguucaauuauguccuuaccgauuuucugccuucuggaucugucaauuccugauugagggguguuuaagucuuuaacuaugauaguggauuugacuaguccuccuuacauuucuaucaguuuuugucucauauuuugaugcucuauugcuaggcacauacauauuaagaaugguuaugucuucuuggaguauuggccccuuuaucauaaugaaaugcccuuugucuuugauaacuuucccuguucugaggucugcuuugagauuaaugcaguuauucccacuuuguuuugauuaguguuagcauagcauaucugucccuauccuuuuacuuuuaaccucuauguguuuuuauauuuaaaauggguuucuuguagccaacauauaguguacagucggaucuuguuguuuuaaauccacuuugaaagucucuguguuuuaauugguguauuuaagcuguucacauuuaaaaugauuauugauuuaguuggauuaguuaucuggucuagguuugcagcuuuucuguucauugcucuuguucuuuuuuaaaaaauuuauuuugccuuccacucuuuuucugccuucucuguuauuaguugaacauuuuaaauaauuccauuuucugucuguucauagcauaucaauuauacuuaaaaaauuuuuguuuuaguugcccuagaguuggcaguguacauuuacaacgaauccaccuucaauuaacauuaaaacuguuuuaugggcagugcugguaccuuauaacauagcauuaccaauuauuucucccauuuuuuauaacacugcuguuuuuuauuuugcuuuuccauaaauuauaauuauucaauauauuguugaugucauuauuuugaacaaauuuauguguuagaucaguuaagaauuuuuaaaauaaacguuuuguuuuuaucuuuuauucuuuaaugcuuuuccuuugugcagaucgguaaccuauauuuuccuucuuucagaagaacuuuuaacauuuuuuucaagacaggucuaguagugacaaauucucuauuuuuaucugagaaagucuuuuuuucucuuauacuuuucaagaauuuugcuguaugcagaauuguagguugcuaguuuuuucuuucagcacuaaauauuuaacuucaaucuucuugcuugcaugguuccugaagaaaugucugauguaauucuuauccuuguuccucaauagguaagguuucucuuaacuaccaucuguggcuucuuuaaguaucuuuuuguugucuuugauuuucugcagauugaauaugacaugccuaaguguagauuuuugguauuuaucuuaugucauguucuccaaacuuucugccucugugauuuggugucugucauaaauguuggaaaguuuucagccauuuuuucuucgauuacuauuuuaaugauuuuucagcuuuacaauggugcaaaagcaauaugcauucaguagaaaccauacuucucuugcuaugcugggcagcagcaagccucagcuuccagucagcuaugccuuuuugacugacaguauuuucacucaggauggacuuacugggacuuaaguggaggagcaucuguauucuguuuccuucucucuuucuuuucugucuuggauuccuauuaugcauacauuuuaccuuuuuaaauuguccuacagucuuaggauauucuauuccuuuuuuuuuucuuugcuuuucaguuuuggaaguuuuuauugacguaucuuugagcucacugauucuuaggccaugugcagaugaucugguaauaugcauucuuuuuuucuguugcuguuuuuuuuuauuucuggcauuuccuuuugauucucagaauuuucaucucuuugcuuauauuacccaucaauucuuaacauguucucuacuuuuuccacuagagcccuuagcauguuaguaguuauuugcaauuguuggccuaauaauugcaaaauaucugccauaucugaaucugauucugacacuugcuuuggauccucagacuguuuuauuuuuccuaaccuuuuagcaugucuaaugguguuuuuuguuuguuuguuuguuuguuuuugagacagggucucacucuguuauccaggcuggaguacaguggcacagucuuggcuaacugcaaccuccacuucccggucucaagagauucuccagccucagccucgugaggagcugggacugcaggcgcaagccaccaacaccuggcuaauuuuucuauuuuuguagagauggguuuuugccauguuguccagacuagguucaaacuccugagaucaaggcaguccgcucaccuuagccucccaaaaugcugggauuacaggugugaaccacugagccuggcuauuuuuuuuuuuuuuuuuuuuuuguuaaaagcuagauaugauguauuggguaaaaggaacuaagaucaguaggacuugaguaugaaguuucauguuuaucuggcuagggguuaaucuguguuuauuugcuguugaugucagaggcuagaauuuccuauaguguccuugaucuugucuacucugugguauuuggguuucccuagagacucccuuuuauuuuuacuuuuuuagagacagggucuugcuguguuacccaggcuagagugcaguggcacgaucauggcuuacugcagccuucaacuccuggguucaagggauccuccugccucaggcucuugagaagaugguacuacaggcaugcgccuccaugcuuggcuaauuuaucuuuugauuuuuguagaggugggggcucacuguguugcuaggcuggucuugaauuccugggcucaagugauccuccugccucgguuucccaaagugcugugauuacaggcaugagacuccuuuuuaaauagagccugagccuuaccauucuuucaguugugauuuccuguuuuacaggagcucuguugauuguaguaagaugaguguuguggagcggggagaauagucuguauguaguccugugauuaggcucagguuuuuugugggacagugccccugggcuuucaccuuuacaaaugcuucucagcuuuuuuaccccccuuagguggaacaagaaagcuagagagagaacccuaguuggauauuuuccuuauuccacuuggucaggcuuugauauacccgcuguugguuagccucugguaaaauaauuuuccuuaaggucaguccuuuguuaaggauaacagaauguucugggaauauuugaauaugguuacuuuuuccuuuuuuccuuucuccuuccagaagcacagggauuuuuuucucuuuucuuuacccugacaaccugauggggcuuuuggaguuaaaaaucauggaaguagcugggcacgguggcucacgccuguaaucccagcacuugggaggccuaggcagauggauuacuugaagucagggguuugagaccagccuagccaacauggugaaaccucaucucuucuaaaauaauacaaaaauuagcugggcauggcgggugcuguuaauacucaggaggcugaggcaggagaauugcuugaauccgggaagcggagguugcagugagccaagaucgcgccauugcacucuagccugggugacaagagugaaacuccaucucaaacaaacaaacaaaaaaaaucauggaaguguggggagccccuuaaggcugguuugccaggaguuuccaucugucaaacuaguccauauuuagacugucuuaauuaaucuauuuaaguuuuucuuccaguuguuggcuucagcaauaguugcugcuucugguaagcugugauuuucuguauuugcuuguuucuuuaguuuuggaggaggcagcagauuguccugugaucucgguucucugauggaucuaagagaagcuacugauuuccaguucaguuuuuuuuuuuuucuguuguguggacaggagugacagcuucacuaguugaacucaaaacuggaaguaguaugaauuuuucagugucugaauuugccuucaauuuaguuugagucccacgacuuagaaguaggcuguucuacuaggagcuuuuuaaaccauuacaguuauuuaauuugauucauuuaaucucuauugaggaucuacuaaguuucaugcaucuuuuauuauguauaguauuucaugcacuggaaauauuaagaugcuucuauccccauacuucuuuuuucaaaggcuuuuucucauuguucucuagaggaugggucuaucucuuauauuuugcuaaagauuuguugccuuuuguauuuuaucuuuccuucuauuagcaaauguuuuucucuauuagcucauucucaugaguaucuaauuaugcuuucauacaucaucuuaaggaagccaccuugggucuuuccacacccccuaacuucugcaaucucuguucacuuucauuaucaagaguugucuacuuauauuguuacaaucucucaaauuuaguuuacuuuucaaucuauuccauucugguugucgcuucugauaccacugugaaugcucugucaucaggguccucccuguugcaaaauccuucuucucugcgugccacauacuccuaccuccccaccucaggcucuggcagccacagaucuuacuaucugucuaguuuugccuuuccuggaaugucauaguguuggagucaugcaguguguagcuuuuucagacuggcuuucacuuagcaauaugaaaguuuuuuucaugucuuuuugugacuugggagcucauuucuuauuauuguauauaucuaccacaguuuguuuauccaucaucuaaugaaggacagcuugguugcuugauguuuuuggcaguucugaauaaagcugccgcaaacauuccugugcagguuuuuauguggacuuguuuucaacucauuugggaaaauaccugugugugcaauugcugagucauguaguaagccugugcuuagcucuguaagagacugcagacugucucaacucgacuguacuguuuuugcauuuccaccagcaaugaauaugaauucauuugcucugcauucuuagcagcauuugguguugucagugauuguagccugucuaauaggggugugguaguauccauuguuuuaauuagcauuucucuagugauauaggguguugagcuccauuucauguuuuuuuuuuuucucuauuaucuuuggugauacaucugcucagauuuuuugcucuuuuuuaagauuuuuucuuuauuguguguuaagaguucuugguauauuuuagauaccaguccuuuauaagauguguuugacaaauauuuucuccuagucuguggcuugucuuuucauuuuuuuuaaacaguguuuuacagagaagaaaaauuuucaauuuuaaugaagucuaccuuaucaauuuuuucuuuaugggucaugauuuucgugcuguguuuacaaauauauugccaaacaagauuuucuuccucauuaucuacaaguuuuacaguuuugaauuguauguauaggucugugauacuuucugaguuaacuuuugugaaagauaaaaggucaguguuggauagauuauuuuuccuuuugcaugugguuguccagcaccaugaagacucuuccuucuccacugaauugucuuuguacuuuugccaaagaucagauuuaccucuuaaaucuuugucaaaccuguccacuucucaccaucuccauuuucaaucucuucaagccaccauccucucuugccuaauuauugcaguaguccuuacuggucuugccuuaucuguugaucccuguuuuauucacagaauaugauuugugauuuuaaaggcauaaauaaaaugccuuuucuguuuaauaucuaauugcuuuccuuuauacaaacaacaaaauccaaauucuuuaucauggccugugagacccuaaaugaucaggcccuaccuuuucuuccaacuuuacccucauucuuccucuccagccaccuuuggcucauuuagucucugaauguguuacugucuacuaccuuaggggauuccuaaugacuggaaugccccuuuuaagucucagcuuaaauguuuccucuucagggaugccuuuucuagucauuauaucuaaacauuuaguucucuuccuugacuuuuacucucuaacauuacaucaauucuuuacuacuauuuugcccaauuuaaaagcauauauuguuggucuauuuauugucugacuuccugagaccagggaucacgucugucuuguuugcuauuguuuuuuuuagcagcugcuacacaguaggcgccaaacaaauauuuuaaggaagaagacauaggcagccuuugagaugcccaaauuuagugaggaagauccauauguauguagguaaauuauagugccauuuuagugcuguuagaaaguuguaguuuuggaaaacaaguaaugaaagguuaagaaagaaaaaucuuucggauucuuccucaagugugugaacuuuauagcugucaauuuaugaagucuuauugccuagguuucuuuuuuuuuuuuuuuccauucuuugucacuuuuauucaguagguuuuuuuucccuuauuuucagugccagacauggcgaggagugauuacagccaacuguuauuaaaacauuuguucacaacauauacccccuuuauaccacugaccccaaacugacucauuuuaugugcuuucauucuuucuuuuuuuaauauaccacuaucaagaccggguggagggggcaaggguaagagagaugaaggggaggaguccaggaggccagaagaggggaaugcuacaagccacaguaagaaugagcuguauuuaauuuaaaaaaaagggggaagggguguaccccacaaaugauacaguaaugaggauacacaauuaaaucccauagcaugacugaaagcuuucacuguguuugacaucaucacaauggaauugccuagguuucuuagcuaaaaguaaguuuguaucuuuuauuauuugauagugggggguuagcguccuagaagucccagacuuagguucucaauugucuuaagaaaccauccaucuguauugacaauaugggugcucuaggggcagucuuaagcccaauaagaggucuuuuagcgcacugagcuuuugcucucuagggucaguguuuggauuugaauauccagcacugccacucaccuugggcaagucauuuaaacugcaugucucaguuuccucaucugcaaagggacuaauaaacacaccuaccuccugggaugguuuugaggaauacauuggcuaauauauguaaagcauuuacuaugugccagacccugcaauaaaugugaaaguagucucuguuacuacauaaagggcuucucauuuagccaaaauuuuauuacauucuaguacacuuacguugaguaauaugcagcuuuuucaguggauacuucauuucaaccuuacagagaaauuagaaaccaucagaugggauauccuucauucugauaccaaacauaaaucugacauguucaacaccccuuccuucagcuucaccuaugcucuauaucuuaucaccucugcuaucugagaucuuaagauuuuuaaaaaauuacuucuuucucauauuuaacuuuuuccuuucaacuagauccuucucuuaugcauagaagcauguuaaaguuugucuaaaacuuucauugauuuauaucuagcuacuuccccaugcuuccucugcauacccaaacuuaaaaacucuguaaucucuccauuccuccccuacucagcccacuugaaucuugcuuccaccucugauaaccucacugaaauaauacuauugagguuauuaguagaucaaguggacagcuuuguaucuagucauauguguacccucagcagcauuugaaacaguagacuacauucucucuucacacuuugggugcuauuaaucuuuaguccucugauuuccugucuuucuggccaguuuuuagucugauucgcagacucauucucacucuaccuggacuuuauauaugggaguuucuuaggcaggguccuugguuaucaugugucaauucucugggcauuucuaccaauaccacagauugaauaccuucacacagaugacucguguuuauaacacugaucaacuucauagaucuaccuauuugacuucucuuuuugggugucccaggagcacuucaaacaugcuuuaugaauuuaugaucuucgccuucaaaucugguuuucuuuugggagaucucaucuuagugacugucacccacauguguucaguuauguaugcuggaaaccugggugucguauuucaguauaucuguaguccuuacaccauaauccaucaucuaguccuguugguuuuuuuacgggcuggagggcugaaauaucucagccauauauccuguugucauuaccuugucucaauccaugauuuccuaacuuggaugcaagaguucuaauuggucuccuuguauauaaccuuaugcuaaugaaauucauucuccagaauuuggcuggagugauguuauuccuuuaauuaaaacauuauauuggcuuccaauuaauuuugggauucauggguaggguagagacaaaaauucuugcuauaauuuuugaaaaccugagagucgccauuuaccuuuccagucuuaccuuugaccacuuuuuggcugucucuuuugcccauuuacuuacuucagggacgucucuugugauguucuugaauaggugagaucauucuguuugcugucauugugccauguauacuccauuuuguauacuccugguuuuacauuuuugcgugccauuucucccuguagcuaaaauccugugagagaccaggaucuuguuuacuuuugcuuaccauuugccauugcuuauuagcauagcuaauuggcuuauacccuucauacauugaauuuuaagaugucagccuuauuuuucauuuacuaugaaaaaaagggaaggaaaguaaucagugaaagaagaaaccuaacaugauagauguaaaacauacugcuuugaaucaaugaaagauaagaucacaaugauauuguugaaaucauuuucuguaaaagcugaacuaacuuaaacuauaacauccucucccagccccuugcuuuucuauaaugguaaaauaaaugcuauugaagaaaaaaaauuuagaccgguucuagauucuaacaccuuaagaaaauaauuggcacuaaauccacuguuucaggccuuucaaaacugaaaaauuacauuguguuucuaacauugaaaauaaaguuucaagauaguuuuaauuaauuuggauauaaguauagaagguuugaccacuuucagaacucucaggugauuuugacuugugaucaucucugggaagggauauuuagugauagccugaauuuuaaaaaccucaacuugaacacugggaguugaugggagaccaucugauuaagggauggacuaaguaaguguaccagugucaguuugccuauuaaauacaaucaaagcgcaaugucuuuccuuuuaagauaaaaaaccaguaauuuggauaauauuuuaauucagcaccaaguagauuguuucucacaccuguguuggaaguuacugguuuagaguaugguuuaaaauuuuuuucucucauaggccuuuaaaauuaaaauaauuugcauguuaauuaaauuccagccuuaauaggguuuuccaucaccuuaauucccacauuuguuuuucauuuccaacaucuuugaacuuuuauugaauaaaauaauuguacaaucuuagauaaauauuaaaccaaaauuugaugaaaguaauacugcauucaugauacuuugcuagcuagauacuauaauuagaacugaaugaaauaaacaaccuguuuuuaauuuuucccuuuuuugagggaugacacaguuugccuaauuagaaauaccuuuugugacugucguuuguuuaccucuauuuugcagcagcauagcacuucugagauguuuaacuucuuuuuucaucaaaauuauuuugaacaugcugacauaucuuugagauuuaauuccuagucauuuaaagaaaauaaggggcuaggggugguggcucacuucuguaaucccaacacuuggaggccaacgcuggaggaucacuugaguccaggaguuugagaccagccuggacaacauagagaccugucucuacaaaaaaaaaaaaaguuagcugggcgugguggugcacgucuauagccccagcuacucuggaggcuaaggugagaggauugcuugagccugggagguccgugucugcagugagcugugauccugccaaugcacucagccucggcucagugagaccuuguuaaaaaaaaaaaaaaaaaaaaaauauauauauauauauauauauauauauacacacacacacacacacauauauauguguguauauauauguauauauauguguauauauauauauacacacacacauauauacguauauauguauauauauauaguauuaagcuggaaaauacuuaaacuuuuuuuuuuuuucuuuugauagaaacaggguuucaccauguuggccaggcuggucuugaacuccugaccuccagugauccacccaccucagucucccaaagugcugggauuauaggcgcaagccaccgcaccuggcccggaaaauacuucaaaaugcucagguuuugauugaucaauggauaguaauccugcacauuuucaguuugaaaauuuaacaauucuguuguuauugauaugucuugccaauuguagauaauuucuugugggaaauuuucuaauuuaugcuuacuguuuauuuuuucuaaucuuuacccaauuuuugugaggaaggaguacauuuguguguguguguguguguguguguguuuuguuuuuguuuuuacgguaacgaugguuacuauugcucucuguuuuagaaguaauggucauacauaagagcacauuguguacaaaaauaaauauuaguuuguaaaauagguuguaguacaggaugaauagagagguuugaaaaauagguccguuuccauuauuuccuuuaaaaugcauauacacacauauaaucuagaucaaauuuuuauauacagguauacauguguauacacacaaacacacacguguauaucucuguguaaaccuuucauugaucucagaccaggaagggaacaugauggaucaggcagcuguacuuccagguugcuuuuuuaggauuguugcccugguguagagcugagaucagcagguggcaggaagaaggcggggugacuaacugggcaggacuuaggaagagacugcuaucccuuucuuccuccaucuuauagguaauugaucugcuuuugcugaaauguuuucugcuuugauaagcuucuguuguuaguaguguugcuguuuccagaaauaggaggagaaaugaagggaauuacagagggaaaauuuaacuuuuaaaaauccugccuuugagggaagaaaacuaagugccucagccucauuucuucugcuuaauggauucuugaugggguacuuuaaaaaaugucucuuuauacauuuugcuaauuuuaacaaagguagaucaagugaguauucacuuguaauauuaguuugcuuuuuuuuccccccauaaaaagaauauuucuuuacugguauaaugcagucacuggugugcuuugaaaauggccugggugucuuugauguguugggguguccuggguuucuuuucugucugauggccaccauguggcuaguuuccauaagccuuuaugccgaaguccccuuugggagcuugauuucaagucuucaggaacuuuuauuuauuaagagauuuuaaaaagacuauuaagagaauuuguuuuuaaaaagcagguucuucagaauuagagggagguaaccugugguagaggggagcugguaaagggaggugcuuucucaccauucagcgucaauuucuagugcccccaaagucucaaguaaacuaaugauguucaacaagagaacuuuuuuuuuaguagcauaggugcuaaaguucugcaggucaaguaauguauuauuccggggauacugcauacuacuaauagcuaaaacacuugaaaccacuuuuugggaauuggauauguuuuuauuaaaaucaaccccacuuucuauuucagcuguucauuucaaaaaguauuagaaaacaugaaaaguuugccuacucuugaaaauaguauacuagaaguguggauuuuguuuauauuaauauccuuauuucucccucugugaaguucuacugcuuauuugaagugaggugguuuuucuuuugaaaauuuguaauagguguaaaaugguacauauugcaaaguuuugcucuuauaccuguuuuaaauucaccaaauacuucucaccuuccuagcccuaggcagccacuauuaaguuuuuuauauguuauuucagauauauacauauucaugcaauuaagaauuuuuuucacuuaggccaggcaugguagcucacaccugcaaucccagcacuuugggaggccaaggugggugaucacuugaggccaggaguucgaggccagccuggccaacauggcaaaacccugucucuauuaaaaauaccaaaauuagccggguaugguggcacaugucuguaauuccagcuacuugggagucugagguaggagaaucacuugaacccagaagguggaggcugcagagaaccgagauugugccacugcacuccagccugggugaaagaaagaacugucucaaaaaaaaaaaaagauuuuuuucacuuaaaauuuuacacaaaacuuguacacuauauaugcuguucugcucuuugcuuuuuuuucacuuaauauuucuuggccaucuuuccauauaguaaauagaugacuaccuuauucuuuuuaaaaaaaaaauaguuguagaggauugugucucauggauauaccacauuuuacuuaaccaaucucuaaucaaugcuuauuuuagauaguuuauuaucuuuugcuacuaaauauaauacuguagugaguaacuuuguacaggugucguuccugucuaucugcauauauauauucauaaguuaaauucccagaaguagaauugcugggacaaaggguaugauuuuauaauuuugaugacuauugucaaauugcccucuauaggaguugcaccagauuacccucccacuagcaauggaugagaaugccucuuuuccugcugccuuaucauuagaguaugccauuaaacaucuggauuuuugcuuaucuauuagguuaauacuguaucucagaguaauuuuaauuugcauguuuuuaauaaaugacuuuaaacuucuuuuauuuauuuauuuuuuucuuugagacaggaucuuguucugucaccuaggcuggagugcauuggugcgaucucggcucacugcaaccuccgucuccuggguacaagcaauucuccugcgucagccuccugaguagcuggaauuacaggugcauaccaccauguccagcuaauuuuuauauuuuuuguagagacgugguuucaccuuguuggccaggcgagucuugaacuccugaccucaaguguucugcccccuuuggccucccaaaguguugggauuacaggugugagucacgguaccuggccuaaacuucuuuuuauaaauauuuguguuuccguauacugucaguuuguaucaucguguguguguguauguguguguuuuggauuagcccuuugucagugauaugaguaguaaacguuuuucccaguuugauauuuaucuuuugaucuuguucauggugguuuuuuugugugugugugauguggggggcaugcauagguuuuuuuuauguagucaaauucaucaaaguuuccuuuuaugacuagaauuuugaguagggaagaucuuguuuacuucaaggcgauaaaggaauuauuuuacauuuacuuuauugauucuuuuuuuuuccuacauaaaucuuaacuccuuugaaauugauuuuggugcacugaguggauucaauuguauuuuuuugcagauggcuucuaguuguucuaauaacacuuaaugaauaauucauauuuucuccagaucaucagaucauauucagaaugaguuuuaauuggaauguccuucaaauuugcauauaagggugauagaauaaaugaguaauagaaaagguaacauuuucuauucucaguuuccuuguuaguugaguugccaaaacuuuaguugucuauaccugcaaguugaaaggaacuuuuagcaacuuuucuacuacaugguuugaguuugguguggguuauccucaagguuuaucuauuaaaacuguuuuuaauuggugucugagguuauuugugcuuacugaaguaacuugucaucugaauucucuuuucccgaaggccuuaauuagcugagaacaaaguuaaaagaaguuagaagagaaaagauucucuacugcgguucagcauugcccugguugauacugcuuauggugacuguaguuggauaugucuccuguuguuaggguuuccagugguuuacacaaacucugaaucugaaugaaaaaacauagccaggguuuauaaguggaucucuguccuagccaauucacuuuauuucuggaguguuuucuauugcuaaauauuucacucuauuuuguuaggccauuuucuucccaaucuaguuaucuccacauuuucaaguaugaagaccuauuucuguuaucaaaaaaagucacagguuauguguuuuguguauugugacuuuugaaaauacaugacaaaaaccuaucauuucuagcagugauuuaaauugguauaguauugaucaccaaaaacauuuauauauguuuggaaaaguauguucauguuugagauauaaagcaugaggcaauuauuagucacauguuagaucacauauaagugauuuuaaugaacuccuagaugcaguaaagcaaaaugguaucagagagacaaucccuucucucaugcagaagcucacuuaauaggauaaagacaaccauuacaaggacauuuuuuaguguuaggggaaguagaggaguacugugagaucaauugcaguuaaauccaaccugaccuagagaaugggcaagaccuuccugaggaugugacauuuaagcugauuucugaaaagaauuggugaaaguuaggacuggaggugagaaagucaacuaggaagcaauuucaggauuuaggaaggagcuaaccugauccugaauuaggacacaggcuuuagagauaagaaugaagaggccaggcgcaguggcucacgccuguaaucccagcacuuugggaggccgaggcaggcagaucacaaggucaagagaucgagaccauccuggccaacauggugaaacccugucucuacuaaaaauacaauaauuagcugggcgugauggcgcacgccuguagucccagcuacuugggaggcugaggcaggagaauugcuugaaccugggaggcagagguugcagugaguugagaucgcgucgcugcacuggugacagagcaagacuccaucucaaaaaacaaaacaaaaaagauugcuuuuacuaaggaauuccuaagucuuguuaauuuauagauguagauguagagaaagggaugaagauaaucugauuuuccaggugggaagugguucuguuucacaguaauagggaauauaggagaaacagguuuacagaggaaacacuaagcuuaaggcauguugaguuugaaauaaauauccaaggcugggcgcgguggcucacaccuguaaucccagcacuuugggaggccgaggcgggcggaucacgaggucaggagaucgagaccauccuggcuaacacggugaaaccccgucucuacuaaaaauacaaaaaauuagccgggcgcggugaugggcgccuguagucccagcuacucgggaggcugaggcaggagaauggcgugaaccugggaggcggagcuugcagugagccaagauagcgccauugcacuccggccugggcgaaagagcaagacuccgucucaaaaacaaacaaaaaaagaaaacaaacaaacaaaaaaagaaauaaauauccaaguagagauggccagugggcguucaaauuugaguuugaagauugggauacaauucugaaaugaagauguugauggugggagcugucaucuuaagugauaauuaaagcugugagaauaaaugcgauugcccugaaaauguguguagaaugagaaugagaaaagcagaagguugaagguacaacuuuugggagcauuggcauuuaaaggggauggaagauccuaauucugcccuuugcuuggguagcuccuguuuaucuaaauugcucuccaagcucuucacuuaaccaaauauaaucaggcccuccuucagugucugaauuaaaacuuaccuucaugaauccauuucuacuacuuccucuaaagauuguuuuaaaaagcauucauugguggcagcauuuaaaaaaaaucauaaauucuacuucagagauucccagguuuuuuggcuugguugucugauuccugauuguuuaacaacaacaaaaaaguguguguguguguguguguguguguguguguauuucuuuuuauucagaaagcugucauuuagauggauagguguuuuuggauugucauauugaacaauuacuauaugucaauuaguuauaugccagauguuagcgauaaauaaaacuuggcuccugaucuuagaguaccaacaacuuaauugagaugauagacagcuggguggauguuuuaugacguucauagcuuucuuuucccaaauauaaguuagaaguaaacuucuuccuuucccacuauuacugugacaugagcucagcuauagaaaagcagaagaauuacaggcaaagguuuuuguuuauguuguuugaaaauuuuuuuugguuuuuuuuugaaacagguucucacucuguugcccagucugaaguguaguggugugaucauggucacugcagcugcaaccucccgggcucaagcaauccuccagccucucagccuccugaguagcugggauuacaggugcgcaccaccaugcccggcuaauauuuuguauuuuuuuguagagauaggguuuugccguguugcccaggauggucucccugggcuuaagugauccucccaccucugccucccagaacgcugggauugcagguguaaaccaccacauuggccugaaaauguuugaaauuauacuugguauauacaauuuuucauaauuuuuucacaaauuaccacgaguucuucagaaacauugugaguuucuuauaaaaaacauauggcugggcuggacaugauggcucgugccuguaauuccagcacuugggaggcugaauugggcagaucaccugaggucaggaguuugagaccagccuggucaacauggggaaacccugucuguaccaaaaaauauacaaaaauuagcugggugugguggugcauuccuguaguuccagcuacucaggaggcugaggcaggagaaucccuugaaccugggagguggagguuguagugagccgagaucaugccacuucacuccagccugggcaacagagagaacuugucuccaaacaaaacaaaacaaaacaaaacauauggcuguaccagagcuuuauucuuauugccugauguucauuucauuuucuacuauauuuauaaauagugcugugaagaacauucauauuugugcauuaaucuuuuuagacacuuaggauuauuucguuagaguuaauucacagaagugcaauugcagggccgaagaguaugaacauuuuuuguuuuuuuuuugagacggaguuucacucuuguugcuccugcuggagugcacuggcgcaaucuugguucacugcaacccccgccucgcagguucaagugauucuccugccucagccuccugaguagcugggauuauaggcaugcgccaccacgcccggcuaauuuuguauuuuuuuuuuuuuuuuaguagacaggguuucuccauguuggucaggcuggucucgaucucccgaccucaggugauccacccgccucagccucccagagugcuaggauuacaggugugagccaccgugccuagcggaguauaaacauuuuuaagacuccuaauauaugcugacaaguuccuuuuccaaagggccuugacuauagcuucacuagcaaaguacaugagaacucauuuuccuugcccagguuauuuuuuuuuuuuagcuuuuuuuuuuuuuuuuuuuuugcuuauuuucuaguuugacaggugaaaauaauaucuuguuuuaauaauguaaguuuauuagugaagcuaaacauguuaaaaauauauuucuuucaacugucucuuuuuucuguuagugaaccauuacauauucuuacugcaucuucaauuuaauagauuuagaagguaucuuucuuagcuuuuauguuuuuucauggugaaaaauugucuuacagaucuguugaaacuuuccuauuccuugaaaaaaaaccugguaaaauacacauaauauaaaauucaccaucuuaaccauuuuuaaguguauaaaauaauggauggagucucgcucugucgcccaggcuggagugcaguggcacgaucuuggcucacugcaaccuccgccuccuggguucaagcgauucuccugccucagccuccugaguagcugggacuacaggcgcccgccaccacguccggcucauuuuuuguauuuuuaauagagacgggguuucaccauguugaccagacuggucucaaacuccugaccucaagugaucugccugccuuggccucccaaagugcugggauuacaggcgugagccaccacgcccugccuuauacacuucuuaaauguacaguucaguggcauuaaguauauucacauuguugugcaaccaucaccagcguccuacccucuucaucauuuugauuacuccuccagcguaauaaucuuggcuucagaauucacugguauugacuguagcauuguuaguguuagugcaccauuuugggggggguacuguuuuguuucuaauaauuuuauuggccugucugaguguggaagcgcacuggguaaaguugagauuuucacuuuauauugggucuuggguuguuugauaauaauucagaguucuucauucaaugaguauggcuuauuaacauuaauuuuaauuuucccuaaacuuguuauuuuguccugucaagauuguugcuuaucugccacuucaugcuuaucacauggggccucaugugcuuuuuauauaguuuguuuuugcuuggacauuuccuuccucaguucuuacccaugagcacgggggcugugucugacuguguguauuggcugaggacacaggagguacaaaggcucugcuguggaaaggagccuugauuugcucgaggaacagcagggagacuuggguggcuggagcauggggagcaaggggacaguggugugagaugaagcugcagagguaagcaggggccagaugcuguagggcccuguaagaguuagguuccuauuauacugugaauagagcuuuguugaaagauuuuuaacuggaacuggguggugggcaacauagucuaaugugccuuuaaaaaaaucauccuggcuguuggauggagaaacggauuauagaggaauaagaguggaagcugggagguguguugggacaugauuuauguuauccagguggcaguguuaaacugauucguuuccuuuuuuuaaaaaaacaauucauauugugaccaucugcagcacaacugaagauaacuggccaaguuuacuccauggaaaaguuaagcuuauagaacguaugaacaucggaaccauguguucauuaguaucauacuuuaaccaagcucaccaaccccuggcuaaauauaguuucuauguaugugaaucucaaacauuuacugucagcugucuuugaacaucccugugaaguuaacugaacuuuaauuauaaaugauugagugaauucagaagauacuaauauugcuauuuuacauaggaagaaugggaagucuggucauuuauaguacugaaauaaaaagcaaaacacuugucaguuucuccuagcugcaagcaccauuuuauuaacaacauguuuuaaguuuaauucccuccaaaucuauuauaacuucaguguauggaugagacuugagaguucugggauauauuauucuugggacaccaguuaaauuauucccacacuuaacugcugucgcaaguuagaauuuguauaauuccucuaggaagcugccugugauuccccagggcucaggaaggaucccucuuugugcugucguagugccuuauaucuuccccugugguaggcauuuaucaugcugaauuauauggcacucugaggacagagccaaagauucgggagaaugaaugcaaacauggggaguuggggaagcaaaacugaagggauugaggcaagagugaaaauucuuugaagucuugggaaucuucuacuucauuucuuaaugcgguuuuguuuucauaugaaauacuuuaccuaaugaauaaaauugacauuacagcaagcuguaaauuuuguuuauauugcagcuucaucuauuuucaguaucuucuucagucugagggguugcaauucuauaguauuuuguguacuuuaaauccaucuccuguguuagcuauagggggcuagcaucaauacauacauauuagucuuugcacauuaaaaaaaaaaaguaaaguaagauauuugcuuugcaaaacuuugaaaacaucuccuuaguuugaaaacaucuuccuuaguccuucaguauaauguauuacucugacgccuucucagaccucccuaaucuuggccuuucgcuccuuuuugagccuuccucauuuugaaccuugcgcuacuguagcaacguuauucuuaccucugcugcuuuuaucuccuuucuuggcuguuaacccuuccucccauaagguaccuguagguauaaaagguuaucuccuuaguucuguuccuuucugucuacuuacuccugaagcauuugcuguaguucuuaaagucuaaacucugcaauugacuccaaaucuuuaucuucaaccugggccucuuucccauugcccugugcugagauagcugccuuauauuuauaugugcucccucuccucaguuuauagcuucuauugaugauugucccaauuuuccaguacuccaggcuaaaagccuaggaccuuugacuccauuuucucaugccucugacaugcuuguuccugaguccccagauacacagcaggcacuguguacacauucaucccauugugaaaucucagauucuguagugucuugccuuuuuguucuucuccucucuauccccauuaucaccacuguaguccaggcuguaugaccucuuuaaauuaucuguggagacaccuuacuggucacccaguguccaagcccacuuccaucuuuuccauacucucucgauacccagcucagaaaucuuuagugguagaacacuuuucccuguucccuucuagcuaucuucuuacauauacuuuuuauuuauuuuuucccauccacuuuuaaguucugggauacaugugcaggauguguagguuuguuacauagguaaacaugugccauggugauuugcugcacagaucaaccauagguauuagguccagcauccauuagcuauucuuccugaugcugucccuccccugcccccucaacaggucccaguguguguuauaaccccugaaguguucauaugacaucaucguucagcucccacuuauaagcgagaacaugcggcauuugguuuucuguuccugcauuaguuuggugaggauaauggcuuccagcucuauccaugacccugcaaagguagacugcuuucacacaaugucuugcuuuuucuuaggcaucucucuuucccagaauuccuacucaacuguuccccugaaacucaccugcccuucugggaccauauuuaaauuucuacuugauggaauguaaucuaauuuuggaaacuccauacauuuuuucuguagcuuuaagaaacugccaucauuauuacuucguuauaccuucaucagugcuugagaguaaguggggcagagugguuagaagcauggacucuggagccacacugccugcauucgcaucccaguucaccucuuauuauuccccaccuugcucugguuacuuaaccucucugagucucauuuuccuaccuauuucacagagcuguuaggaggaauaaaaugaguuaauguauguuuaaaauacugaaaacacugcccaguacuagagagauuucugcuguuaucauuacauguuaaaaaagauuucuucuguuccauaagccccuuuagguuaagaaaugucuuauucuucuuuggaugcccucacagaauguagcauggugccuuauacauaguaagcauucaauaaauaaguacuuaaugaaauggaaauuuauugaaaagucuaguaguucaauaacaaugauuuuugguuuugauccuaaagugaaaucacagaguuuuuucugggauaauuuaauagcagaauauguuguuuccuuguuuaauugcacaauuuggauuuuaaaaaacuguauaguuuaaauauauauaguauguauuuuauuuuuugagacggagucucauucugccccaggcuggagugcaguggugcaguguuggcuuacugcagccucaaccuccagggaucaagcaauccucccaccucaaccucccaaguagcagggaucauagacacgcaccaccacgccuggcuaauuuuuuguauuuuuguagauacagggucuugccauauugcuaagucuggucucgaacuccugagcucaagugaucugccugccucagccucccaagguuacaggcaggagcugcugcacccacccuuauuuuaauuuuuuuuggagaugaggucuugcuuuguugcucaggcugacucaagcgccuggcuucaagugauccuccugccuuggccucccaaaguucugggauugcaggcaugagccacugugcuugacccaaaaauauauauuuugaccaaaucauacaaggaugaugaaauggcaaaccugugaguacuaaaauauaagacacaggcuuugacauuaaaggaaaagagcacuacgauucacauuaggcaaaaauuugccugcaauggagauaaccuucuaaaugaaagcaucccagaguagaaagaucccagaguagauccagucaugauguauaauuuucuuucaagagcacuaguuuuaaaagcaccauucugggauuuuuagcuuauguaugcauuuggccuuuaacauauauuugauagagcuuuuuaguaccucuuagaauuaaauaagagauguccaggauuaaaauuugcuguugauguugauaugugaaacuuuaaugcauuguagauugugguaauccgauguuucaacuuuaaguauuugacaucauuugggguguuaguuuuaugauuuucaagaaaugaaaaacauuaucauuggggcagacauuucauucaaauuacuucuaucaguuugcuugaaaauuuuuuuuuuuuuuuuuuuuuugagacagucucccucugucacccaggcuggagugcagugguacgaucacugcucacugcaaccuccaccucccaggcucaggugauccucccaccucagccucucaaauagcugggaacacaggcgcaagccaccacguccaccuaauuuuucuauuucuuguagagacaggguuucaucauguuucccaggcuguucuugaacuccugugauucucuugccuuggccucucaaagugcugggauuacaggcaugagcuacugggcccacccagugacuuuuaagagagucacuugagacuuuuaagagagacuuaagaaugcucuaaaacuagacuacaggugaaauguagagugauauuugguuuccggggaggggcggguggggaaggaagaaauauucauuaaauacaggcuugcuuuuucuggcuucaagucaagucaaguaguuuuuuuuuuuuuuuucauuuguacauuuuacaggggcuuugaugggucugacaaagaagcacuugcaauguuuugggguuucuguuaugaaauuaacacauagcucaaauucccauuaaguaaucaugacuuaaaauagaguccagcuauauagucuugcauauuucagaguuaagaauguaaucuuuaucuuuuauuguuaauauucucuaagguuuauuuacuguauuauuuugucaugaguuuauuuaaaauauuuuuuaauauuaaaguauuuuaaguauuucuaguuguaauaaaaauguagauauauucaagaaauuauaaaauuagguuuuguaauugaucgguauucaaguaaaaggaggaaagcuaucaaguagucaugaugaaauauucaucaaauguaaaaugaccuacucaucaacuugccaggucuaaccucuguuucuguuucauuugucuuuacaaccuuuuaagaaguuuauuuuguaaacuucuuuuuucucugcuuuagaguuggaaauacugaaagacuuuucuauucuagauuguaucuuuuccccccagccccaacccaaauugaagaaaacuauugggacaacuggaugauuuacaaaucuauuagcaauggcaacaauaugaaaauuugaagguauuuauguauggcauccuguaguuuggguggaaaucauuuuuuuuuuccuuucacuucugccaugucaacuuuagucucaauguguagauuccaaaauagaaucccaacagauuucuggagacuuucgucuuuaacuauguugucucucucuucucuguuuuuuuucuguguacuuuaggauaucugugugggaaccuaagaaacuaucagagggaacuaggaaguaaaauugcugaaauagcagccuuuauauuaguauuauaugauaacuugaaaauuauuggugauauguuuauguuauguaaaucuuguuuguauuuuuaucuucaaauuucagaauguuuaauauacacauauuagcaugucucuaacaacugaugacuauaguuuggcucgagaggcuuauaucauguaagcuagucacaccuauuugaauucacuuuucuuuguuucuugauuucuuauggcuauuauugcaacaaucaaacaaauuuugaauaccuuuugugagcuagcacuguggaaauaugagggaaguuuauugugguucuuacuuuaaauaguuugcaguuuuauuguguauacaaauguaugcaugugaaauauacagauuuuaaaaaagcagaucauuaaagauuaggucauaagguguagucuguacauggaggaagagcuaaguugauucagaauaacaugguuagauuuugaagcuagccuggauuugaaucuuggauccaccacugacuagcuauguaagcuuagucaagcaacucaaccccugccacuguaggggcacaguuuccucaucugucaacaguuuccucaucugucaaauggugacgauaauauaaccuacccacuguauaguugugacuuguggccuuucuuuacugguauuucuugagaaaauugagcccuaaugagcuaagcauuuguuguaugaaugaauacaacaguuuugugguucuggaauagcauuggucaucaaccauccuugggauauuugagaaaacaggcacucagaucauuuucuguguguggugguuccaaugaaggaaucuuaguuaaggauuaaaugaguuaacauauaauaaauaacagaaaacaaggccuggaaguuuuaaaacuaguauuguuggacucugaaaaaugaagacaauuuaauuaaucagaggugagaguuuucagccugagagaaaucaaagguuuauaugaaaauguuuuucaucuuaagcaaguauccaauuacuuugugucucuggaaccaaaugggacugggaaaaucaacaacguacucaccaaucaggaaggcauccaacauuuggaaggaggcucacacauagaaaaaagauucuuaauaagcauauuaccuguaucagaaucaucaaaauuuacaaauauauugaaacgauaggagagagagugcacauaagaguaagccuuaaaaacuucuaaugagaaagagauggugaauggaaaugaaccauguaggauaagauguguaaacugauacaccuuuuguugcuauauauaaagacaaauuauuucacuuggucuucagugccaugugaguacaauuuuagguagguuaagugugaagaacuggcuguuaaguauaaagaucauuuggcgacuuugggaaagagccauuuuaauggacgaucagcccacagcacauguguuagcgcuuauguuuucucucucacacacauacauuaguuucaauaugauauuaguaaauuuaugaggcuuugauacagguaauaugcuucuuaaguuuagcuuuucauguguuuauuacaguagacucuuagcucauuauccuucuuuuaggguuucucuuccuggcaguuuauucugcaugucacugccgugaucauuuucuuucaucuguuccacuugauuccuacuaauacgcuacccccuccacccggccuagccucugggaccaagugugcccuuaggaaggauuuagaguuccauuucaaugccaggggauucagcaguaaggguaguuguugcuaguuugaugcuuuauucaguauuuauaauuaguauacuaccuuauuccagugauuuguuccccaccuugcacuccaauucagguaccugggcuacuuacauuucucuuugaagaguccuugguuugauaacccuaagccuuuggagaggggucucucugaugugugacauuugugauuuccuaucguugggauaucuguuaaugcaugcugaacuucccucaaaccagccacuugccugauuauuaacuguugccuuucaggguuuuaucuguuuucuauuauaccuucuaaauugucccucacugcuugcuauugguucaccaccucgcaguuucuagucccaaaucacuauucuuuucgguccauggcaggaaccucugguacuaccuggaaaaugacaacagcagagaauguaguguucuuuauaaaauuccucuggcacaugaaggagccagcagaaucaaugccauuaaauauaccaguuggaccacacauaguugcucaugccuguaaucccagcacuuugggaggcgaaggcaggaggaucgcuggaggccaggaguuugaaacuagccugggcaauaaagugagacacucaucuucacaaaaaauaaaaaaauuagccaggcaugguggugugcaucuguagucccagcuauucaggaggcugaggcaggaggauugcuugaacccaggaauuugaggcugcagugagcuaugauugcgccacugcacuccagccuggguggcagagugagacccugucucuaaacaaaaacgaagcauguccauagaaagaaacugaaaaauguuagcauuaagaacccagauggagaccuuucuuuuggucaagauuauaauuuagaaauuuugagaugggguguggugaggaaagugaggaagcuuaacugcuugguucuuucaucucugaaauuuaggcagugacauuauuuauuuagagugagauaaauugugauggcucaaagagaaugaaaaaucccuauaaugguuuauaugggggaauagauauauagucaacuaagaaugaacacaaggauuguugaacagcugugaaauaauuuuaugucuggcuccuguaacauuuggaggcccagaaacagacuggcuaauaauuagccaaguguguauaugagguuuuuuuaaaggauuucuuccagaagggauuaaaggcaguuuacaaaaauauauccagcaugacaaaauuaaauauauauaauggcaaaggagaaaaaaaguuuaauaagauggagcucagaaugaggauaauaaccagauugcauaugaggaaguuuaaaaaugggccguaaguuagccgugagcuuuuuucuuuuucuuuucuuuuuuuuuuuuuuuucuuuuuugagacgggcuuucgcucuugucacccaggcuggagugcagugggcgccaucucagcucacugcaaccuccgccuccuggguucaagugauucuccugccucagccucccaaguagcugggauuacaagcaccugccaccacgccuggcuaauuuuuguauuuuuaguagagaugggguuucaccauguaggccaggcuggucuucaacuccugacuucaggugacccgccugccucagccucccaaagugcugugauuacacaugugagccacugcacccggcuagcugugagcuuuuuaguagccaauugcaaagauggaaauaauaauaaagugaucccaaaccuguaaaauauaaaacaaaugaauuacuuaggcaaagcacaagaauugguggcauugagaaaauguuugcccgaggucuuuucugggaauuuaucaaauauuaacuugggggaaaugcuuuggguccagcagaaauagcccuaggaagaaucagucuugauucuaagaaaguuuauaguugugcuucaugccuuccaggguuugaaaucuauagauguuguaaagugggcagaauuagauuggauuugaacaacuagaguaaaacuaaccucauuaacaaaacacuuuaaugugucacacaaauguaauuuuauaggaaauauuuauauauuuuagauauuuuaaaauauuaauuuaucucuagucaucaaggaaauccugagauauauucuggcuuuucuugggcucaccuggguacauucagauugucaaaacauucucagauaucaagugugucagcacaaacaaaaggaaagaguagagaauacuuucuuugaaaaauauuccaaaagaaucuaguuuccagcauauuaucuaaugccaaccaaaugauuuggcaagccugagaacuuggcaauaugccuuaggggauugguagauagugguacaggagugaguauaacuaugucaaacucuaaagacugaaauugaauuguauuuccagugagggagagaacaguuaguuaaauuuuuguauuuaagguuuuuaaaaauuuucuaaacuaauuaaaggauuuugccuugacugcagucuuauuuaaugaaacuuugcauuuuuuuuuacauuuccuuagauugacuuagacuaguuuucaguuuuuuuaauaagaaggauuaaaaaguauucuuucguguaucaaauguguuaaucaugucaaaagcucuuguuuuacuuaguuugaggauggaguacuaaacagaaacauuacacaaacaaguugccaguuauucucagauacuggcuagucaugaaggaugagggcaacggugaguggggaaugacgaauagugauccucacuacugaggaucagguagugaaggaugaguggaucccugaauuauuuuaugcuugacugaaugacugaauggaugaacauuugcugagcuagguucuugagacagaaguaugauaaagucauggccccugcucugagagucuacugggggauuaucuaguugauuagaaaauaagccaguuauacuacagugugguauaacuguauaccaaccauuauccaagcauggcauaaaugguugguaugcugugaaaugguugguaugcugugaaaauagagaauuggaaacugaaugagacguuuaguugaauuuuuagggaaguugcucacuugggaaagaguaucccaggcagaaguagagaacuuaauuaaacagcaugguuuuuguuguuuuuguuuuugguuuuguuuguuuguuuguuuguuuuugaggcagaaucucacuuuguugcccaggcugaagggcaguggcaccaucacagcucauuguagccucaaccucccagucucaggugaucuucccaccucagccuccagaguagcugagaccacaggugcaugccaccuugcccagcuaauuuuguauuuuuuuguagagacauuuuuguggagacauuuuuuuuuuugguuuuuuuuuugguuuuaucauguugcccaggcugagcauagaucuuggaaguaggaagacuacacccucuguauaguggaggaaggggaggagugacaggaagugagcccagagggauaggaaggggcuagaauaggaauggccuuuugugcuaggauaaggagcuucauauuauccugaaagcuaucagggaacaaggaaagauuuugaguaggaaacuuauaugauuagauuugcauuuuuagaaaggugaaucuggcagcaacuucagaagggauuaaaugugggaacagugcuguugacaacuagacaaucuaugaaacuguuguaauuaguaggugagaagugaugguucugaaugaaggcagggacaguugcaaaggaaaaagggggaaaaucaccuucuaaaguggaaguagaaucugccuuagcucagugacaggugggguguaagugaugauggaaaaaagaaauugaagauaauuuguggcuuucugauuaaggccacagguguuuuguuguuguuguuguucuuguuuccuuuuuaaauugaggugacauuuaauuuauaaacaacauaagauuaaccauuugaacuauauaauucaauaguauuugguacauccacaguguuguguaacugucaccuuuaucaagucucaaaacauuuucaucaccccaaaagaaaguggcaauucccaguuugccucugccccagcccuuggcacccaccaauaugcuuucuguuucuaugaauuuaccuauucugaauauuucauaugaaugaaaucauauacuaugugaccuuguauguggccucuuucacuuagcacgauuuuuaagaucauccauauuauaauacaaaucaguacuuuauuuauauggcugaaugauauuucauguauauauuuaccacauuuuguuuguuuaucuacugauggacauuugagguguuuucaccuuuuggcuauugugaaagcuccugugaacauuagaacagguagugucuuacuacccauuuucaauuauuuugguaauaucuaagaguggaagagugacucauaauuccauguuuaauuuuuugagaaacugcuauauauauauauagcacagcagcuauaccacuuuacacucucaccauuguaugagggauccaguuucuucucauccucaccaacacuuguuauuuuccauauuuuugauuguagcuauccuagugggugugaagugguaucuuguggcuuuguuuuuugagacagagucucacuuuguuguccaggcuggagugcaguaguagccucacacuccugggcucaagcgaucccccuaucuuugucuccugaauagcugagacugcagguguauaccacuaugccccacuaauuuauuuuuuauuauuauuacuauuuuuuugagacagagucucgcuuuuguugcccaggcuggaaugcaauggcgugaucuuggcucacugcaaccuccaccucucggguuccagugauucuccugucucaaccuccugaguagcugggacuacaggcgcuugccaccacgccuggcuaauuuuuuuguauuuuuaguagagaugggguuucgcaauguuggccaggcuggucucgaacuccugcccucaggugauccacccgccucggccucccaaagugcugggauuacaggugugagccaccacacccggccaccccacugauuuuuuuaaaaaaguuuuguggagacagggucucccuauguuguccaggcuagucucaaacuccuggccuaagcaauagccucccaaagugcugggauuaugggcgugagccacuacacuggccucuuguggcuuugauuuccauuucccuaauggcuagugaugagcaucuuucaugugcuugucagccauuuguauaucuucuuaauuccacucccagguguauacccaaaaggucuuuucaaauucuuugcacauuuuuuaauugaguuguguuuuuguugaguuguaagaguucuuuauguauucuagauacaagucucuuauacaauucacaaauauuuucucccauucuguagguuaucuuucauuuugauguacaaaagguuuaauuuugaugaaguucaauuuaucuauucuuuuuugcuuauauguuugguauuauaucugucuauugucaaguccaagguuaugaauauacacucuauguuuugcucuaagaauuuuauaguuuuaacuguuacauuuaguucauugguauauuuugaguuguauauguuaagguguccaacuuaauuuuuuugcauauggauauccaguugugccagcaccauuuauuaaaacagauuauucuuucuccuuuggauggucuugacacccuuuucugaaaucaguugguuguagauguagguguuuauaucuagauucucaguuuuauuccacuggccuguuuuuuuuuauguuguugcuacaaauuacuucuuuuacguggugucacugucaacagauuuaugauuauuguuuuauguagaugucuuuuaguucauaaggguaaaaaaagaagaguugcaaauuaagaaguaaaauaguacugacuuucauauuuaucuauacaguuaccuuuaccaguauucuuuauuucuuuguauggcuuuguguuauuaucuagcauccuuucauuuccaccugaaggacuucuuuagcaucacuuguagggcaggucuacuagggagaaugucuuaauuucucucucauuuuuaaaagauaguuuugucagauauagaauuaccguuagacuguuuuuuuuuuuuuuuuccuuagcauuuuaaauaugucacccugcugcuuucuggcuuacauacaguuucugcugagaaauuggcuuaucaaauuugggaaguuuuuggccauuauuucuucaaauaauucuuuccuuuucugucuauucuuuccuucuggaacucucauuauguguugagagugcuugauguuaccucacaggucuuuuggccuccauucauuuuucuucauucuuucugcuccucuaguuugauaauuucaauuggccuauuuucaguuucacuguuucuuucuucugccuacucagaucugcucuuaaaccucccuagugcaauuuucauuucaguuauuguauuuaucaauucuagaauuucucuuugguuccuuuuuauacuuucugucuuguuacugauauucuguauuuguugagacauaauucuccugguuuccuuuaguuccuuguccauguuuccuuuaagcucuuugagcauacuuaagaaaucugauuuaaagucuuugucuaguaaguccaaugucaggaacaguuucuguuaauuucuuccaugaugggucauauuuucuuuuuucuuugcaugcuuuguaaguuuuugaaaacuggacauuuuauuauuguaaugugugauaaugcuggaauucagauucuuccccuuccucagauccucagaguuuguuuuuguugcuuguguggguuguaauuguuuggugacuuucuuuuuauuuuuuauuuuuuuugagauggggucucgcuguguugcccaggccgaaaugcaguggcacaauuauggcucagugcagccuugaccucccaggcucaagcaguacuccugcuucagccucuuaaguaucugggaccacagguaugugcuaccaugcuuggcuaaucuuuuuuuuuuuuuuuuuuuuuuuuuuuuuuugauacggagucuuggucugucacccaggcuggagugccguggugugaucucggcucacugcaaccuccaccucuuggguucaagcgauucuccugccucagccucccaaguaccugggauuacacgugcacaccacuacgccuggcuaauuuuuguauuuuuaguagagacaggguuucaacauguuggccaggcuagucucaaacuccugaccucaagugauccgccugccuuggcuucccaaagugcugggauuagaggugugagccaccaugccugaccaugcuuggcuaauuuuuaaauuguuuguagagaugaugucgugcuguguugcccaggcuggucuugaacuccuggacguaagcaaucuucccuccucacccucccaaagugcugggauuacaggcaugagccacugcaccuggccaacuuuuguaagcuauuuuuguaaagacuguaccuuugucauguaugaugucugaagugucuguuuguuagcuugugguuagcaauuguuuugacagauggccuugaauaccuggagccucaccacccaccucaccacuacuuccaaaauaaaaauaaauaaacaacaaaauguauucuucuaaaauuugcugauuggcucugcacuggggcacuuuuucaaagcuuagacagguuauuuacaguccucucauagccugcuugaacugagccuaaagaucagcaagaugugaaaguuuggggucuucucaggucuuuucugaauaugcauccuaccacgggcaugcauauggcuuucuaaauuccccaguaacacauggcagcuuuucaaugcacuaaaucuccaaagaaucuuucuucccaggcugcagcauaucuuuugugugccuuaacaguaaucuuuugcuucaggugacggugguuuguucauuugccuuucaauguuuucaaagaaugcccucuguauagccacuuuucugccuugagaaagucuugaguuaggugaaaguaaggcaagugucuuuugucaggccugaagguuguccccagauaagucaaaacagacaaacacaguucuuugaaaauaagaucugcucugccuucuguagaacuggagucccacgcuggaaaugugggcugccauugucaagauugucacuaaaucagggagggcauuggggcaagggcaaguaaaaaugccaccaaaauuucauguuuccucugucuugagccacuauuuacuuaguugcuguaaaccuuugacuauuuuccagcguucagaugaaguuaauucugauaguuucuucucauuuuuuuguuuguguguuuuucuggagggaagggccauugguacucugcugucuuugcugacauuacucccgugggugauuuuuuugaagaauaaauuugauagaagaguuucugagcuagagagagagggauuugaguuagcagaugccaagagcuacaagggagguauaucucuugagcaguuuucaagggaaauauuagaacucauauuuauguauuuuaagaaguuuuuuuugucauuuguuaugggauucauguaaaagaaauacauaacuuuuaaguaaauuauuaggaaaaaaaaccccugugaaucuaauaccaaacuuaaagcuaacacaucauaguaacuuugaaacgauauuguauuccucccagccccauccuccaccauuccuccagagauaaguacuagagugauuuuuuuuuguuuggaggggggagcuuauauuucugcguuuuaaaacaaagcagacuccaaagcagcuuaccuagauauguacauaucccuaaacaauguguugcuuaguuuugucuuaugcuuuauauggaauccuguacagagucuugucuguuuuacauuuuucacucaguauugaucuaagagugucaaugucguguauagcuguacagauggucucuaacuuacuaugguucaauucaagauuuuccaacuuuacaauggugcaaaagcgauacacauucaguaaaaacuguacagccauucuguuuuuucacuuugaguauucaauaaauuacaugagauauucaacacuguuauaaaauagguuuuguguuagaugauuuugcccaauuguaggcuaauguaaauguucugagcacauuuaagguaggcuaggcuaagcuaugauguucaguaagcuagcuauuuaacuguauuuuugacugacaguauuuuuaacauaugauggguuuauaagaauguaaccccauuguagauuaaggagcaucuguauguuguucauuucaugaaugaaugaaacuuagacgugaauguaccacaauugaucugcucucuacuugaugggcauuuaggguuguuuccaguuuuuauguuuugugaagaugaacaaugcuaguaugaacauuuuuaugugugugcuuaagaagauauguauaguguuuccacugaaaugaaauaacugaaucacggaagauauacauguucagcuuuacaagaugauaucgcauuguuuucuacaaugauuguuccacuuugcuuuccuaccaucaauacauaaaaaaccccacugauuauuguuuuccuaacauuugauauugucgggcugcuucaauuuugcugauauaaugcuuguaaauauuaguucauugugguuuuaauuucaagcuaagcauguuauuuauaucuguuaaacuguucauauuuccuuuuccguaaauucauuuucucaauuuucuauuggauuuuuuuggauuguacuuauuuacggaagcucuuuauguauucuggauacuaaucuuuucuuuuuucuuuuuuuuuuuuuuuugagacggagucucgcuuugccucccaggcuggagugcaguggcgcgaucucggcucacugcaagcgccgccugccggguucaugccguucuccugccucagcuucccgaguagcugggacuacaggugccuaccacuacguccagcuaauuuuuuuguauuuuuaauagagacaggguuucaccauguuagccaggauggucucgaucuccugaccuugugauccacccgccuuggccucccaaagugcugggauuacaggcgugagccacugcgcccggccucuggauacuaaucuucagguuacauauauugucgacauuauugccucauuugugguaugccuuuucacauucucugugauguccuuuguuaguuuuguuuuuuugagacggagucuugcucugucgcccaggcuggagugcaguggcaccaucuuggcucacugcaaccucugccuccugaguucaaaugauucuucgugccucagccucccaaguggcugggaccacaggcaugugccaccaggccuggcuaauugugauauccuuugaacagaaguucuuaacuuuaauguagucaaauuuaugaauauauacauauauauguauauauauuuuuuuuaaugagacggaguuucauuuuuuuuaaugagacggaguuucacuccagccuuguugcccaggcuggagugcaguggcguaaucuuggcucaccgcaaccuccaccucccagguucaagugauucuccugccucagccucccgaguagcugggauuacaggcaugcaccaccaugccuggcuaauuuuguauuuuuaguagagacgggguuucuccauauuggucaggcuggucucgaacucccgaccucagaugaucugcccgccucggucucucagagugcugggauuacaggcgugaacuacuaugcccagccuauauauucuuuauaguuagcaauucuuggguuuaagacaucuuuuauuaccucaaugucaucaagagaguuuccuauaauuucuucuaaaauauugauuuuuuugguugaacauuuauaucuuuaauuauucagaauuauuuuuaaaaauugaaauauagcauacagagaggaaaauguacaaaucauaucacuugaugaauuauuacaaaguaauggguauguaaccuccaucuacaugaaaaaaaaaaaaaaaacuuagcauucucucaaaugaccugcuaaguacuauucuucucccuagcgauaccuccucuacagaccucuaacacuaucaguuaguuuuggccauuuugaaauuuauauaaaugaaauuauauacuauauauucuuuuguuucuuaucuuccguguucaauacuaugugagauucauucauguugagcuuaauagaaguuuguucauuuucauagauauauacuauuuguacaaguaugccacauuuuauuucucuauucuguugauagauauuuggguuuuuuccaucugggggcuaguacaccuuugcaucucuguuggggauauuuguaggaauggaacugcugguagguuuguguauguucgucuugaguagauacugccacauuuccaaagugguuguaccuguuuucacuccuagcugugucugugaauguuccagcuguuccacauuccauccaucucuuagguuuaaccccugucagucuuugaaauuuuggccaucuuggugguguguagugguaccucauugugguuuuaaauugcauuucccuuauugcuguugagauugagcauagaucuaucaauaggcagacagacuauuuggauauauuauuuuauaaaaugccuguuaaagucucuugccuauuuuucuuuuuuauuuauguaauuuauuuuuauuuuuuaaaauucuuuauagagaugaggucuugcuauguugcccaggcuggucuggaauuccuggccugaaacaauccucccaccucggccucccaaagugcuggaauuauaggcaugagccaguguucucagccuugccuauuuuucuagugguuuauuugucuuuuuuuuuuauuauugauuuuaggacuugucuuaauauuuauaaaaugagcucuuugauguuuaacaaauaucucuucucuccaugugacuuaaauuuuuguucucuuauugaugucuuuuaauaaucauaaauuccuaauuuugauguaguuuacuuuguucagcuuuuccuuuauaguuaauguuuuuguauccuguuuaaaaaaucuuugccuauucccaaaauauucuccuauuuaucuucuaggaacaguuuuaccuuucacaguuagagcuauaauucuucugauuuuuuuuuuuuuuuuugcaugaaaugagguaaggcucaaaaguaauuuuuuccccauguggauaccuaauugacucagcaccaauauuugaaaagacuuucucuuuuuuugcagugcugcuuuugucauaaauccauauauuuaggguuaauuucauuucugcaaucuauucuuuuaauggaauauugcuuugcugaaaaguuuugguaucugggaaggucucuucacuuucuucuucuuuaagaugccauggcuauuguggggucuuccauacaaauuuuaugguuccucauaaaacucuuuugggauuuuggugaauaccauuggauuuaagaauacugcugaaucuacagaugaauuuggggauuuucgauauugaauuucucuguuuauuucagucucuuuaauauaguucaauaaaauucuguguauccuuuguuaaauucuagguguuuuauauuuuuguuucuuuugucaaugguaucuuuuugaaaauuacauuuucuaaguguugauauaugcagaaugcaauuagccauuuugcuaaaccuucuuauugauucuaacagauucuuuauauauuauuuuguuuuucuguguagauaaccauagcaucugagaauaaugacagcuuuguuuuuucuuuuccaauauugguucguucuguucuuuuuucuuguuuuacuaacugauuaggauagcacuauccaauggaaaugcaacguuagccuuaugcguaauuuaaaaauggcugguagucacaguggaaaaaaagcaaaaaacaggugaaguuaguuuuaauaauuugcuuuauuuuauuuaacucaaaauugucauuucaauauguaaucauuauaaaauuaaugagauauuuuacuuuuggggggguacuaaaucuuaaaaagcugguguguauuuugcacuuacagcacaucucaguuuggacuagcuguauuuccaggccucauagcuguguguguauggcuaguagcuauuguauuagacaaugcaggacuucaguuaccaguagagugcugauacugcacguacuuguuacucauuuugaaacaaauacuucugacauuugaccauuaagaaggauguguucuguagauuuugguagauaucuuuuauguuauuaaagaaguuucuuuuuuuuucuuuugagacagagucuugaucuguugcccaggcuggagugcagugguaugaucucaacucacugcaaccuccaccucccaagcucaagcaacucucaugccuuagccucccaaauaacugggauuacaggcgugcaccaccacgcccagcuaauuuuuguauuuuuaguagaguggggguauugccacguuggccagggcuggucucaaacuccuggccugaagugauccgccugccuuggccucccaaagugcugggauuacaggugugagcuaaugcgacuagccaagaaguguuuuuguacuuuuaguguacuguguuuucuucuuaacaagaaauuuauuuaucuuuuuuuuuuaaccucuugaagugaucuuucuugauuuucuaaugguaagcuacucuuguauugcugggauaaacucaguuugguccugauaccucuuuauucacuacuagauuuguuuuaauuuuguuuuuaagaauuuuuacauuguucauaaaaggaauggcugguaauuucuuuuucuuuucuuuuuuuuuuuuuuuuuuuuuuuuuuuuugagauggagucuugcucuguugcccaggcuggagugcaguggcacgaucgcggcucacugcaaccuccaccucccagguucaagugauucuccugccuuagccuccccaguagcugggguuacaggugugcaucaccacgcccagcuaauuuuuguauuuuuaguagagacaggguuuugccauguuggacaggcuggucuugaacuccugaccucaggugauccaccugccuuggccucccaaagugcugggauuacaggcgugagccaccacaccuggccaguaauuucuuuuuuuaacuaugcuuuucugauuuugguuuaaagguuuuacuagccucuuaaaauaagcuggagaguaaauaauuuuauauauauguaaaaucucuagaaaaguuuuuauacaagaguuucaucuucuguuacuuggcaguuugguagaugguagaaacuuugcauuuaaaaccuuauagguauuuuuuuuuuacauuuccuaaguuuauaauccucuaccuuauuguaagcauuuacaauaauauaagcauuuaagcuauacaauuccuucugacuacuucauagcauauuuuagaaaucugcauuucuuuuucauucuaagugucuuaaguuucuauuaagauuuauuuuuugauccacauauuauuuaaaguguuuugaaauuauccagugugggugcuuuuaugcuuugucauuuuguuagugaauuacacauuaauuaauugcauaguguucagcaaacgugguuguaugaacugauucuuuuaaauguauuuggucuugcuguaugguuuagcacaucaacaguuuauauagauuguccauguaugccuguaauucuuuaauuuugaggcugaggauucucuauguguccauucagucaaguuuuuaaauugcuuuaauuagaucuuuaguaucuuaacuaauuuuaucugcuagaccuaacaguaauauagagauuauuugauacuuccuuagaguucuagcaaauuuuucuuugucuguuuaucuauauucagugcauguaaguuuagaauucuuauaucuuccuggugcauugaagccuguuaugucacgauucucuuuaacccuaaugaugcauuuugcuuagauuuauuuugucuuauuuaacaagguuauuccaccuuucuuugguuaauauugccagugguaucuuuuucuacuuccacuuuucaucuuuuagcauuugcaugcccuuauauuuuaguguguuucuuguaaauaucauauaguggauuguuuuuuugugggggugacauuuaaaaucuuuggugagucuugucuguuuauauuuauugugauuauggaucugaauuucuuuauuccaucccuguucuucuguuuguccugcuuuuucuaugcuuugcccuccauucuugccuuauuuuuuuagauuaagauuuuugcuuuggauuauuuacauuuucuuuuucgccuuuucugguuggggagcuauguauuaauguuccuuuaguuuauacuuuugucuaauccaucuaacaaaaucuaaaauuauuccauauuuaaaaacccaucccccuugaaaaaauacagaagccuuacaacaguuuaacacuaauuacccuaaccuuccccuacuaccuacaauuuauuugauacucuuauccauaauuuuaacuuuaaauaauucuacaaauuugacaguauuuuauauagguaauguuuguuuagauuggcccacagguuuaccaguuucuuugccuacuguucuuucuuguaacucagaccuuucuaauggaguauuuuucuucuuccuaaauaauauuuuuugugaauuccuuuagugaaugucaaauggugguaaacuuuuaugcuuaucugaaaaaugccuuuauuuuauucuaguucuacaaauaucugaguacccauuuccagguuauucuaggcaucuguucucucugaacuaguaggacauuuuugaaaugucuuucuaauuagaaagguaaucuagaggucuaauauuuguuauguaugggauuaauuuaaaaaucuuacuaaaaacacuuuuaauaaccuuguacaaaguuuguguuauacugaaagaauugcuauacaauuaaagacugaaauaugacuaaaagaacuuuccauauauauaucuuggugauugcuuuuagauucauagcuggagucacuauuuauagggccuauugcuuauggcuuugaguuucauuuacuuauacuaagcacucauuuuucagaaaacuuguacuuuauuaguucuuggugauggggggcagcaugcauucuauucuuuaaaacucuuauuuucuaacuauugucuugauuggagucagcuuaaguggauauguacuauuauugcugccugcuccuuauugcuucuauaauaugguaaaagaaagaggauggacuccaauauuuauugacucuuuauguacuacucaucuuacauacucuacauaucuauucuuuuucaguucucacuacauauaaucccacuuuacuuucauuuuguaaaugaggaaaucgaauuugaaaguuaagugacuuccugaguuauaguauacaaguguugggacuaggagucaaaacacagaugcucauguauuuucuacaauuccaguguuaucaguuaaaauaucuucugguaaucaguccuuuauaugcagcccaguaagcagaagggauacccaccuguguggcuugagguucgaugugggaaagagcccaucagcuaaugauacugcuguacuauuauucuguggugcugcauauguacuauuauucugugguguggccuauacuuagauuuacuucuaggguuugcguugggccauaaauuguuaaauauguuuaucaugaauauuaguuguaccuuuaacaauuuccaucauuuccugccuucuccaaccgcaucucccauucuagacuaacaugauaauaauacacagcuaugcauuuuuccgcuuccagacuaauuaaaguaacguauguuucugugcucacauucagagacauuauuuaccucugaauugagaagcacuauuauuuauaaaguauauaggaugggcuaguaugggaagggaggaaggacuguguucccuugcuugucaacaagaaauuaguauauucuucauagccuuaaaggguuuuacaguaagaaauggaaaucuuguuacuguagagacuagagauuuuugagggauuuuuuuuagcauucccauaguugaacuguaggcauaauuucaaacucuuaggcuacucaaaccucaaaacguucagauacuauuuguuuugaggguuuuuuaaaaccuguuccuacuuuuuucaguuucaaacuuugugauaguauguaugucuguuuuauuuguuagcaaauuuuguagcuuuuuaaucuauguuuaaguaaugcuuuuaaaaagggccaagauucguguauaagauaccuauguguucagcuuaagcaaaauuagguuagaaaugaaauuauaugaaucaaauuguaccuaauuuaagagcccugguugcauucauaaaaauaaucuagaaggcuaaauggaccauuuuuuaaugaaaaggauacguuguauuagcgccaucuacuguuaggucagaauaauuacuucuugguguacguuuggauuuuucccaauggcauauuccaaguccagcaucuuucugcauguccuuuaacuuaauugaccagucuguagaaugugggcguuuuaagcuauucaaauaauauccugucuauguucagggucagccaauuuuuguagaucuuguuucauaauucuuuuuuuuuuuuuuuuugagacggagucucgcucugucgcccaggcuggagugcaguggcgcgaucuccgcucacugcaagcuccgccucccggguucacgccauucuccugccucagccuauugcugggacuacaggcgccugcuaccacgcccggcuaauuuuuuuauuuauuuuuuguauuuguaguagagacggcguuucacuguguuagccaggauggucucgaucuccugaccucaugauccgucugccucggccucccaacaugcugggauuacaggcuugagccaccgcacccggcccauaauucuuguuaaaguagcaauggcaaauuuccuacaauuuucuugauaguucaugauuuuaaaauaaagcuagcugauugugcuagcuuucuacaaagcauccuuguuuuaaaauuugcuaauugauaauuguuauaaagacugggauauuaaaauugaacauccaauuuguagcugaaagacugucuagagaaagcuguaucucaauauguugcuuguuaauucacugaaugucuaacucugcaucguacauuauuaaguguauucguaauuuaggggaaaaccuauaucuaaauaauguaguuacuuuuuuaaaauuucuuaauguaaagaauauuacaaaaauagcuuuauauaauguacugauuaggaauauaagcuuuaaaguuagauucucugaguuuaaauaccggcuuuagcacuuguugcauuuaugaucuugggauaauugugaagcauaaauaucuuucuaaagcacuuggaauaacaucuggcauauuaguaagcacucaauaaauguuaguugcuaucauuaauauuuuaaucaauguuuacauauccaaaguaaacauaauguuucaauaacuauauuuuuaucuuaguaacuaauaacuuuuuugguaaugaaaccuauaauauuugacauaaaauauguaacuuaagaauauaaauguucaaaauguuuacuguuuguuucugcauaucauuuagaguaaaggguaguaugguagagcagaaacaacaaaguugagucuucagucucagcucugucaguuacuagcaguguaacuugagguuauuuaaccucucuacugaguuuuuuguuuuguuuuguuuugagauggagucucacucuguugcccaggcuggagugcaguggcgugaucucggcucacugcagccccugccucccagguucaagcgauccucuggccucagcuuccugagguacugggauuacaggugugugccaccaugccuggcuaauuuuuuuuuguauuuuuaguagagaugggguuuugccaugugggccagacuggucucgaacuccugaccucaggugauccacuugccucagccucccgaagugccuggauuacaggcgugagccacugcaccuggcuaaccucucuaaagcucaaucucuucaccugaaaaugaguuguuuugaggauuaaauuauauaauguauguauaaagucauucuuggcacuuaguagacuaacagcauagaugucaauucuuuuauaacauacugcaaauuuacuaacaugcacguguuuccauaauuuugcuuuauauuacuuauaugaaaauaaaaauauauuaagcacccuuuauauuugaaaagcugauggaguuugagaaggaacaaagaaauugugacaucuuaagaaguauaauugaggauggaauagaaacgugaagaguuuuaacugggaauaaugguucagucaguaauauuuguaugugauugcuaaauauacagaauuuuuuuuaauucaaaggaggaauacuuucuacauuggaccuagauugcaugucccccaccgacuuuguuauuauugcuauaauuuuuugguaguauggcccauugcacauucuaggaggacauaaagaggaugaaauccacuuguggauuauuagaaguauuuguugauuucauguuaucugccagcaucauggaccacgacuguagauauauccagccuucaggguggguggaguuaggugggcucuguugguaaaugaucagcaccgaguauuguuccugagcauaguagaugcuuguaaauauuugaaugaacaaaugaaagugucuguaucacaguuauuacacugacugaggcuaguguucucaucacacgcuaauuuaaauuucuaugucaaaugguaaauagcucauuccuuccuguguucucugggacuuugcuuuaucaggauauaucaucucuuguuuaaucuuuuccacuuuauugacaaccuaagugaaccagaaccacccaccccucaccaguuaccugucuuccucauuuuacccauucaucuacacugcugugguguggcuguuccuuuuuccuuaccaccucccaccccaagcuuuuucugcagaugucaccaaugacuuccuaacugcgaagucucaagccccgaggaucccauuuccauccuucuugucucauuugaucucucuguaucuuuggcauugcugccuguuacuuccugaaguucuccucuguuggcuccagugcaccagucucuucugguucuccuucugucucuuggccuucuccuuuucagucucauuuacuauuuguuuggcuucucuccccagcucucuuaaacguugguguuucccuagguucuguugcuuggccucccuucuuuuuauaguagguuuucuuuguacuccagcgacccaauuuaucuguggaacccaauucagccgcucauaacacaaggggaagaggguguaggcagcagccccccauaaucucuaugaccuguuacacaugaaagcuucacugaguaagcauacaaucuauguaaaacaaccaaaaaacaaacauuuauguaaaaggagugugguuaguauggaaacuuggccucaagaagugucuccuaaccccugucccuggacuccuuuguagaaauucuagaguugucuggagugucuucaauuucccugugaacauaucuacuuggaugucuccuccaaacagccucuuauuuauuccuguuuucacauaauccaccccuccuguauucucucacagcuacuaguaccaacauguacucuaccuuaagcccaaacccugcaucauccuaaauucuacuuuauucucaacagcugguccugggaucgcugcugccuucaucucucaucugugagagaauuuccuauauuauaauuauuugauucaugucuauuucuuucauuagaaucuuuaugucccaggcaccuacaauuuuuauaguauuaaguguucaacuaauacuuuuauauguaaaaaugaauuuaucagcaaucacuaauucccaaggaauuaauagcauuacccuguugucuuaaaaaaaugccaaaaccauaagaaaauugauuuuccaaucuuaauuuuuuaauguuaaugaauguuaaauucaugcuauauuaaaaugaaauacuuuuaagaucuuugucuuuuacaguugcucaauuuaaaggaaaguuuuuucaggugcuguugauaacauuuuggaacuuguacacaucuuauacauucaauuuaaaaaaaagauccaaacuuaucagucuuguuauuaacacuauuuuucaaauuuaauauuucucaguauuuauucauugaaugcucucaaaugguggcuuaauaguuucauguuuguuaaauacagagcugugucuuccaucugcuauuuuugaaauaaaauuuucauacagcaguccuugauagggccagccuagaaucauagacuuuuuccauuuuaguccuaaauaaauaauaggauggcaugcuguagauucugaauaguaacaacuuauuuaccugauuuuucauugguuugaguauuugauacacagaaauugaagcuuaaacuuuuaucuaaucuuguuuuaaccuucugagaagacuguguguccuuagugacucagauuuagcauacaggugaugaguugucucauuugguggccaguacuuacuuuuugucuuauuagguugaaagcuaucucuucuugagaaugcugguguauguggcugguaacagcuugccauuuuuguuuaguugcuuuuacuuuccugaaacccaggaagccagauaauuaaguuuuaaggauuauacgauauacaagucaauaauuuucuaacaagaucuuaaaagcacaguauauugcuuugguacaguggcuuuaugagagcuuuuugaacuguuuagaguagggguguccaaucuuuugguuucccugggccacgcuggaagaagaauugucuugggccgcacguaaaauacacuaacacuaaugauagcuggugagcuaaaaaaaaaaaaaaaaaaaucacagaaagaucucauacuguuuuaagaaaguucacgaguuaggccgcauucaaagcuguccugggccaugcccguggguugggcaagcuugguguagagguugguuuucauucuucaaguuucuagacugugugcuaaagguuaggguugcugauucuagauacacagaugcauuuuccauucauagauaaccuaguucugguguuuuuuaguaucagucacucuuguguaguuuauuucauuggaucugcuccuagggccaucuaggaccaaguaagagggcuuaauauuuuuuauucaguaauauucagagaccuauaaucuuugaugauacaggauagagagccugacugaaaagcuacacacauacacaaacacacacguaaacauacacacauacauaaauacacacacacacacacacacuaccuguguguuuguuuauauaucagacauagcaaaaauucauuaaucucguuucuuuugguucacugccagaaaucccuaccuagugcuguuugacaauuaguguccaugucugcauacugggcucucuugcuggguggcguccauaguaggaaaacuagauaccgugguagagugugguaaacaaacuaaucaugaguuuuccauaaauaguuugaugguggcuuauguuuuggaaugugguguaaauuuacuaucauuggcucauuuuaauuauguaaagaauugcuaugcaugaaaaaugugaaaaaauucaaauaccccauuauuuuacccuucccccccagauuuugagcuuccuauuuauuuuauucuuuguagagacaauaaagcauauacacucuggcaucagacugccagguuccaagccugacaaaaaauuauuaauuuaugccuaugaacuugggcauguuauuuagucuuucugugucucaguuuuucugccuauaaaaugguaaaacaaaguuagaguuaucaugaggauuacaugagguaauauacguauaaaguacuuaguguguggaguucaauauuaguaauauuauucuacauguauuuuuucuguauaaaacauacagaaauguaaguaaauuuuaaaugugaguaaauuuuaauauuucuuguaacuuaaggcuugcagaauuuucuggcaucucuaagagaauguugugauuuaacuguuuaaguaauuuaaaaauaguucugcuuuuaaauuuucuccuaguuuucccaaggaaucuauagacauuauuuuacuuauuauuauuauuauacuuauuauuuuacuauuugcuuuuuauauaaggacuuuacuuuaaaauaguguuaauacuucuguguucuucauggucucuucuucugucucuuaaggaaugguauuuaaaucuauuagcaggcugggcgcaguggcucacgccuguaaucccagcacuuugggaggcugaggcgggcagaucacuaggucaggaguuugagaccagccuggccaccaaggugaaauccugucucuacuaaaaauacaaaaauuagccaggcgugguggcacccgccuguaagcccaacuacucaggaggccgaggcaggagaaucacuugagcccaggaggcggagguugcagugagccgagaucaugcccacugcacuccagccugggcgacagagcaagacuccgucucaaaaaaaaaaaaaaaaaaaaaucuaugagcacauuugauagggagaccucacuugaucuaaggguucaugcaaggcucacuucaggaaggaacuuccugagauccaaagagugaucagaguuauaaacuagaaaagguguaccauggaaggacaugccuuucaggcagaauuagacguuuaaaugcccagaaaugaaagggagccauuauuauauauaaauaauauauauuguuucaggaaaaauaauggauucuuauuuuugcagugauuguauuuuauuguuaaauauauuccaucugggaagauccaugcaacaaucuuuaaauuuuuaaaaucaaucagugacuaggauagucuaauauagucuuaguaaaauguuuguguuugagaaaauauaggucagguuggccaggcaugguggcucacgccugcagucccagcacuuugggaggccaaggcggguggaucacuugaggccaggaguuggagaccagccuggccaacauggugaaaccccgucucuacuaaaaauacaaaaauuagccagcuacuuggcaggcugaggcacgaaaaucauuugaaccugggagguggagguugcaguuagccaagaucgugccacuggaccuccagccugggcgacagagcaaaacucugcucaaaauaaaacaaacaaacaaacaaaaaacaggccagguguggcaacucgugccuguaaucccagcacuuugggaggcugaggcaggaggauugcuugagaccagggguuuugagaccagccugggcaacauaucaagacccccaucucuacaaaaaauuaaaaaauugguggcaugcaccuguagucccagcuacuugggcugcugaggcaggaggaucacaugagcccaggagguugaggcugcagugagccaugaucaugccacugcacuccagccugagugacacagcaagacccugucucuaaaagaaaaagaaaauauaaaaagaaauuugauuuuuaauguagauuguaauuacuaacuauagaaaacagccaucauaaaauuucccuuugacucauaauugucuaugauuuuuaaauuaaagguugacuucaaguauaagauuuauuuuucauaauucaagugucagaucaugcaguuuaugggcacucuugauaacuuucuuuuuuuaaaauagagcacaucaucccuguuuuuguauauugauauuuuuuauuagauaauaaucaacaaaaagaaaaaaaucacuucauuauucuguuuauuucaaguuacaaauaauuuauauaauuguugacugauacaguauuaaugauucuguuuuauaauaaacauaauguauuuuuauauuuaaauuccuggacacaacacaaguuucccuacaguuuguauauagcuuauauaacuauuaaaguagaaaguuggauagacugggaguaauacuuaauuuauguauaugucaauaaucacaucucagcuaauauuugaaaacuccauaucccuuaagauguaaacaguuuucauuagaauauuaguuuuuauuaauuauaauccauguagcccccaccuaaugugggauaccagugccucuuccaaauauuuuuuggaguccccagaguauauuauaugguucaugcagagcucugggugucaaccacauggcauuaauuuuaauuuuuuucuucuggccauguacuaagguuuugucauuuucacuggagacugccacuuuuguugggcuuuguuguugaucuuuccuuuggccauugcagggacuggcugagcugggucacuuagugcuuuguaggacuuuuugguggagcuaucuagucugggaguuuuauuugaggaaauauuuuucacuauuauauugauuuaauuuuauaugauggcaauauaggacuauucagacuuuauaucucuuuguuucaguaaguuauauuuuuucuauuugaccauuuaaucuauaucucuuaaauuaugguuacauauuuuuuucguuccugauacugcuuauuucugccuucucuuuuuuucuugauuaaauuauacuggcggcuugcugguuuauggucuuuuucauacagccaauuuuugguuuuguugaucuucuaauauaugcuuguuuucuauuuuaacaguuuuugcuguugucuuuaucuccuuucuugaauuuuuuuuuuuuuuugcuuuuguuuguuuuaccucccucuccugacccucccacccugccaguuuccuugaaauccuuaucccaauaaucuuuaggcuuuauucuaauguucaagacuauacauuuccccuaagugcuacuuuagaugcauccugcaguuuuaauauaugcuacauuugucauuguucauuucauucuuauaauuuaaaacuacuuuugugauguuggacccuuuggauuaucuuuuuucuacuacaaaauuuuuuuaauuuucucaaguuuauuuuuuuaaggagauccaacuuguauauuuacuuacuaauuacauacauuuuccgucucauaauuaauaccauucugcuuuuauuccuuucacuuguuuuuuugguugguuuuaucagucucuugucuaccuucuggaacaacauugcagacuguuuaaauaauagaaaaacaaagaauuguagauuucuuuuuguuucccgccccuuccccaccucugcuccaauaagauaguauauuucuagggcuagaguagaauaucuaagauauaaauugcaggaaguacaaugaggccuuauuguacugggaaugaaaaaguugucagauaucucguuucuacauuucugaggcuucuugauaccugcuugccuggguuuugguuuacuugucugguuaguuuuucuucccuuuccucucccucccuccuuuuacucuccucccguccuccuuccccuaccucccuuucuucaucuccucucccuccuucuucccuccauucuuauuuuuaacccuuccuucauccuuucucuuccucuucuccuuccuuccauucuugcauccuuauuguuuuuucaccucugacauaagugugucaaaaguggggaaaacccucacuagauuuuccugauuuugggaucaagacgaaaugaucuguagaggucuuauguuauuaacuuguugcacucuaagaaaaccuaaagaaaaucacccaugccuuuuaaaaugcuugaaacauaacaaaucacuauauucauaguauuuuuguucucuuugaaguaaugagucaucauaaauaaauuggaccacugccccuuuaaguagaaacugccuuaggggacagauggaauuuugggacuacuuccugaagcacuuguuuguccaccaggagugucaguugggccugggugggaagagaggcccaagaaagccaccauagucuguagcgugaagcuuuuccuauagucuagugauaauccugcugugaguaccucacuguaauucaaauaauuguggaaggaauugucucucaguuguccuaaguccugccuaguaccuugaaaagcaguugguuucuaaauacucagcuuggagggugaaauaagguucaguucagccauuuuaguucuuugcuuuguuuuucccagcuggaaaaauuuuaaagcuauuuuaaaaaucacuuggaggauuauuuggagaucaugauagaaauuuuuuacugguuaacugagaugaauuguauaguccuuuuuuagcuuaagaucuuuaaacauuuaguugcauaacagcuuuuuaauuuguuggacuccucaguugaagccauuacaaauuggcuuaaaauuguaaaagauugaguauuauauugagccuuucuaucagaaaacauuagcuuaauuagucuauaauuaaagaugauguuagcuguacuuuaguuugucuuaggaauagagguccucaaauuauauguaaaccaucaguugcaugguucuuuugaaauguggauuuuugugaaugcuuaauaaagcuggccugacuagcuuaauuuaaaaauauauacaucuaugcuaaauauauacacacacacacacacacacauauauacugcuucuacuguuuguauaacuuaaacugauuugcaugcugacaaaaguacucauccaauuguacaguuuuauuuuuauuuauuuauuuauuuuuuauuuuuagagucaggggucuugcucugucgcccaggcuggaguccaguggcaugaucuugguucacugcaaccucgaccuccugggcucaagagauccuccugccucagccuuccaaguagcugggacuacaggugugugccaccaugcccagcuaauuuuuguauuuuuuguagagauggguuuucaccauguugcucaggcuggucucaaacuccugaccucaagugauccaccugcguuggccucccaacgugcugggauuacaggccugugccguugugccuggccuccaguuguauaguuuuaaaugaauguaaaauacuugagugauugguagauuuaauauuauuuaauaaauuuaauauuuuaaaucuaaaaaugcauuaaucaguuugaauaaaagauguacauugggucugcaauuccguuuuaaaaagaggaauuccccugcacaagcucucucucuuugccuacugccaucuauguaagacgugacuugcucuuccuugccuuccgucauaauugggcuucccuggccacguggaacugcaaguccaaguaaaucucuuucuuuuuuaaauugcccaaucucaggucuuuauccacagcaugaaaauggacuacugcaguuguacaauuagauguggagcuuauuuugagaagaauuugagggauagaaggaauguucaaaaauauauaccucaaaacaaagaaaauugccuuuccuugaagauuaggucauggcucacugcagucucaaccucccaggcucaggcaaaggcaguccucccaccucagccuccaggguagcugggucuacaggcacaugccaccacaaccgguuaauuguauagccaggguuucaccauuuuguccaggguggucucaaauucccggacucaagugaucugcccaccucagccucccacaauauugggguuacaggcgaggacuaugcuuuuucauguuuccguuuuagggaccugguacacauagcagguccucauauguuuguugagugagugagugggugagaggggagacagaaaucagauaugucaaugguugagagugucugaaggauugauaccagugugcaaaguaaaacaugcugucucauaugaaaaaaaaggaacaguucucaaguugugagacaaaagagaugaccaguauuuguuaaauagaagaauucaaaggaugcuguauaacagaaaaaugccacaguuuaucuuugcauuugugaccccucuuuauuccaggggucacauucuaagacuccccauggaugccugcaacugaggauaggaucaaaaccaauauucaguauguuuuuucccuauacauacauaccucugauaaagcuuaauuuauaaauuaggcacaguaagagauuaacaacaacaguaauagaacaauuauaacaauaugccagcauuacuacucuugcacuuuggggcuaugaaguaaaauaaggguuacuugaauccuccaaucacuuugacacgcugacaguggaucugauaacugagacaguuacugggugacuaaugggcaaguaguguauacaauguggaucugcuggacaaagggaggauuucagcacauaauuuaacauuuaugacuuauuucuggaauuuuccacuuaauauuuuuggaguauagguaacuaaaauuauggaaagugaaaccacagauaagggaggacuccuguaauugguaguuuauauuuucacaggauaagcuuucaauauuuuauuugucaaaggagacuuagucaucacuuaacaauuuucuaaaaguaauuauuguagaugaugcucugaaacugccagugguucuguauuuuaauucacuguuuuagaacuauucucuuauacgucaauaugauguuaagaaacuuaagucuauuuagguucauugaagagucugaacaaucuaaaaauuauaaguuuaguaaagauauagaaauuuaccauacuuaaucucuacuuguaguuaaaaauugaucaagcaaugcuaucuaguaaguuuugcaguucuauuuauuuaacauuccggcuauuuaacugucagaaaggaaagugugaugguaagaguuuaucaagagauccaagugcuacacaauugcauuuccacaucuuauguuggaagagauaauuuaguuuugaccugagaaauaauuucauuucaaacaaauuucagugcauuuuagcuaaugucagcaugaguauuuaauauuuuaaaauaacuuuaucuugauuaauauuuuuucaaauaagcacauuuuuuaaaauuagaaaauuuaugguaaaguaugaaguacuuuugaacagguaccacaagguggcaggauuguauuuuguagauucuuuuugcuuugaugaacagcaaaccauugguuaucuaaaaucuaaguuuuccagauaguuggcuauuacacacuuuauaugccagaacuuuuaaauuuuaacuuuuuugauggaaaacuaaacuauauuucacauuuccugauuucuuaagcaguagaauauaacuuaucuguugucagugagccauuugaauguauuauuggaugugauuaagauggaguggucaguaacaguaguguggagggaauaaggacuggucccagcagagacucuggaccgugacucuuaaaagcugggucugacgucaacuugcuuuuugcuuuaucugcauuuuuuuccuauuggaggugaagugaaucaugugaagugccagccucuggugugguacaacauggcugcuuuccugcaaaauuaaauagcaaaugaaggcagacauugccuucucccagcggcuuuugugacacaggguauuugggggaaggaaaauaaacuaugaggccuuaaaauuucuucuucaaacaccaguaucguaaagguagcaccagaccaugaggaaugaguucuguaguuaugagaaauauuagaaacaaaucuaacugcucauggagcaacuuuaaggaaucuuuccuauaaaaauauuuuagacucugaguuguacaucauuuguaugaaugagauaauaauaauuauaaaggauguggccagacgcgaaucuauuuuccuuucgaauccaauuaccugcucugguaauuggagagcuguuucaaggcaguuuaugccuuuauuggugauacaacaagcaguggguaaaaucuucauccuuuggacuucuugguuugcucauuaguggauacuguguuucccuuuccacaggcuuccaggucuggaguuguucugcgaaccuguuauaaaagauuugacuagggggaaguuuucuuucauauuuguucccuucauuaauuacuugcauauuuuucuaaucuuuuaaaagaugaaucaguuuaacaucacauaagcacuaagaaagcaacaguugagcccuaccuuaaggggagaggagagggcaugguuuccagcagcaauccuuucucuggcucucuaaaauguuuaucuaccugucacuuucuuacucauauggauuuugcaugauggcugcauaaaucaucauauuuccccccucaucuuaaauucaguccucaagggguaauggagaacuuuuauaagagcuccagagaagccacaggaaauaacugauaaauuagcuccaccugaaauggauauuagggcaucgucaauugacucuucucaguucugcuugguaguagaacuuuuuuuuaaacuucauaguagacgaguaaguggaacuuucaugacuuaaauagauagauaaauuucacuagcuuguacuucuaggauuggguacauuuuccucuuggcaugguacuauguguuuucaaguaaaaauaauacaauucaagucugacaaacuggcucagugaauuauacaagauucgugcuuuaaaacacagucuacacccucccuguugcuuuggggcagaguuuuugaguaauuggacaucuaaaacuaacucugaacuucaagauuaccagaaagaucagaugcaagagcuuaauuuguguuaagaacauccuccuacauauucugccaaaaguuuaagagcuauuaguaaaagcagcucauuugaaguaguaugagauuugaacauuuaacuccaagauagcuagaauuuuauuaaaacggauuuaaagaauuagcccacaauuuaaauacuuuucucauuuuaaauguggcuuaagauguauuugucuuuaugaaggaauuuuggauuaaaaacuguacuguaguugaauuuaggaaagggaagccggagauggguaggcgguggguacuuauagaucuugaaugccugguuauaaagauugggggcuuacccuguagguacccuguaaucauuaacagacuuguaauugcaugggugacaggcaggaaauguuuuaagaaaauuagccugaaagcgcagggugcauuugcuuggauccagcuggagagagauuggagccagauggaccaguugagaugauauggcaaucaauaaucuggaaguuuuaugauauaaaucugaauuagugugaugucaguaggaauacagaaagaauuuaaaagccuuuaagauauuauuagggcagaauugauaaaacauagcaacuugcuaggugagguuaagaaaaaacuauguuauauaaaauuucuauuuuuguuagaaacagcaaacuuagacauaagccagucuucuacaggaaaacuauuucugugcauuuagcauauuauaaauucuucauaauaaagaugauaauauuucuugauauaaagaccaguaauaggagauacuguugauuuugugucugauuucaaagagugaaauggcuaaagcgacuugaacauucccauaguauagcgguucccaaaugcuggauuaaauaccagcuaccucaaaaaauuacuugguuuguugcagguggaagguaucuuaaauaaugcagaaugucaugguuaggagcacagacuguuuugaaaccuggauccaucuacuaugggcaaguuacuucucugugucccaggugacuguuaggguuguuacaggaacgaaauaagaugauacauacaaagugcuuagaaaauugccuagcauauuguaaaugcugaauaaaugguagcagcuuuuuuaaaaaaaaaauucaauagcuuuagggguacaagugguuuuugguuacauagaugaauuguacaguggugaagucugggcuuuuaguguacccaucacccgaauaguguacauuguacccaacaggugauuuucuaucccucacccccuuucuaccuaccccacuucugagucuccaguguccguuauacaacucuguaugccuuugcauacccauggcuuagcucauguuuauaggugagaacauuugguauuugguuuuccauuccugaguugaguuugcuuugaaugauggccuccaguucuguccaaguugcugcaaaagauauuauuuuguucuuauauggcuguucuuuuuauuccauugugugugugugugugugugcgcguguguguauagguugaucccauauuuuugcaauugugaauuaugcugugauaacauaugagugcuagugucuuuuuuauauaaugacucuuuuccuuuugguaaauacccaguagugggauugcuggauugaaugauagaucuucuuuuaguuuucugagaaaucuccauacuguuuucuacagagguuguaccaauuucccaccaacaguguauaaauguucccuuuucacuguaucugugccagcauccauuguuuuuugacuuuaaacaauggccauucucccuggggcaaggugguaucucauuguggugguuuugauuugcauuucccugaugauuagugauguugagcauuuuuuccauauguuucuuggccauuuguauaucuucuuuugagaaauaucuauucauauccuuugcucacuuuuuaacggaguuauuuuuuuuucuugcugauuuguuugaguuccuuguagauuauggagauuauuccucugucagguguauaguuugcaaauauuuucucccauucuguaguuugucuguuuacucuguuauuucuuuugcugugcagaagcuuuuaguuuaaguaagucccauuuauuuauuuuuguuuuuguuacacuugcuuuugggaucuuagugauaaauuauuugcuaaggcuaguguccagaaaguguguccuggguuuucuucuagaauauuuaugguuucacgucagguauccauguccuuaaucuaucucaaguuaauuuuuauauauggugagagacagggagggauccaguuucauucuucauagcagcuauuuuuuuuuguuuuuuuguuuauuuugagaaggagucuugcucuguugcccaggcuggaguacaguggcgugaucuuggcugacugcaaccuccaccucccguguucaagcaauucuccugccucagucuccggguagcugggacuacaggugugcaccaccaugccuggcuaauuuuuguauuuuuaguagaaaugggguuucgcuuuguuggccaggcuggucucaaacuccugaccucaagugaucugcccaccucggccucccaaagugcugggauuacaggcuugagccaccaugcccggccauagcaguuauuguugcuaauuuauuauuuuauaucucuggagauucuaauucauaagguuugacauugggcucaggaaucuauauauuguuuucuuuuuuuuuucuuuuugagacacggucucauucugucacccaggcuggagugcagugguaugaucucagcucauugcagccuugacguccugggcucaggugauucuccuaucucagccucccaaguagcuggggcuacagguaugcaucacaacaccagguugauuuuuuguauuuuuaguagagacaagauuucacuauguuguccaggcuggucuuaaacuccugagcucaagcgauucgccugccauggccucccaaagggcugggauuacaggcaugagccacuaugcccggccaaggaaucuguauuuuuaaaauauccccuccugugacucugauuaccaaguuugaaaacuuuuguugccacccacuuaucuaccuccauauaauaggaugguauuuaaaccacucuguacauuuuuguccuuuauuuugacauuccaaagauggccauguuuuaaaaugguacgugcuauuauuuguaugugcuaagucgcacugaauaguuuacccaaaucccucugguacuaguucuaagcuuccacccucucccuauaccccuucccuagcuucuugaggaucguaaauccuagcccuuggaugccagcccuaugugcugccuucuugagaagucuagaugagugcuccugggggauuggcccucacacugcagcucugcuuauuuccagcccugcuuguguccuaggaauauccuuguaaauuuuguugggaaaaaugaacaaacagucuuauuugcuaauuaaaaauugcaaaguuuuguuuguuuguuuguuuguuuguuuuuucuugaggcagaguuucgcucuuguugcccaggcuggagugcaauggcacaaucucagcucacugcaaccucugccuccuggguucaagcgauucuccugcuucaggcucccaaguggcugggguuacaggugccugccaccacaccuggcuaauuuuuguauuuuuaguagagacaggguuucaccacguuggccaggcuggucuugaacuuuugaccucaggugauccacucgccucggccuccuaaagugcuaggauuacaggcgugagccacugugccuggcccaaauugccaacuuuuuaauacauaaguaauaucagucgugggcuuuguuguuguuuagaaaauuucuuccuaagagcuauucuccaaugcucugauugcugccagugcccccucuggucuagugguuuguagcccuggcuucacauugaaaucaccuguggcagcugacucacacaagaugaguacagucugaaucucugaggcaugagccugaacaucuguauuuuuuaaaagcuuccuacaugauucugaaguucauccaagguugagaaccacugaauuagucucaucauugucaugcucguguccccccacagaguccuauuagaaaaaggaaugcuucagccauaugacgugaauauagcuuucuuagccuggcaaagucuucggggguaaagacaaaguuuaagccugcauuuuuuuuuccugggaggcucuccuuguauuccugucucugugcuuuaaaccuucacacaugcuauuuccauauuaggucaagguccuguguuacauacuguccuaguaccgugaaaguuuccuucagacauuucuucuaugccacgauauauauguuccuaaauaccucauucugcagcauuauguguuaaaaauaagacagccuaugaagaaaacacggugggggucaaccacucaaaacuugugcagcauuguaaccagagcagugagaaaacaaaaaguugguaccaguuuaguaaaacagcaagcucuaaugguagguauuaaaaaauacacaaagaagagugaaaugcuaccaacauuuuaauuagagcagagguggcaggugcugauauaacacagaaggaaguggagcuccaaaccaggggcgcugcaguaagguuggguacaagagucaggguaaccuggcauaagcugaaaggagcacaaagcugguaggggcuccugguggaagugcuugcuuuuaggucuuguuaaauacaaaugaaaagauucuuccugcugcuauacagcagagcugagagcucuuuccauucuugauaaaggcuguaauucaccagcuguacugagugcucuugugaaggaaaaaacccugugaaccaauacaauuuuuguguuaugcugacaucauuaucccauuuacuaaucacuuaauugauuugccuucuagaaggaauuaauuugccuuccagaaacauagggaaaaaaaaaagacuauaucacuaugucacuaucuguaauccuagacaaauuugauuaaagucuguaaacuccguaaggucagugauggugacuauucugacuugucauccucgcaggcauuuguucaaugagugaaugacuucgguaaaacuucuccaaagaaaauggugggaguaauaugaacauuacgcuuuuaaaaaaauggaacaaugaaagugacauaaccuuaaagaaaguuuaggaaguagaagacaaaauuacucccagucuucuucuauuacagucacacuaaaauacuauuauuauuuuuacauguccuuuuauuaggucucuauugcuacauuacaaguuacccuaaaauucaguggcuuaaaacaaugaggaucaucuuaguuucugagggccaggaauuuggaagugguuuagcuaggugguucuggcucagggucucucaugaggucaagaugucagcuagggcuuccaucaucccaagacuugacacuggggccggaagauccauccuaagacagcucacucacauggcuggcaagcugaugcugucuguuggcaggaagcaccucaguucuuagcacuguggaacucuccauaggccagcaugaggguuucaugcuugaauaugaaaauuuaagcuagguacauacauguaagauaacucaaaaacagguacaguaaacaguaugggaaaugacuaauuuuucucuuaugauuuaaucuucuacucuggcauucuuugacaauuaccaugauuggauuauagguaaggauucuuuaaaaccuuuucuucuuuauuauaucuuuagagcaaauggccauuaauuugcaaauacauuuuuuucaugaaauccucuaaucaaaugccacacauuuaaggaguuagcuauuuguuuaaaaaggccauuuugaaagagagaacuguucucuuuaugcaaaccuccuaaugaaauucaacagugaaucugauuuuauuugcauugacccaccucugaguuuaaguuuuuuauguuuaacauaugggcuguuuagccaccuuaacuucuaauucaaagucaaccaguaauuaaacugcaguuuagcuagaacugcuauuucuauaauucuggauagacugaagaguaauacagauaugugagaagcuugcagauuugucaaauaaguugaauuugauguauggauguuaggucauuaccacacuuaaaagaaauuuccauggacuguuugcugaaaauucauaauuuuaggaaauaccauguagcuuuuaugucuauuuauuacuuuuguucucuaugcuuauacagagauggugaugucuguuuuuguuacuuugucaaguaaaacugaucccuuuaaucaaacacaugagaaacucauaggcaauauuuucuuguaugaucagcuuuaguuuuuauuuuagaacuaggauuaguaggggaaagaaagaaaguauuaagugaucucuuucauugaugacuggcaggauuuaaacuguuuaaguuccucaaacucuuuguaagugcaauaugcaucuaaaaucuuuauaauuuauaguuuguaauuauauguuagcuguaacucuuuacuuuucacaaauaagugaacaguuuuuaaaaauucccaaacacauuaaucguccuaauggaucugagacauaccaugcuugauucuuuuuguuccuuauucuccuguacucuaguuuuaugacuuauuuuguguuccuuugagggucuuucugaauuuuuauauuaucuuauugauuuggaaauagagccuauaucaacuacuuaaagcacccagacaaauacuauaaguagaggaaccucuaauaucuuguaucucauaauauggacacuuuacagaucuugauauuguauaagauuuguuuuuauuuagauuuuugugcuguaauuguacacauugccauuuguaggcuuguaaaugguuuacuggaguagugauccauauaacugaaaguagugugggccagaauauauagcuugaacauuugcuauaauaaaaugaucacagaguaggacucagaggcuuauuagaaauauaucaguacuucuuucuuuuguugaacaagucugcuuucuuuuuccauaaaauagauuaaaugaggccauugugauguagaguuuauagaaccauauuuucuaugguccagcaccuuuccaaaaauguuuguaaaauagauguuugauguuauguaacuugaacaaaacaaggugcuuaguuaaaugauaguaauuuucuuguuacucugcugaaauaacauucaaauauauuuguggggguaaucgcagagucaccagucugaauuauucuuauuguguaaugguuucuguauaauacauaguccuauuuguuauuguaauagacucauuugaaaugauguuuacauuuugauuaccuggcgucuuuuaaaaucauuuaucuccccucucccuccagcagaaacccuuuaacagaauuuauuccuggucucugcuuuugccuuccuucuguucauacuucauauuauaucuucaugcuauauauuuaggaauugccuuccuaaaauacagagcuggucaggcuacuccccugcgguaaacaccccacuggugcuccuauuuccuaaaggcaggguugauauuucgcugguuugcacuaguuagguugaacuggccauuuacaacugguaucuguucugauuggcuggggcucaugugcuguggggugaauuucggauuccuuagcaguguuuucaguguuuugggggauuagaagaucucugaaugaguauuuaucugccuuaauuucccaccauacuguaauuauuucagaggacccuacuguuugggcaccuuccauaacgaugcuuugacuuacugccucuguuuuggacauuuucugcuuuucccuuaauacagucauucucuggucuaauuaaugauuuuaagauuauucuugaugauuuaauuuaggagaaaauuccuuggugaaaucuuuacugacuacucaccaucuaguacuuuacucgguuaccuucucuuaugcuuuccugguaccugccauauaccuaagauaucacacuuauuacuuugcccuauaauuauugcuuacacaucuaccaccccuucuggacuaugggccagucacaaugcuuaccacagguaggcacuaaauaaauauuuaaguguauggaaagaaguuagauuuuugagucagaaaaaccugaguucauauuccaggucagcuauuauacuuacuagcaguaugagagugaacaaauuaauuuugcauagucucaguuaacuacuaauuuguauaugcaaugauaauagacgugaguugaauauuaagcaagauacuguguaccaugcuuauuauauuaccuaggauuuagcuguucaauaaacauuccacuguccuaguuaaauuugguuuaaaaguauuguuuugcauuuccuuuucucuuugaacuuuaauuuauaacaagaaagcuguuuuuaucugaaaacaucucuguucuacuggucugugauaaagcuagaugauaaauuauaucauuccuacugcuaagaaaaaccauuguuuucacauuucuacuagcauuuuuugguuugaaagcuuuuuagaaggagggcuucuucacuccucgaaagaagcccaguaacuacuauaaugccaggcacaagauguuugugaauuaaguauuuguggaaaggagcuguggugggaaagaaagacuaucuccucuuccuuguucuggggagaaggucacuugauuuccugcuggagcaacaaauaugacaaaaucaagggaagagaacacuagaagcggauggggccucccuccauagcuuuuccuagaggacagucuaggagggcagagauggccucugugaaagaggcugcaaggacucuaacacaguuuaggacaucaaauaaaugggugaggaaguaagaggugguucucuuuaaagacauaaaguaaaaaaauauuaggaaucacccucugaacuaauucaucaugucauagggauuaaggcaaaauuugaguugcccuuuuaccaaaaacaaugaagucacuuauaaauugcuucuccagauaauuauucugugucauggaaaagggcaucaagcuguauaaaggugguuuucguauuugaaaaaaauuuccuuuggaaguaaucuauaauaauacuuuuuauauuaggccauucucaagcaacucucuacuuuaaggaguaauuugagaaaugugaggaucucuuuugauuaaccccaauuauggcuaaaaccaaguaguucagaacacaagggcuucaccuuaauuggucaccuuaauuacuguggaaagagccagguucuuuucuuguguuaucucuuuuaaaugucauaacaauauuauugucacaggauccuuggggugucgcuuuuucagccagaaaccucuguggcuggggguaccuuugcuggaguuuucucaggcccucugagcuaauaauuccacccacuuggccuggcuggcugcuuuccgcuggcugcucuccgcuugugcuacuguccuggaucccaugccugccaaggaugagacaggcacccaugccugccaagggucaguggcaaggggugugugaaacgagccuggggucucaccacugugcacagccaggugugcuggcugcagcgggguaggcagcucuaggcgccggcucugugcaaggcugcggcuagaccaggcauacuguaaguggcuuccacugugggcaccggggagugcaguggcgccuggaagcuuggagaugccaggaacugcagagccccaaagagggugucacagcccuggguuggggagccccuaggucugggcuuccugaagggcugcagcucuucucucuuucuugucaccugcaauguggcaagcccuguuucuguuacagcucuuucagucccaccacucggcagguccuggguucuugucucguguccaggaagaaugagguauguggacaacuggagggagagcaaggcagagaggagcuucauugagugacagaacagcucucaggagacccaaaguggguggcugcuuucugcaggcaggucgugccaauaaguguccaggugucagcagagaggauauccauaguggguagcuccuuuccacaggcaggucauccuggcaaguguccagcucucaguggagaggagacccauaguggauagcuccuuuccacaggcaggucauuccccacaagucgagcagaccccaagugggucgcuccuuccugcaaccgguaguccccacaucugugcaagucugacugaguccggggguguuuuaugggcuuagaagggaagaagugugugcugauugguccauggacggccaugagugggccuggaaaaagcacaaguucucacugccaucccacggacuccacccggaacuggcagcccagcccccaggcuuuaggccaucuaccacuugaaagugggguuucacuagggauccuccccuuucucuccaagaaccugucugccucccgccaucaacaugccauccacagugcccaggcuguucguacugaggggugccugcagguuugcauggagcugcccucagccccacccuggccuucuuccugcacuugucggugcccaagguccagagggggccgaggcagaguagggguggcuggcaugucagcugcugccccgagcgcacacacacaccuggucggacagcgcccaggcuuggccauaacuuugcugcaaaaucagagcgggcacugggaguggggagagaccagagagcaggaucgggcccuuccaagccugugggggaaguggggcuuccuggguccccgagagcacagggaugcccaggucuggagguacggcugggcagcugcagcugugccugggagugcaggcuucuguccugcuaacuugguaggggguggggcucccgccuguuccuggcccuugcugucucucuggagccugcaaugcccgccgcgccuccccagcugcagccagcgucuuugcaguggcugcucuagaugggcugcuguugccaucauuaugaaauauguauuaucacuuccauuuuacuaugaauaagugauuuuuggaaauuugaauuaggcucuaacuccagugcucaaaaucugacucuuuaaaaagcugcacuaaagucaguacugaugaagauguuuuauaauugcauuuauggacuuaaauggcuaaaacaacaucauagaugcuuucaaagguuguuuggaaaugaugcuuuaguuggaauuaaaaaggaaaaggaucauacuauuaagagaacauuaagaauuuuugcugauagaaucacagugagaaauuaggaggaucagauuugauagaauauagugacuggaaaggcuucaaagauuucaccuaucuguuucaaaagugaaaguagauccuagaacuuguucuacuuuuauaugagcagacuuugaaauccuuggaaacuuaguuuucuaauucuguccaagaauaugaaacagugucaguugacagaucugauguauguguaauagauaacuauuucaucagaauugaaaguuugacccaauauauagccaccuucuucaguuagcuucuguaucacugcuggaaauucuuuuugcaguuuucuuaggugagcucucugcuucacccuacaaccgaaggcuuuggaaaucauagagauuuuugaaacuacuaaaccagccacugcuagcacaaaaggagcaaauucugcaggauuuagcgauuuccuuuuuauauaaauagugcuuucucuuugauucugagaaaaaguauuccuuuuuuuuuuuuuuuuuuuuugcuauuugcuuuucaguacauauauucaacaagcuuucuuuuucuucuguuucuuuagggguugcucuuuuugcagcccuugaaauugcuuuaccaauaggcguuucuuuuauuuccaugcguuguuugugaaggcccacaacaugaauuuuauuucuguugcuugggagauaccacauguucucaucacauauucucucauuucuuucaaaaugccuuauuucuggcuucucaauauuuaaaagcuuuucuuuugugcaugcugcuugauguuuuugauccagugugauuagacauauuugagauguugaaugcguguuuuuauauagaaaaguuauccuuugcgaaagaauagcaaaacauaauuuugcagaguaacaaacgugccgaacugagguagcuguuacauguuugagauaugugcuguuugcguuuuccuaggugcaguuuugguucagcugggugcaguuuccugcguucaccugauguuucucacaaacaaaaucacacauaagcaaaugugaaaugugcauuacgcucaaauuguucucuaacauaugaauuguguuggaacaaauugguguuuuccaaacaaguuuuauaauggaacagauuguacuugauaggcucuguuaauuuuaaaaagccugaucuguaguucuaggaaguuuucuugaauuauuuuaugacacuuuucuccuguccauauugcacauuucugaaacuucuuuuguuaggguguuagcccuucuaaauauuaauagcuguuauuuauuuucuuuccuguauuaaccuuuuugguauuuuguucuaguuucugagauaguucuucaacuuuacuuucuauucuagcacauuuucacuuaugcucucauaucaauuuuucaguuuccaagagcucuuucuaguguucugaauguuguccuccucuuauuuuauccauguaaucuuuuaggauuuuacaaguuucuucaguucccuacacugucucuguuuccucuagguuccuuuugacugaguguuggcuauacuagagaauuguuagucauugugaaaggugaagccggcugggcuucugggucggguggggacuuggagaacuuuucugucuagguaaaggauuggaaacgcaccaaucagugcucugugucuagcuaaagguuuguaaacgcaccaaucagcacucuguaaaaauggaccaaucagcgcucugugucuagcuaaagguuuguaaacgcaccaaucagcacucuguaaaaacagaccaaucgguacucuguaaaauggaccaaucagugcucuguaaaauggaccaaucagcaggaugugggcagggccaaauaagggaauaaaagcuggcuacuccagccagcagcagcaacccgcucgggucuucuucuccgccguggaagcuuuguuguuuuacuguuagcgauaaaucuugcugcugcucacuuuuugggucugcacuaccuuuaugagcugagcuguaacacucacugcgaggguccacggcuuuauucuuuaagucagcgagaccaacaacccacgggaaggaaccaauuccagauacaauugcucaguuauucaguugaguaagauugggucugucuuauacagacuuauguugucugcaccuuguacuuuuugaguauugaguucuuuacugcauaucaauggucuuuggacuuucuuuacggcuugcucagguuucaacuugaugaauuaccgucuuuuuuccagcuuugaaaaacuauugaaauugacgucucuuuuauauuuacucuauccuuaugcauuuaaaacuggguucucaucucuuuaguggugugagguagaaauaaagauaaaugaguguguucggugcaccaugcuuagucagaaguagcuuuaaaaggcucuguaauagauucccuaugcgauuaauucucauggcuucuugaaacuauccaaagcaagacucaaaaaagagcuaucauugcauaucuagugcuuaaauuuuguagacagaugauucuacaggaggaccugacuuauuuguacuuccagacagggaaaguuuuuauuggaaagugaaaagcaucccaaaauaauucuugaagaaacuaguuuagaauauaaaguggcauguaauaccuauugcuauuaagugcagaacaguguuucuuaaaugcaccguguaccauaaugauggucucaguaagcauguuucuuuaaaaaagagucuuucagaaaaccaagauagcaaaagugagagagaucucuuguaucauacauugguuacugcgcaguccuaugaugcaucaugcugucuugacuuuguugggucucuugaauacagcauuuccccuugcuguucucccugcuggaagaguucuuccaugacuaaucccaucaucucucuuaggucuuuacucaaaacucauuuucucagggaguccuucuuugaaagcuagcuaaaauuucauccucucugaucuuucauaucccugcuucuguucuuuaauuugucuccuggguacuuguccuuaucucacauacuguauauguacuuauuugucuuguuuacuuuuucagccccaguugaauguaaguuucaggaagacagagacuuuuguccauuuuguucauacugaauccccugugccuagaacaguuccugacacaaaaugggugcucaauauauauuuguugaauuuuuauuauuuuaaaaaaaaacuauuuccagugauaaccagucuuucaagggacugaagauuacuaaaacaugacagcaucuguuaugauaagagugcagaaguauuuuuugcuuuucauaguggugaugaguaugaccuuaucaagucacauaacuccuuugcgccuugguuuccuccucuauaugaaugggaauaauaaugguaccuagaugaggugguuauuuaaaggauuaaaugagguaauauacauaacguguagaauagggacugacaaguaguaagucuaaucaaguauuaguaaacaaaacuucugccuuugucuaguauguuuuaguggaggaaggaagccaauaaacauaguaacuaaacauaguaaauauaguaacuaauuaaaugggaaugauuucaggcuggagaagaauugccccuggugugggaguagaggaugaggaggagcauaagaguuucagugguguugauaacguucuuaguuuagcggggggcaguuuguggguguuuguucuaccguuauacuuccuaacuuacauagauguuguuauauauguuuacauaauguaaauacuucauuaaaaaaauacuuucuguuccaagcauaccucaguguuaaaacagguuaaucacucauuuaauuuaguuauccugauuagguaagaaacuugguuuuaaagaaaaucucuucauauaacauaacuggucuuccccugcugucccccucccccaaucuaauguauuaaagccaaaguuuuuuuagaauuaacucuguuuuuacuagcaauauguauuugagguauucaguuuuauguguuugugcagcauuacccuaacuuggguuacguaauaggugauggaacuuaugcuuugucaccaacaucauuuuaauggccuuuguaaaacaucuuguuuuauucaaaauaaugcaacugaauuuuuaaauauauguaguauuuaauuuggguaaugaaacaaaggaauucauucccucuacaccagacuaaauuaauccuuuauguuuuaacuuuaccuucaaaccaaugcaaaaucauuaaguaaaauugaagcaucuucaauuaggagcauuucuuauuagaaacauacguguaauacucugauaaaucuguauauuuuagauauaaauugucugaaggugucuagccaugaugacuagaaguaacauuuacuauuuuaaggacaggugucaguuuuuuacuaaauuaauugaacugcguauuucuggggugucuagaaauagcccacuuuuugguucugcuagauuauugagucaugcccuguaccaaagccgacugacuugaguuuggaucuuggcucugccauuuguuaaacauaugucuccuuggguaaguugucugaccacuaucagauuuguuuguguuaaugaaaauaagcuuuauugcaucaaguaauaaauacauauaaagauauaaacaguuauuuucuuccaguuuugaucaacuuaaaguaugcauaaccgaaaucuacugauaguuugaaaauuuuggguguuccuuguuaaguuugguagguuauucugcuguauuuauaacuugugcauuuuaaaaauugacuucagugcacuaauagucaugcauauguuuaugcaaaaaaguuauauuaagcagaaacgaggaguggcuacuaagugcgcuguuaguaugcauugaaacaaaauccuuaugguuguauuagcuuaacagaacaguuuggggcacagaaacauauucaaaggagaagguuaaagggagacacugguaucuuagaggcaaacuaguuugcugagauaacuuuacaugcaccuuuuaaaucaaugcuuaaaaaauaacuuggguaauuccuaacuacugaaaauguaaauucuaauuaacugcaaaaucuuuuuucaaucugugagacuguaguucagagccaggugaaacaugggaggaaaaaccaaccuguuagcauuuugaaaacaagaguuucaucgaaacaggggaggugaacuguaacuucucaucuuguaaaaagauggaaaaccuuuaaagccaaaagcagcaaggauauggcacucuguucgguuuuagccaagcacuuaccuuaccagcuuucuagagugaauaaugccucgauuuagucucuuuauucuguucuuacuccacguaggcaggguugaucucuccccaacucuucacuggggcuccuggcuguucccagcucccuggguguagccuauggauaguggcccauggucacucagcagcuggcgguacugggggggcaucaccaggcugucagaaggcaagcagacgucccuagaguguagccaaguuacuuuguaagacauacucacccuuccccaugaguagcccagccaggccaugaggacagugguggcauggggcccugugaggcgcagaggcccaggcucccugugcucgggcucugggagcacuggcaaauaugauugcccucacccucgugcccacuguagggugucauccacacauuaggcaggugggcgggcacagaggaggccauaaacuucaagcagacuuuuuaacuuuaaaaugaagaaaagaaugguaccuaccgccucagaguaguaaagauuaacugggguaugagugugcggcaguuuccuuuuucgaguaguugccaccaacucugccacuccuuuuugcuauacauugggguugccuuacaacaucucacuuuauuuaguuccaugacuuguuaguuacuucucguuacuuaaccucauuuggguucuuaaggcuuaguucuguuauuugauagcuuuauaucguguuuuguucaaaguucuccucuucugucaagucggacuaagcuugugucucuagcaauuuggaauugacaugagaggaccuggauuguuuccaucuauaucuguccccugccugcuuuccugacugaacaagucccugauguggggcugggagcgcaaaagugggaaaggacagggguguccuugccagggagcccuuggugaguuugcaguccucuccucggucagccauggcggauguccuauuggugaucggugggauagauacgggcaugcaguggccccaacagccccacagguaaggggcugugcccccuauagcucacuggggucugcucagccccugacaugauauggccucaucucacaguugauccucagcguguggcuucaugccgcauucuucuggauccccuccagagccauuugcuuaaagucucaauucauuggugagaaauaugcaugucaugguuuguuuuuauuucuccuaauaacugcuauuaauugugcucaguugaaucacccuuucacucugguagcaggcuuccuuacuagcaugucgacccauuuccaucgcuuuccaguuaauuuuggucauuuaaacagucacuuaccauuuuuuaaacacuucguucuuugcauuuugaaauuugacucucaugucagaaucaaagcucucucuucucugcccacucuuucccugaaaaggaaaaaaagaacccagucuguuacuggcgccuuggaguggaggcuguuuuuggcucucacacgcgucccucccucuuggcaguagcagugcgcuagcauggaggugggaaggaagaaccgaggggcagagucucugugcugacuguugcagugucccgcuucugucacgguugcagcugccgucugucuguuucugucuaacggacuguccauuggcucauuucgugaggcugccauccacaugagcuuucucaaaggacgcaguugcuggcucuuugcuggcaccuuagggugccuggcauuggagagcugaccugaucucuucauuuccccgcucccuccacaguuaaaucacuuucucugucuuggucuccuuguuggguagaggcuacucucccauucaagguucuugcaagugccucaagccuagccaccuucuguaguguccacuagauccacagaaaacucaggugucuuugcuaugccaaacggcugccccaguguguguggccgcccagcuccaccaucucuugccuauauggauuucugagguaaucucauccacucccaaggagacuuacugcuaaccuaacaacuuuucuuaugccaguauuuucuuaugcccaaccccaccugaguuccaaaaccguauuucccacugccuaguaaggccuaucaauguuauaccccagaaccaguuuacuccccuuagccuacagccuuauucuggcuaauggcaucaccuuccaccuguucacauaauccagaaaccugugagucauccugccucccuuaccucacacaagccaguucggucaguucuauguugcaaugucuuugaauccaucccacuuuucucucugucuccccuuugcuccuugguuuuggcccucauuauuuccuuccuuuuacccccaguuccaucucuuguagucuuauacauuguggucagagugaccuugccaaaacacaaaucccauugcaucauuugcccccuuuaaacccuauuauguggaccuucauugcccucagacuaaaguccagucucccaucacauggccugugaggccccagccugucuuaaacuuuuuuccuucuacugccuuucucuucacucccacugcuaaacuccaaccuccuauuccauagccacacucaacuacugagagguguccaaacucagcaugcugcuucaugacccuggcuuuugccuggcccuuccuuuuucauggaguguucucauucucuuuguaccuuguagucuaacuggacaacucuuauuuguuuuucaacacccagaggguaagucuucugcccucagaaacacucccaggcugcuuucugcuaaccaucauuuuuuauauacacucaaauuauacaaaauaucauacgucuuucuccccuugcccccugcaacugcccccaagucacuaaaagcaaggauugugucuuacucaucuugauaacuguggugccaagccuaaaguuccuggccuuucaugggugcucacuguuaaauaaaugcgaguaaaucaaauggcugaagagcuaauguauagaaaguuuuuaaauucuaguuuauaucuuucuagcuaagauguauuauguugaccauuucuuuuacaguaguuggcagcagguuuaaaugcuaaaaagugacccucauucucauuguaaauuuuuauuucccacuucauuggccccacucagcacuuuauuauuuucaucgcauugucuucuuacccuuauuuaaucauggauaggagaauguggcaaugucagaaucacacuaagaugauauggaaggagauccaagcugaugaccaccuagaguaaaaauccuugggguauauugggacaccacagaaguucuuaaagugauugccgcuaaagccauuucuccuauuccuggccacaagccuuggggacgcagccugccugccuucuuuacaagugagcaucauuuucuuugauccccuuggacuuccucuaacucgucuucucacagcucuugagggcuuugcaaggaacugucagggcuaaugaaaggacaauuugaaaaucuucuuuaggcacauucacuaaguaauguguccgucagcaaguguggcucugugucuguggugagccccuuucucugucgggaccuugucccagugccuggagagcaccuucucaaacuguagaccucacuggcacugggacugaucugagugccccugucagccugcccagccucagaaaggaagcuguggagggccaguucucaccaagagcucaccagcuccacucuagacuaggcccagaaacccugcagccaggcugccugacucacaugcagcaugggucucuggcugugguuuccacacagccucccagcuuguuucuuaaucuguaaaauggguggcuuucaaugaauacuguggcuccguugagaucagcagaagggcauuucacuuuauggucccuuuauucuuccaggucuaacaucuuacacacacacacacacacacacacggaucuagaauuucuggugugcacuucuagggcacacuauauugaaucagcauuugguucuaugcuccauccaacaguugaugagguagacccuggacaaagcaccuaaugccuuugagccuccauuucuaaaccuagagaauaagaaaauuaaaugaucuccaagguccauuuugcuuuauaauucugaauagaucagaggguuaaagaaacccucagaccucauuuaugucacagagcugcugcccauggaggccauaauguagaaaugugucccuugaucgaagcagagguauuuauuauguaaacacacuguguccccagcacacagagucaacuuugccaauguguuaaugcuuaccuaggccuguacuacauuagacauucuggagcuagguaauauccuuaaauuuaucuuuaccguuguaaauacaacuguguaauugagcuucaucugauuguuuuagagucaccaagagacugccucuaaugacccuaaguggcucuguaugcauagaaaaaugguuaguugguuagucuaguuccuaccaggucuuuuaggacugcuuaucguuguuuucuucuggaauuuaacaggaaaauuagcuuaaaguaacuaguuauuuuuaaaaagugcucaaagcaucuauuuuucauagcugugcaaaaguaaaagaaauaauauucauuuuucacuucaugcaagaaccucacuugcaugagguucucgaaauagaaaaucauaaucaggacaacuugucacuucuucagauguuuuauauagaauaucauuuggcuucuaaaucugugauuccuuuuuugucuguggcuccagauuuucauaaucuaccacuauuaagcagaagugguaauuuaugaagaaauuuggguuugaaaugcuuauuauuuucaugaagauaaaaaguaaaauaagaauguuaaccauuugaguccuguugcugaagggcauugagaggaguugagccccaucucucucucccauugcaguaguuccucuuaaagucucccuuaccaucuuaaaaaaaaaaaaaaaaaaaagaaaaggcauugggucuucuuagcauuauagauauucuuuuggaauuaguaguuaugcuaaauaaggugaagacagccaugggaaaacuuaaaauuguuucuagaauuguaacaauuuaaaaguaauuauaaauguuuagagagagaaaaauacagaaaaaauguauuuacagaggguaaauacauguguuauauauagguguauauaaauaaaagauuauauuuaaaucuauuagcauuuuaagacuuuuaaaauucucacacuuaaagcaaguauuuaauuuuuacaaaucuuuuaacgcuaauaugagauuuaggaaugauuaaucaccaacaaacucaacaguucuaagaacagagcaaaauuauaguuaaaaaauucaagccuaguaaugcauuuuauauaaugauagaacaauuaguuauaaaauaggcauuuuuaggucuccucaaugaauauauuuaaguccuugcauuauaucuuuuaaaauaguuuuuguucccuuuuuucuuuuaguuuaaaauguuuuaaaucaaaauacuacauguaggcugggcaugguggcucacgccuauaaucucaacacuuuggaaggcuaaggugggaggacugccugagcccaggaguucgagaucagccugggcaacauggcgagacacugucucuaauuuaaaaaaaaaaaaaaaguauagguaucuaaaguagccgaauucauagaaauagaaauuagaguggcaguuacuaggggcaggagaagggggaaaugggaaguuauuuaauggauaguuucagaucugcacaugaaaaaguucugaagaucuuuuucacaauaguaaccauaugcuuaacacuacugagcuauacauuuaaaaaugguuaauguaaauuuuauguguuuuuuacuacaauaaaaaaugauaaugaaaauauaaagauuagauagaaauuuaaaaauauguuucuuuuucuucuucuuuuccucuucuucuucuuccuccuccucuucuuccuccuccucuuccuccuccuuuuccuccuccuccuccucuucuuccucuucuuccucuucuucuucuucuuuuuuuuuuuucauucuucccagucugcuauuuaggggcagucaucuuuucauuuuuuaagauguaaauuacauauaguaaaguuugccuuuuuaguguacagcaauaguguuguuuguuuugauucagggcauacaggcacagguuuguaauauggguauguuaugugaugcugagucuugggguucuaauaaucccguugcccaaguggugaacgagguaccucauagguagccuuucagcccuggcuccccucccuccccacuucuggagucuccaguguuuauugcucccaucuuugaguucuacauguuuugaaaaacagugggcauaacaccacuacaguuuagauaugagauaguuccaucacccauaacaaucuccccucccuccccuaccccaaguuucugggaacuucugaucugguuuuugucucuauaguuuuaccuacucuagaaugucucauaaauggaaucauaugguuugcagucuuuaaguguggcuuguuucucuuaccauaauauauuugagauucauucagguuguuauguguaucaguaguuuguuucuuuguauugcugaguauuauugcauugucuagauguaccaugguuuguuuaucuuuucuccaguugagugacauuugguuuguuuccaguuuggaucucuuaagcguucauguccaaauuuuugugguaacauguuuucaauuuucuuggauaaauaacuugaauugggauuacugguuuuuauggaaacucugugucuaacuuuauaaauaacugcaaaacuguucugcaaagugguuguaccauuuuucauucccaccaucaauauauguguuccaauuuuucugccuuuucagcauuuuguauuuucagguuuaaaauuuaaacuauauuuuagcuauucugauagguguguagugguauaucauuaugguuuuaauuugcauuucucuaacaauuaauagcauucagcauuuuuuccaggcgcuuauuuaccauccauauaucuuugauaaagugacuguucaugucuuuugcccuuuucuuuuaauggguuguuuguuuucuugcuauugaguuuugaguucuuuauauauucuggauauaaguccuuuaucagauaugugacuugcgguacuuaauucuggucuauaguuuguuuuuucauucuuguaacauuaucuuucaaaaaacaaguuuuucauuaugguaaaaguccauuuuaucaauuuuuuuucuuccauggauugugcuuuuggugucuuaccuaagaaaucuuuacugguucaagguucaaaagauuuauguuuucuuauagaaguuuuauagguugggauuuuacauuuaguccuaugauccauuuuaaguuaauauuucauauggcguaaagaauggaucaguuguauuuuuuuuuuuugcaguuguuccaguaccauuugcugaagacucuuuucugaauugcuuuacauauuuguggaaaaucgauuugcucuguguguguguguguguguguguguguguguguguguaucuuugaccucucuguuuuguuccauuacucuaugucugucauuuuacuaguaccacacugugguaaugcaaguaguuauuagucuguaguuuuucuuuuuuauaaugucuuuaucuggcuuuaguguuuagggaaugcuggccucauagaaugaguuguaaaguaguuuuuuaaaauuuucugucucucuggaagaguuuguauagaauugauauuauuucuuucuuuaaauauuuaguggaauuuaccagugaaaccauuugagcuugagguuuucuuuauagaaagaguuuaaacuauaaauucaauuuuguaaauagauacaggacuauucaaguuaucuguuucuucucaugugaguuuugguagguugugucuuuauaagaauuuguccauuuuuguuuaaauuguuaaauuuauugaaauaaauuuugauaugccuuguuuuuauuuucauucaguucagaauauuuccuaaucuuccuuuugauugcuuauuugacccauggguuacuuagacguguguaauuuuuccccaaguauuuuucagauaaucucauguuauugauuucuaauuuaauuacauuguagucagagaacauaaugauaaaaucgaccuuuuaucauuauaaugaccuuuauucuuuauaauauucuuugcacugcagucuacuuugaguaauauagccaccucagcuuucuuuuauuguuaacauggaauaucuucuuccauauucuuauuguaccuauuuguguuuuuauauuuaaagucuauuucuuauaggcaguauauaguuguaucuugcuuuuucauccaaacuagcaguaucugcuuuuuaauugaggugcuugagaccauuuauauuuaaugucauuauuguuuuuuuuucuuuuucuuuucuuuucuuuuuuuuuuuuuuuuuuuuuuuuuuuuuugagacagagucuugcucuguuccccaggcuggaguacaguggugcaaucuugagucacugcagccucugccucccagguucaagcgauucuccugccucagccucccaaguagcugggauuacaggcguaugccacuaugcacagcuaauuuuuguauuuuuaguagagauggguuuuuaccauauuggccaggcuggucuugaacucaagugacccacccaccugggccucccaaagugcugggauuacaggcgugagccaccacgcccagccuaaugugauuauugauacaguugguuuaaaucugcuaucuugguauucauuuuuuauucuauucuuuauuccccuuuuccucuuauucuuucuuuuagauuauacauuuuccuaugauuccauuuuauccuccuguguuagcuuuauuagauuuagaguuuauagcauacaucuuuaacuuaucauaguguacucagcaguauauuucccuucucccuucuuagccguuguucuaucuuugucauacauuuuacaucuacauauuguaguacauuccaguacauuguuauuuuugcuuuaaacagucaaugauuauuauagacagagccucaguauguugcccaggcuggccucaaacuccuagcuaggcucaagugguucucccaccucagccuuuugagaagcugggacuacagguauguggcacugcaccuggcaacagucaguuaucuuagauuuaaauacuaagggggaaaaguuuuuguauuuaaccauuaguuaucauuucuggugcucuucacacucuugcguagaucuaguuuuuucaucugguaucauuuuccuucugucugaaggaguuacagugaugaauccuuccagcuuuuguaugucugaaaaagucuuaauuucaccuuaaauuucugaaagauguuuucacugggcauagaauuacagauugacagguuuuuuuuuuucuuucaguuaaagauguugcugcacugucuucuggcuagcauuguuuccaaccagaagucggcuaucauucuuuguugcucuguacauagcaauuuuuuccagcugcuucuaagauuuuaucacugauaguaagcaauuugauuaugauacaccuugucgacuucuucacaauucucuuguuugggguuuguuuagcuucuuggaucuguagguuauuguuuuaguaaaaugugaggaaaauuaccguuauuucuuaaaauguuuucucuccuuuuuuuuuuuuuucagggacuucacuacagauauauuugguugcuugaaacugucccauagcuuauugacacuuuguucuuuuuuugauuuguucuuuuucauucuuuuuuuuuuuuuuuuugacagagucucgcucuguggcucuguggcccaggcuggagugcaguggcgcaaucucggcucacuccaaccucugccuccuggguucaugcaguucuccagccucccagguagcuggaauuacaggugugugccacaacgcccagcuauuuuauauuuuuaguagagaugggguuucaccauauuggccaggcuugucucaaacuccugaccuaaagagauccaccugccucggccucccaaagugcugggauuacaggcaugagccaccacaccuggccgauuuguucuuuuuauucaacguuucuucuguguuuuauuuuggauaguuucuauugcucauauaucacuaauacuacuucuguccuaucuaaucuacuguuaaucucaucuaguguauuuuucuucucaaauauuguauuuuucaccuugauaauuuaauuuagguuuucuuacauuucucacaccuguccuuaauaugcuaauguuuuccucuacuuucuugaacauaugaaauauaguuauaacuguuuuuaauguuccugucuauaaaucaucuuugucauaucugggucauuuugauuaauuuuucuccucaugagugauauuucccugcuuguuuuuaugccuaguacuuuuuauuggaugccagacauugugaauuauuggaugcuagagacuuuauuaaauauucuugagcuuuguuuugagagaaaauuaaguuacuuggaaacaguuugaccuuucagggcuuccuuuuaaacugcuuuauguaggaccaaaacacucuucagucuaggacucauuuuucccuuaaauuaguccuagacugaagggaauuagaauucuucuaagcauucagaaggagacuuaggcaguauacuucugaauaucugauaucccuuuuuacagaguuuuuuuuucauuuaggcuggugggugguaauaccaacuggugccuacccuaugugauuucugaaaauuguucugcuugcuucuuuugggugguucuuuccccagccucggguaguuuccucacaugcaggugugcuaagggcucugcugaagccuggaagcaggaagaacugcugcagaucccuauaaaccuuucuuuuauuuugaaguguuuaaaauuuauuuuauuuaaauuuuuuaaucaaaauacauguacauacccaaaaagcaaauagaaugaauagaaaaaaauagcaguucucuuuuuucacuuauccacucggugccuuagacgcagccacuuuuaaguuuuaguuguuuuuucucauuuuuaccuccacauuucuauguaauauauuuauacuuacacuauuucuugcuuuuuccauuuuagauguuagguaaucaagcuguaguagauuaggauuuagcaguuuuaaaccauuccugccaugcaauuuuucuuccuguuaccuucucaauaaaguuaacuuuuaaaagguaaauccacaaaaaaaugaaaaaauaauaugggucauguauauuuuaugagcauuccguguuuucuuccuugcucuguuuucaguaaaacugccuuugagcuuaucuaauuguuccauuagaucuaucauacaccuaucaguagcucaccugugcccugcaaaugcuuagauguguuagauaaucuguguguucauuagcacggaagcucucccuccuggaguucuccaucuucccuuaccauugcagaccagguacagaccagcugcagcuugggcuuguccagcagcagucccccugagaucucccugcacuccagccugcugauucccuuccuuuccuccaguaucugaguuccugguuccuauuucccaugccugccuuuuuucuugauuugcuccuccauuuuggugucugaaauaucuaaaaauguuuuaauucuaccuuuacacucaaaugaugauuuggccaaguaaagaauucuggauaaaaaaacucuuuucucucagaauuuuaaagacauuuucuucaucuuuuucugacugccagcaaagugguucuguuccuagucccuguguuuguaacuuguuucuuccauuuggaagcuuuuaguauuuucucucuaugccuagugauuaagguuucaggguggugugcuuugguggagggcuuuuucauuucuuguggugggcauuuggucaucucauuuaacuggagacuuguguccuucaguucuggaacaauucuuaaauuauuugauaauucucuuccuucuguucucucuccaaaauagaaaugcauccuauuuugauguuggaccuccuagauuuauccuuuuucuuuuccgauucuuuuuuuuuuuuuuuuuuuuuuugagacagagccuugcccuguugccuaggcuggagugcaaugaugcgaucucagcucacugcaaccucugccuccuggguucaagcaauucuucgucagccuccccaguagcugggauuauagacaugugccaccacgcccagcuaauuuauuuguuuuuguuuuuuuuuaaaguggagacgggguuuuaccauguuggcaaggcuggucuugaacuccugaccucaagugauccgcccaucucacccucucaaagugcugggauuacaggcaugagccaucgcgcucgcgcccggccacuguucuacucuuuuggaagcuuuuuccaaccagccuuucuguggagauaaggaaauguaaauugugguugaauuuaacagccauuucuuuggcauuucuucuuguuuugacagugugugggacccaacacuaaaacacuauuuguuguuuuucugccauucacauuuaacugauaguccuguaguuucauuuguuaaaccugguaaguauauucccaugccuagugagaguaaacuagaaaaauggaggugacgugggaguccuuagacagcagugauuuggucagguacaggguaaugugccuucgcuucuuuccuggcaguuguuuuagauuugcaaggaguuuggauagggggagaaagagguuacucuauuucagugcugaaucuccaacuguaccgguguuggccaagucagauuaaguuuggaagaaaagcacauguuacaggaaacagaaacacucaggccuguuccucuuuuccuauccugucaugcuugcuaccaauaugcaguagcaguugaauuggaaucuguguaaaaaggcuuuuaggcagacaacacuagaaaauaccucaaucucaauuguccaggcuguuuaauguguaugaguucccacugaggugauaccuccugaucuuugcucagugccugaaauagacuuauaugguccauggcuuuaaggaucucuccuggaagccuuguaguauuuuucucugcccugucagcaagucucagugagcucugaugaggcaccagacauauggaucguuugucuugcaauuagaagagccuuugaauguaauucuagccauuugugccacggacauuucugauccaaggguuuucccuccauggagcuuuccauuuccuuugccuucuuuuucaaauuaugucuucucaguuuucauacaaaagucuaguuuuaaaggaaucuagcauauuuaugugaaauauaugagaaaauuagauuucuaaucauuuuuuuaguugccuauccuuuggcucaacaaauucuccagaagugugcacacacacauacauguucaaggauguauguagaaggauguuccuugcaauuuuauuuaaaauauccaaguauuaacaauaacuguaauguccuucaauaggaaaauggguuaaauagacuaugguugcuuauauuugcuucucuugcuugauacaauggaugaucaguuaaaaugauugaaauaaaaacagcuuucuguuuauguugaagaacggcaugaauaaauucaguuaauuuaguaauuuuuuaaaacugcagcuuggaauuuaaaaauuuuuuuauaugaccuuagaguuuuguuuuuuaaagcucuuuuuauagcuuaaauggugcuuuaauacccuuuuuucaugaaguuggcauucaguuaaaacauguaaauggaauuuagcauacaaauaguuuuagguauaacuuuaacuuucaaaauauagagacuaucauguaguaaauaauauucugguuagcauucauagacauagggaccacaugccagcuucccaaauaauuacgauuucuaagcuucuacuuagucuccuuuuguuggaaauggguaucuuuuuuuuuaaagcaucauaugaguuaauauauguaauuuuuauaaauuauaaauauguuaacaauuauuguuauucaaaagccaagccuuaaaauuuggagaauaugaaccuuucaguaaaaagggaaucucaucacuuuauaguuggucacacuuugguuuuuaacccaaaagagaauuguggucuucaucauuuacugugcuuaccgaucuggucugguuccuaauaacuuuggacaguuucugaaaaccaaaucuaccuacccccacuaccagcauugagucaacuuaaaaacugucuaaauggaucugauggcaauuuuagaaaaggaugcugcuugaggaaagaugcuuauuuuggagagaagacuguguguguuugugcaugugcguguauuacauauauauguucuacggucagauuuuauguuggaauuauuugugaugacacaauuuuaucuacagauuagagaggucuccccaaguacuuuguagauuuuuugguuuuuauauuaugccauuagagggcaguauuguagagguuaaguuuucuuucucgcauguauugacuuggaaacuguuuauguuguauuauaauuuagcaaacuucagggcuuagauuucuaguauauuaaauuguagccuuaauugaugcaucccugcaaguauuuuaaauuaauauaggaaauuuugaaaggguuaagcuauuuuauacccacaucucucgauuuugguuuggagaagggaauuauuuggucaguguggccaagagggugaaacagaggugagccuacagcaucuauuggcugcuuaacuauuuuuaaccaccauuauauccucccuuuucugguucuggacacugcaaaugggcagagacuaacuucaaggauuuguaugcuuugaauacauacuuuauaauauuucaaucccucugauguaagaaggcucauaggauugagggauugagucuuagaggaauugucacucagcuugcaaaaacgugccuuagggacuuaacuaaaaauagauuuauguggaauucaaccuguggauugacuuuuuugggucuaaauagaagaaggcauauuuaguuacuagggagaagaugcuaauagggagaugugauuuuaagguuuguggcucuacgggcuuuuugggaagauccuggauuuuaucuggagucuuucccucaugccuagcaaagaauauauaauguuuuuuguuuuguuucuauaaaacaaaagguaguaucucucaaagagcaaaugugauuuuuuuuccucuaaaauuaaaaaaauacaugauugcagggugauuauuaucuuuaaaaauaaaaccgucuauaaaauccucccaguaccgcugccgguaagaacuagauaauugaaaucaagacacucgaagucuuacaguggugggacugggcaugcccaguagcucagacgguucggguuacaaauaggaagcuuucgccguuaagcagccgcgggacacagcuccggggaccggggucugacucccuuaaacguaagcacgugugggggcccccauaguauuuuucagggacccuucacauuuucugccgaagcaauggcccaguguuuugaggccgccguggaaaccuccgaacccagcaccccacucccucugagcacggcccgcgccaggccagcccaccccacgagcgggaucuggagaaugggggcggagguggggguggggggaggcggggaagcagggaagcgggaggaccuggaagggaguagggggcggucccaguggcgugccggccaaucggcgcagcucuuuccugcauauauuuugcacuaagacugggaguccuggucuagagcugaguggagcccggcugcggaucugggaagcgccucuucacggcacugggauccgcaucugccugggaucaucaagcccuagaagcuggguuucuuuaaauuagggcugccguuuucuguuucucccugggcugcggaaagccagaagauuuuaucuagcuuauacaaggcugcugguguucccucuuuuuuuccacgaggguguuuuuggcugcaauugcaugaaaucccaaugguguagaccaguggcgauggaucuaggaguuuaccaacugagacauuuuucaauuucuuucuugucauccuugcuggggacugaaaacgcuucugugagacuugauaauagguaaaugucggcuaagauaguuucuuuaaauuuauucgugggauacuuauaauaauacaggugaaagauagccaggcgaauuccuuuguccauugcugagagauuauggugacauggauguuguuuuucgaaauguuaaaaaaccuuauuuuugcaagucuggccagagaacaggcuuuccccacauuauguaauuuaguccuuuguggcuuacuaaaauagggagaugccuggauauucguuaguaagagaggggcuggcauuuucuggagggugauacauuacauaguguuaaauaacauucaaaauaugaugcuagcaauaucacaaaauugggagauccuuuuuaucuuggaagcuuaagauaaauuccauuuaucgaugaccuuuuucccuccucuuuuucagcuccucuggugcaagugugguagcuauugacaacaaaaucgagcaagcuaugguauguacugaugaaaaaucauuuauacuaaaugugggcacagcacaaaaauaagauguuuuguggaaccagugcaucccuaaguucagaugaugaugauugcucuugaugcgcguagaaaugccggcgcugucuccauucggccagcguggagccaccuaccacggcagccguggagggagaaaggggcccugcggguauuaaauggucuucuuccccggacugguuucacacgacgggauuuucucacggugacccuuuuugcuggggauuuauuagggaagcgcuggccaacuaucuccuucggcuggucgugagcacaccuuuagcgauguggcuuuacuaggaauccuaauauuuuacuagggagccgggagguggggagggccccagaagucgggauccuggauaagggucuucuagacggugcacaaacggguccccgguggcgcgggcuccuucacaaugaagaagaaucagagaaaaaguuuuguuuucuuagccugcgccuggauuucuccuauuuuuuauuuccgccuuggccguucuuuguuauuggagcagcgccuguggcucuucucacgggauucucugcccacuguugcuaggcaaacucugaaccuuuaauucggagcuauaaauaacucgggcucccauuggcugcgacgucugcccagguuucugugaugucagcuuaaucacgaaaagaggggggcgggguggagggaagaaaaugcggcaacauguucgguaggaacuggcugcagccggugcugaaggaggcggcuccgggcgagcgcggggcggggccugggggcggggacgcggugggcgcgcuguggcuuggacguccccgcugcuggucucagucggggacccagcgcccggcucuggcccagucucaggaagccuuacuugggcguuucuggccaacgucugcagagaagcacagacuuuuacaaagcuugaucauuuauacguuaaacucaaguauuguacagucauguuuguauucagauuuccccaagugucauugaaccaacuuuaaagguggaauauguaaauaguuagggagauccauguaaaauaaugucuuggaaacucaaaagaguccagaaaauaccaaauaaugaguuaaaccuuuucugucuucuuuccaggaucuagugaaaagccauuugauguaugcggucagagaagaaguggagguccucaaagagcaaaucaaagaacuaauagagaaaaauucccagcuggagcaggagaacaaucugcugaagacacuggccaguccugagcagcuugcccaguuucaggcccagcugcagacuggcucccccccugccaccacccagccacagggcaccacacagccccccgcccagccagcaucgcagggcucaggaccaaccgcauagcugccuaugcccccgcagaacuggcugcugcgugugaacugaacagacggagaagaugugcuagggagaaucugccuccacagucacccauuucauugcucgcugcgaaagagacgugagacugacauaugccauuaucucuuuuccaguauuaaacacucauaugcuuauggcuuggagaaauuucuuaguugggugaauuaaagguuaauccgagaauuagcauggauauaccgggaccucaugcagcuuggcagauaucugagaaaugguuuaauucaugcucaggagcugugugccuuuccaucccuuccggcucccuaccccucacuuccaaggguucucucuccugcuugcgcuuaguguccuacaugggguugugaagcgauggagcuccucacuggacucgccucucuccucuccuccccccaggaggaacuugaaaggaggguaaaaagacuaaaaugagggggaacagaguucacuguacaaauuugacaacugucaccaaaauucauaaaaaacaauaguacugugccucuuucuucucaaacaauggaugacacaaaacuaugagagugacaaaauggugacagguagcugggaccuaggcuaucuuaccaugaagguuguuuugcuuauuguauauuuguguauguaguguaacuauuuuguacaauagaggacuguaacuacuauuuagguuguacagauugaaauuuaguuguuucauuggcugucugaggagguguggacuuuuauauauagaucuacauaaaaacugcuacaugacaaaaaccacaccuaaagaaauuuuaagaauuuggcacaguuacucacuuuguguaaucugaaaucuagcugcugaauacgcugaaguaaauccuuguucacugaagucuuucaauugagcugguugaauacuuugaaaaaugcucaguucuaacuaaugaaauggauuucccaguagggguuucugcauaucaccuguauaguaguuauaugcauauguuucugugcauguucucuacacaauuguaaggugucacuguauuuaacuguugcacuugucaacuuucaauaaagcauauaaauguuga

SEQ ID NO: 21522 - RNA, 142815 nt, Homo sapiens
ucaacauuuauaugcuuuauugaaaguugacaagugcaacaguuaaauacagugacaccuuacaauuguguagagaacaugcacagaaacauaugcauauaacuacuauacaggugauaugcagaaaccccuacugggaaauccauuucauuaguuagaacugagcauuuuucaaaguauucaaccagcucaauugaaagacuucagugaacaaggauuuacuucagcguauucagcagcuagauuucagauuacacaaagugaguaacugugccaaauucuuaaaauuucuuuaggugugguuuuugucauguagcaguuuuuauguagaucuauauauaaaaguccacaccuccucagacagccaaugaaacaacuaaauuucaaucuguacaaccuaaauaguaguuacaguccucuauuguacaaaauaguuacacuacauacacaaauauacaauaagcaaaacaaccuucaugguaagauagccuaggucccagcuaccugucaccauuuugucacucucauaguuuugugucauccauuguuugagaagaaagaggcacaguacuauuguuuuuuaugaauuuuggugacaguugucaaauuuguacagugaacucuguucccccucauuuuagucuuuuuacccuccuuucaaguuccuccuggggggaggagaggagagaggcgaguccagugaggagcuccaucgcuucacaaccccauguaggacacuaagcgcaagcaggagagagaacccuuggaagugagggguagggagccggaagggauggaaaggcacacagcuccugagcaugaauuaaaccauuucucagauaucugccaagcugcaugaggucccgguauauccaugcuaauucucggauuaaccuuuaauucacccaacuaagaaauuucuccaagccauaagcauaugaguguuuaauacuggaaaagagauaauggcauaugucagucucacgucucuuucgcagcgagcaaugaaaugggugacuguggaggcagauucucccuagcacaucuucuccgucuguucaguucacacgcagcagccaguucugcgggggcauaggcagcuaugcgguugguccugagcccugcgaugcuggcugggcggggggcuguguggugcccuguggcugggugguggcagggggggagccagucugcagcugggccugaaacugggcaagcugcucaggacuggccagugucuucagcagauuguucuccugcuccagcugggaauuuuucucuauuaguucuuugauuugcucuuugaggaccuccacuucuucucugaccgcauacaucaaauggcuuuucacuagauccuggaaagaagacagaaaagguuuaacucauuauuugguauuuucuggacucuuuugaguuuccaagacauuauuuuacauggaucucccuaacuauuuacauauuccaccuuuaaaguugguucaaugacacuuggggaaaucugaauacaaacaugacuguacaauacuugaguuuaacguauaaaugaucaagcuuuguaaaagucugugcuucucugcagacguuggccagaaacgcccaaguaaggcuuccugagacugggccagagccgggcgcuggguccccgacugagaccagcagcggggacguccaagccacagcgcgcccaccgcguccccgcccccaggccccgccccgcgcucgcccggagccgccuccuucagcaccggcugcagccaguuccuaccgaacauguugccgcauuuucuucccuccaccccgccccccucuuuucgugauuaagcugacaucacagaaaccugggcagacgucgcagccaaugggagcccgaguuauuuauagcuccgaauuaaagguucagaguuugccuagcaacagugggcagagaaucccgugagaagagccacaggcgcugcuccaauaacaaagaacggccaaggcggaaauaaaaaauaggagaaauccaggcgcaggcuaagaaaacaaaacuuuuucucugauucuucuucauugugaaggagcccgcgccaccggggacccguuugugcaccgucuagaagacccuuauccaggaucccgacuucuggggcccuccccaccucccggcucccuaguaaaauauuaggauuccuaguaaagccacaucgcuaaaggugugcucacgaccagccgaaggagauaguuggccagcgcuucccuaauaaauccccagcaaaaagggucaccgugagaaaaucccgucgugugaaaccaguccggggaagaagaccauuuaauacccgcagggccccuuucucccuccacggcugccgugguagguggcuccacgcuggccgaauggagacagcgccggcauuucuacgcgcaucaagagcaaucaucaucaucugaacuuagggaugcacugguuccacaaaacaucuuauuuuugugcugugcccacauuuaguauaaaugauuuuucaucaguacauaccauagcuugcucgauuuuguugucaauagcuaccacacuugcaccagaggagcugaaaaagaggagggaaaaaggucaucgauaaauggaauuuaucuuaagcuuccaagauaaaaaggaucucccaauuuugugauauugcuagcaucauauuuugaauguuauuuaacacuauguaauguaucacccuccagaaaaugccagccccucucuuacuaacgaauauccaggcaucucccuauuuuaguaagccacaaaggacuaaauuacauaauguggggaaagccuguucucuggccagacuugcaaaaauaagguuuuuuaacauuucgaaaaacaacauccaugucaccauaaucucucagcaauggacaaaggaauucgccuggcuaucuuucaccuguauuauuauaaguaucccacgaauaaauuuaaagaaacuaucuuagccgacauuuaccuauuaucaagucucacagaagcguuuucaguccccagcaaggaugacaagaaagaaauugaaaaaugucucaguugguaaacuccuagauccaucgccacuggucuacaccauugggauuucaugcaauugcagccaaaaacacccucguggaaaaaaagagggaacaccagcagccuuguauaagcuagauaaaaucuucuggcuuuccgcagcccagggagaaacagaaaacggcagcccuaauuuaaagaaacccagcuucuagggcuugaugaucccaggcagaugcggaucccagugccgugaagaggcgcuucccagauccgcagccgggcuccacucagcucuagaccaggacucccagucuuagugcaaaauauaugcaggaaagagcugcgccgauuggccggcacgccacugggaccgcccccuacucccuuccagguccucccgcuucccugcuuccccgccuccccccacccccaccuccgcccccauucuccagaucccgcucguggggugggcuggccuggcgcgggccgugcucagagggaguggggugcuggguucggagguuuccacggcggccucaaaacacugggccauugcuucggcagaaaaugugaagggucccugaaaaauacuaugggggcccccacacgugcuuacguuuaagggagucagaccccgguccccggagcugugucccgcggcugcuuaacggcgaaagcuuccuauuuguaacccgaaccgucugagcuacugggcaugcccagucccaccacuguaagacuucgagugucuugauuucaauuaucuaguucuuaccggcagcgguacugggaggauuuuauagacgguuuuauuuuuaaagauaauaaucacccugcaaucauguauuuuuuuaauuuuagaggaaaaaaaaucacauuugcucuuugagagauacuaccuuuuguuuuauagaaacaaaacaaaaaacauuauauauucuuugcuaggcaugagggaaagacuccagauaaaauccaggaucuucccaaaaagcccguagagccacaaaccuuaaaaucacaucucccuauuagcaucuucucccuaguaacuaaauaugccuucuucuauuuagacccaaaaaagucaauccacagguugaauuccacauaaaucuauuuuuaguuaagucccuaaggcacguuuuugcaagcugagugacaauuccucuaagacucaaucccucaauccuaugagccuucuuacaucagagggauugaaauauuauaaaguauguauucaaagcauacaaauccuugaaguuagucucugcccauuugcaguguccagaaccagaaaagggaggauauaauggugguuaaaaauaguuaagcagccaauagaugcuguaggcucaccucuguuucacccucuuggccacacugaccaaauaauucccuucuccaaaccaaaaucgagagauguggguauaaaauagcuuaacccuuucaaaauuuccuauauuaauuuaaaauacuugcagggaugcaucaauuaaggcuacaauuuaauauacuagaaaucuaagcccugaaguuugcuaaauuauaauacaacauaaacaguuuccaagucaauacaugcgagaaagaaaacuuaaccucuacaauacugcccucuaauggcauaauauaaaaaccaaaaaaucuacaaaguacuuggggagaccucucuaaucuguagauaaaauugugucaucacaaauaauuccaacauaaaaucugaccguagaacauauauauguaauacacgcacaugcacaaacacacacagucuucucuccaaaauaagcaucuuuccucaagcagcauccuuuucuaaaauugccaucagauccauuuagacaguuuuuaaguugacucaaugcugguaguggggguagguagauuugguuuucagaaacuguccaaaguuauuaggaaccagaccagaucgguaagcacaguaaaugaugaagaccacaauucucuuuuggguuaaaaaccaaagugugaccaacuauaaagugaugagauucccuuuuuacugaaagguucauauucuccaaauuuuaaggcuuggcuuuugaauaacaauaauuguuaacauauuuauaauuuauaaaaauuacauauauuaacucauaugaugcuuuaaaaaaaaagauacccauuuccaacaaaaggagacuaaguagaagcuuagaaaucguaauuauuugggaagcuggcauguggucccuaugucuaugaaugcuaaccagaauauuauuuacuacaugauagucucuauauuuugaaaguuaaaguuauaccuaaaacuauuuguaugcuaaauuccauuuacauguuuuaacugaaugccaacuucaugaaaaaaggguauuaaagcaccauuuaagcuauaaaaagagcuuuaaaaaacaaaacucuaaggucauauaaaaaaauuuuuaaauuccaagcugcaguuuuaaaaaauuacuaaauuaacugaauuuauucaugccguucuucaacauaaacagaaagcuguuuuuauuucaaucauuuuaacugaucauccauuguaucaagcaagagaagcaaauauaagcaaccauagucuauuuaacccauuuuccuauugaaggacauuacaguuauuguuaauacuuggauauuuuaaauaaaauugcaaggaacauccuucuacauacauccuugaacauguaugugugugugcacacuucuggagaauuuguugagccaaaggauaggcaacuaaaaaaaugauuagaaaucuaauuuucucauauauuucacauaaauaugcuagauuccuuuaaaacuagacuuuuguaugaaaacugagaagacauaauuugaaaaagaaggcaaaggaaauggaaagcuccauggagggaaaacccuuggaucagaaauguccguggcacaaauggcuagaauuacauucaaaggcucuucuaauugcaagacaaacgauccauaugucuggugccucaucagagcucacugagacuugcugacagggcagagaaaaauacuacaaggcuuccaggagagauccuuaaagccauggaccauauaagucuauuucaggcacugagcaaagaucaggagguaucaccucagugggaacucauacacauuaaacagccuggacaauugagauugagguauuuucuaguguugucugccuaaaagccuuuuuacacagauuccaauucaacugcuacugcauauugguagcaagcaugacaggauaggaaaagaggaacaggccugaguguuucuguuuccuguaacaugugcuuuucuuccaaacuuaaucugacuuggccaacaccgguacaguuggagauucagcacugaaauagaguaaccucuuucucccccuauccaaacuccuugcaaaucuaaaacaacugccaggaaagaagcgaaggcacauuacccuguaccugaccaaaucacugcugucuaaggacucccacgucaccuccauuuuucuaguuuacucucacuaggcaugggaauauacuuaccagguuuaacaaaugaaacuacaggacuaucaguuaaaugugaauggcagaaaaacaacaaauaguguuuuaguguugggucccacacacugucaaaacaagaagaaaugccaaagaaauggcuguuaaauucaaccacaauuuacauuuccuuaucuccacagaaaggcugguuggaaaaagcuuccaaaagaguagaacaguggccgggcgcgagcgcgauggcucaugccuguaaucccagcacuuugagagggugagaugggcggaucacuugaggucaggaguucaagaccagccuugccaacaugguaaaaccccgucuccacuuuaaaaaaaaacaaaaacaaauaaauuagcugggcgugguggcacaugucuauaaucccagcuacuggggaggcugacgaagaauugcuugaacccaggaggcagagguugcagugagcugagaucgcaucauugcacuccagccuaggcaacagggcaaggcucugucucaaaaaaaaaaaaaaaaaaaaaaagaaucggaaaagaaaaaggauaaaucuaggagguccaacaucaaaauaggaugcauuucuauuuuggagagagaacagaaggaagagaauuaucaaauaauuuaagaauuguuccagaacugaaggacacaagucuccaguuaaaugagaugaccaaaugcccaccacaagaaaugaaaaagcccuccaccaaagcacaccacccugaaaccuuaaucacuaggcauagagagaaaauacuaaaagcuuccaaauggaagaaacaaguuacaaacacagggacuaggaacagaaccacuuugcuggcagucagaaaaagaugaagaaaaugucuuuaaaauucugagagaaaagaguuuuuuuauccagaauucuuuacuuggccaaaucaucauuugaguguaaagguagaauuaaaacauuuuuagauauuucagacaccaaaauggaggagcaaaucaagaaaaaaggcaggcaugggaaauaggaaccaggaacucagauacuggaggaaaggaagggaaucagcaggcuggagugcagggagaucucagggggacugcugcuggacaagcccaagcugcagcuggucuguaccuggucugcaaugguaagggaagauggagaacuccaggagggagagcuuccgugcuaaugaacacacagauuaucuaacacaucuaagcauuugcagggcacaggugagcuacugauagguguaugauagaucuaauggaacaauuagauaagcucaaaggcaguuuuacugaaaacagagcaaggaagaaaacacggaaugcucauaaaauauacaugacccauauuauuuuuucauuuuuuuguggauuuaccuuuuaaaaguuaacuuuauugagaagguaacaggaagaaaaauugcauggcaggaaugguuuaaaacugcuaaauccuaaucuacuacagcuugauuaccuaacaucuaaaauggaaaaagcaagaaauaguguaaguauaaauauauuacauagaaauguggagguaaaaaugagaaaaaacaacuaaaacuuaaaaguggcugcgucuaaggcaccgaguggauaagugaaaaaagagaacugcuauuuuuuucuauucauucuauuugcuuuuuggguauguacauguauuuugauuaaaaaauuuaaauaaaauaaauuuuaaacacuucaaaauaaaagaaagguuuauagggaucugcagcaguucuuccugcuuccaggcuucagcagagcccuuagcacaccugcaugugaggaaacuacccgaggcuggggaaagaaccacccaaaagaagcaagcagaacaauuuucagaaaucacauaggguaggcaccaguugguauuaccacccaccagccuaaaugaaaaaaaaacucuguaaaaagggauaucagauauucagaaguauacugccuaagucuccuucugaaugcuuagaagaauucuaauucccuucagucuaggacuaauuuaagggaaaaaugaguccuagacugaagaguguuuugguccuacauaaagcaguuuaaaaggaagcccugaaaggucaaacuguuuccaaguaacuuaauuuucucucaaaacaaagcucaagaauauuuaauaaagucucuagcauccaauaauucacaaugucuggcauccaauaaaaaguacuaggcauaaaaacaagcagggaaauaucacucaugaggagaaaaauuaaucaaaaugacccagauaugacaaagaugauuuauagacaggaacauuaaaaacaguuauaacuauauuucauauguucaagaaaguagaggaaaacauuagcauauuaaggacaggugugagaaauguaagaaaaccuaaauuaaauuaucaaggugaaaaauacaauauuugagaagaaaaauacacuagaugagauuaacaguagauuagauaggacagaaguaguauuagugauauaugagcaauagaaacuauccaaaauaaaacacagaagaaacguugaauaaaaagaacaaaucggccaggugugguggcucaugccuguaaucccagcacuuugggaggccgaggcagguggaucucuuuaggucaggaguuugagacaagccuggccaauauggugaaaccccaucucuacuaaaaauauaaaauagcugggcguuguggcacacaccuguaauuccagcuaccugggaggcuggagaacugcaugaacccaggaggcagagguuggagugagccgagauugcgccacugcacuccagccugggccacagagccacagagcgagacucugucaaaaaaaaaaaaaaaaagaaugaaaaagaacaaaucaaaaaaagaacaaagugucaauaagcuaugggacaguuucaagcaaccaaauauaucuguagugaagucccugaaaaaaaaaaaaaaggagagaaaacauuuuaagaaauaacgguaauuuuccucacauuuuacuaaaacaauaaccuacagauccaagaagcuaaacaaaccccaaacaagagaauugugaagaagucgacaagguguaucauaaucaaauugcuuacuaucagugauaaaaucuuagaagcagcuggaaaaaauugcuauguacagagcaacaaagaaugauagccgacuucugguuggaaacaaugcuagccagaagacagugcagcaacaucuuuaacugaaagaaaaaaaaaaaccugucaaucuguaauucuaugcccagugaaaacaucuuucagaaauuuaaggugaaauuaagacuuuuucagacauacaaaagcuggaaggauucaucacuguaacuccuucagacagaaggaaaaugauaccagaugaaaaaacuagaucuacgcaagagugugaagagcaccagaaaugauaacuaaugguuaaauacaaaaacuuuucccccuuaguauuuaaaucuaagauaacugacuguugccaggugcagugccacauaccuguagucccagcuucucaaaaggcugaggugggagaaccacuugagccuagcuaggaguuugaggccagccugggcaacauacugaggcucugucuauaauaaucauugacuguuuaaagcaaaaauaacaauguacuggaauguacuacaauauguagauguaaaauguaugacaaagauagaacaacggcuaagaagggagaagggaaauauacugcugaguacacuaugauaaguuaaagauguaugcuauaaacucuaaaucuaauaaagcuaacacaggaggauaaaauggaaucauaggaaaauguauaaucuaaaagaaagaauaagaggaaaaggggaauaaagaauagaauaaaaaaugaauaccaagauagcagauuuaaaccaacuguaucaauaaucacauuaggcugggcgugguggcucacgccuguaaucccagcacuuugggaggcccaggugggugggucacuugaguucaagaccagccuggccaauaugguaaaaacccaucucuacuaaaaauacaaaaauuagcugugcauaguggcauacgccuguaaucccagcuacuugggaggcugaggcaggagaaucgcuugaaccugggaggcagaggcugcagugacucaagauugcaccacuguacuccagccuggggaacagagcaagacucugucucaaaaaaaaaaaaaaaaaaaaaaaaaaaaaagaaaagaaaagaaaaagaaaaaaaaacaauaaugacauuaaauauaaauggucucaagcaccucaauuaaaaagcagauacugcuaguuuggaugaaaaagcaagauacaacuauauacugccuauaagaaauagacuuuaaauauaaaaacacaaauagguacaauaagaauauggaagaagauauuccauguuaacaauaaaagaaagcugagguggcuauauuacucaaaguagacugcagugcaaagaauauuauaaagaauaaaggucauuauaaugauaaaaggucgauuuuaucauuauguucucugacuacaauguaauuaaauuagaaaucaauaacaugagauuaucugaaaaauacuuggggaaaaauuacacacgucuaaguaacccaugggucaaauaagcaaucaaaaggaagauuaggaaauauucugaacugaaugaaaauaaaaacaaggcauaucaaaauuuauuucaauaaauuuaacaauuuaaacaaaaauggacaaauucuuauaaagacacaaccuaccaaaacucacaugagaagaaacagauaacuugaauaguccuguaucuauuuacaaaauugaauuuauaguuuaaacucuuucuauaaagaaaaccucaagcucaaaugguuucacugguaaauuccacuaaauauuuaaagaaagaaauaauaucaauucuauacaaacucuuccagagagacagaaaauuuuaaaaaacuacuuuacaacucauucuaugaggccagcauucccuaaacacuaaagccagauaaagacauuauaaaaaagaaaaacuacagacuaauaacuacuugcauuaccacagugugguacuaguaaaaugacagacauagaguaauggaacaaaacagagaggucaaagauacacacacacacacacacacacacacacacacacacagagcaaaucgauuuuccacaaauauguaaagcaauucagaaaagagucuucagcaaaugguacuggaacaacugcaaaaaaaaaaaauacaacugauccauucuuuacgccauaugaaauauuaacuuaaaauggaucauaggacuaaauguaaaaucccaaccuauaaaacuucuauaagaaaacauaaaucuuuugaaccuugaaccaguaaagauuucuuagguaagacaccaaaagcacaauccauggaagaaaaaaaauugauaaaauggacuuuuaccauaaugaaaaacuuguuuuuugaaagauaauguuacaagaaugaaaaaacaaacuauagaccagaauuaaguaccgcaagucacauaucugauaaaggacuuauauccagaauauauaaagaacucaaaacucaauagcaagaaaacaaacaacccauuaaaagaaaagggcaaaagacaugaacagucacuuuaucaaagauauauggaugguaaauaagcgccuggaaaaaaugcugaaugcuauuaauuguuagagaaaugcaaauuaaaaccauaaugauauaccacuacacaccuaucagaauagcuaaaauauaguuuaaauuuuaaaccugaaaauacaaaaugcugaaaaggcagaaaaauuggaacacauauauugauggugggaaugaaaaaugguacaaccacuuugcagaacaguuuugcaguuauuuauaaaguuagacacagaguuuccauaaaaaccaguaaucccaauucaaguuauuuauccaagaaaauugaaaacauguuaccacaaaaauuuggacaugaacgcuuaagagauccaaacuggaaacaaaccaaaugucacucaacuggagaaaagauaaacaaaccaugguacaucuagacaaugcaauaauacucagcaauacaaagaaacaaacuacugauacacauaacaaccugaaugaaucucaaauauauuaugguaagagaaacaagccacacuuaaagacugcaaaccauaugauuccauuuaugagacauucuagaguagguaaaacuauagagacaaaaaccagaucagaaguucccagaaacuugggguaggggagggaggggagauuguuaugggugauggaacuaucucauaucuaaacuguagugguguuaugcccacuguuuuucaaaacauguagaacucaaagaugggagcaauaaacacuggagacuccagaaguggggagggaggggagccagggcugaaaggcuaccuaugagguaccucguucaccacuugggcaacgggauuauuagaaccccaagacucagcaucacauaacauacccauauuacaaaccugugccuguaugcccugaaucaaaacaaacaacacuauugcuguacacuaaaaaggcaaacuuuacuauauguaauuuacaucuuaaaaaaugaaaagaugacugccccuaaauagcagacugggaagaaugaaaaaaaaaaaagaagaagaagaagaggaagaagaggaagaagaggaggaggaggaggaaaaggaggaggaagaggaggaggaagaagaggaggaggaagaagaagaagaggaaaagaagaagaaaaagaaacauauuuuuaaauuucuaucuaaucuuuauauuuucauuaucauuuuuuauuguaguaaaaaacacauaaaauuuacauuaaccauuuuuaaauguauagcucaguaguguuaagcauaugguuacuauugugaaaaagaucuucagaacuuuuucaugugcagaucugaaacuauccauuaaauaacuucccauuucccccuucuccugccccuaguaacugccacucuaauuucuauuucuaugaauucggcuacuuuagauaccuauacuuuuuuuuuuuuuuuaaauuagagacagugucucgccauguugcccaggcugaucucgaacuccugggcucaggcaguccucccaccuuagccuuccaaaguguugagauuauaggcgugagccaccaugcccagccuacauguaguauuuugauuuaaaacauuuuaaacuaaaagaaaaaagggaacaaaaacuauuuuaaaagauauaaugcaaggacuuaaauauauucauugaggagaccuaaaaaugccuauuuuauaacuaauuguucuaucauuauauaaaaugcauuacuaggcuugaauuuuuuaacuauaauuuugcucuguucuuagaacuguugaguuuguuggugauuaaucauuccuaaaucucauauuagcguuaaaagauuuguaaaaauuaaauacuugcuuuaagugugagaauuuuaaaagucuuaaaaugcuaauagauuuaaauauaaucuuuuauuuauauacaccuauauauaacacauguauuuacccucuguaaauacauuuuuucuguauuuuucucucucuaaacauuuauaauuacuuuuaaauuguuacaauucuagaaacaauuuuaaguuuucccauggcugucuucaccuuauuuagcauaacuacuaauuccaaaagaauaucuauaaugcuaagaagacccaaugccuuuucuuuuuuuuuuuuuuuuuuuuaagaugguaagggagacuuuaagaggaacuacugcaaugggagagagagauggggcucaacuccucucaaugcccuucagcaacaggacucaaaugguuaacauucuuauuuuacuuuuuaucuucaugaaaauaauaagcauuucaaacccaaauuucuucauaaauuaccacuucugcuuaauagugguagauuaugaaaaucuggagccacagacaaaaaaggaaucacagauuuagaagccaaaugauauucuauauaaaacaucugaagaagugacaaguuguccugauuaugauuuucuauuucgagaaccucaugcaagugagguucuugcaugaagugaaaaaugaauauuauuucuuuuacuuuugcacagcuaugaaaaauagaugcuuugagcacuuuuuaaaaauaacuaguuacuuuaagcuaauuuuccuguuaaauuccagaagaaaacaacgauaagcaguccuaaaagaccugguaggaacuagacuaaccaacuaaccauuuuucuaugcauacagagccacuuagggucauuagaggcagucucuuggugacucuaaaacaaucagaugaagcucaauuacacaguuguauuuacaacgguaaagauaaauuuaaggauauuaccuagcuccagaaugucuaauguaguacaggccuagguaagcauuaacacauuggcaaaguugacucugugugcuggggacacaguguguuuacauaauaaauaccucugcuucgaucaagggacacauuucuacauuauggccuccaugggcagcagcucugugacauaaaugaggucugaggguuucuuuaacccucugaucuauucagaauuauaaagcaaaauggaccuuggagaucauuuaauuuucuuauucucuagguuuagaaauggaggcucaaaggcauuaggugcuuuguccagggucuaccucaucaacuguuggauggagcauagaaccaaaugcugauucaauauagugugcccuagaagugcacaccagaaauucuagauccguguguguguguguguguguguguaagauguuagaccuggaagaauaaagggaccauaaagugaaaugcccuucugcugaucucaacggagccacaguauucauugaaagccacccauuuuacagauuaagaaacaagcugggaggcuguguggaaaccacagccagagacccaugcugcaugugagucaggcagccuggcugcaggguuucugggccuagucuagaguggagcuggugagcucuuggugagaacuggcccuccacagcuuccuuucugaggcugggcaggcugacaggggcacucagaucagucccagugccagugaggucuacaguuugagaaggugcucuccaggcacugggacaaggucccgacagagaaaggggcucaccacagacacagagccacacuugcugacggacacauuacuuagugaaugugccuaaagaagauuuucaaauuguccuuucauuagcccugacaguuccuugcaaagcccucaagagcugugagaagacgaguuagaggaaguccaaggggaucaaagaaaaugaugcucacuuguaaagaaggcaggcaggcugcguccccaaggcuuguggccaggaauaggagaaauggcuuuagcggcaaucacuuuaagaacuucuguggugucccaauauaccccaaggauuuuuacucuagguggucaucagcuuggaucuccuuccauaucaucuuagugugauucugacauugccacauucuccuauccaugauuaaauaaggguaagaagacaaugcgaugaaaauaauaaagugcugaguggggccaaugaagugggaaauaaaaauuuacaaugagaaugagggucacuuuuuagcauuuaaaccugcugccaacuacuguaaaagaaauggucaacauaauacaucuuagcuagaaagauauaaacuagaauuuaaaaacuuucuauacauuagcucuucagccauuugauuuacucgcauuuauuuaacagugagcacccaugaaaggccaggaacuuuaggcuuggcaccacaguuaucaagaugaguaagacacaauccuugcuuuuagugacuugggggcaguugcagggggcaaggggagaaagacguaugauauuuuguauaauuugaguguauauaaaaaaugaugguuagcagaaagcagccugggaguguuucugagggcagaagacuuacccucuggguguugaaaaacaaauaagaguuguccaguuagacuacaagguacaaagagaaugagaacacuccaugaaaaaggaagggccaggcaaaagccagggucaugaagcagcaugcugaguuuggacaccucucaguaguugaguguggcuauggaauaggagguuggaguuuagcagugggagugaagagaaaggcaguagaaggaaaaaaguuuaagacaggcuggggccucacaggccaugugaugggagacuggacuuuagucugagggcaaugaagguccacauaauaggguuuaaagggggcaaaugaugcaaugggauuuguguuuuggcaaggucacucugaccacaauguauaagacuacaagagauggaacuggggguaaaaggaaggaaauaaugagggccaaaaccaaggagcaaaggggagacagagagaaaagugggauggauucaaagacauugcaacauagaacugaccgaacuggcuugugugagguaagggaggcaggaugacucacagguuucuggauuaugugaacagguggaaggugaugccauuagccagaauaaggcuguaggcuaaggggaguaaacugguucugggguauaacauugauaggccuuacuaggcagugggaaauacgguuuuggaacucaggugggguugggcauaagaaaauacuggcauaagaaaaguuguuagguuagcaguaagucuccuugggaguggaugagauuaccucagaaauccauauaggcaagagaugguggagcugggcggccacacacacuggggcagccguuuggcauagcaaagacaccugaguuuucuguggaucuaguggacacuacagaagguggcuaggcuugaggcacuugcaagaaccuugaaugggagaguagccucuacccaacaaggagaccaagacagagaaagugauuuaacuguggagggagcggggaaaugaagagaucaggucagcucuccaaugccaggcacccuaaggugccagcaaagagccagcaacugcguccuuugagaaagcucauguggauggcagccucacgaaaugagccaauggacaguccguuagacagaaacagacagacggcagcugcaaccgugacagaagcgggacacugcaacagucagcacagagacucugccccucgguucuuccuucccaccuccaugcuagcgcacugcuacugccaagagggagggacgcgugugagagccaaaaacagccuccacuccaaggcgccaguaacagacuggguucuuuuuuuccuuuucagggaaagagugggcagagaagagagagcuuugauucugacaugagagucaaauuucaaaaugcaaagaacgaaguguuuaaaaaaugguaagugacuguuuaaaugaccaaaauuaacuggaaagcgauggaaaugggucgacaugcuaguaaggaagccugcuaccagagugaaagggugauucaacugagcacaauuaauagcaguuauuaggagaaauaaaaacaaaccaugacaugcauauuucucaccaaugaauugagacuuuaagcaaauggcucuggaggggauccagaagaaugcggcaugaagccacacgcugaggaucaacugugagaugaggccauaucaugucaggggcugagcagaccccagugagcuauagggggcacagccccuuaccuguggggcuguuggggccacugcaugcccguaucuaucccaccgaucaccaauaggacauccgccauggcugaccgaggagaggacugcaaacucaccaagggcucccuggcaaggacaccccuguccuuucccacuuuugcgcucccagccccacaucagggacuuguucagucaggaaagcaggcaggggacagauauagauggaaacaauccagguccucucaugucaauuccaaauugcuagagacacaagcuuaguccgacuugacagaagaggagaacuuugaacaaaacacgauauaaagcuaucaaauaacagaacuaagccuuaagaacccaaaugagguuaaguaacgagaaguaacuaacaagucauggaacuaaauaaagugagauguuguaaggcaaccccaauguauagcaaaaaggaguggcagaguugguggcaacuacucgaaaaaggaaacugccgcacacucauaccccaguuaaucuuuacuacucugaggcgguagguaccauucuuuucuucauuuuaaaguuaaaaagucugcuugaaguuuauggccuccucugugcccgcccaccugccuaauguguggaugacacccuacagugggcacgagggugagggcaaucauauuugccagugcucccagagcccgagcacagggagccugggccucugcgccucacagggccccaugccaccacuguccucauggccuggcugggcuacucauggggaagggugaguaugucuuacaaaguaacuuggcuacacucuagggacgucugcuugccuucugacagccuggugaugcccccccaguaccgccagcugcugagugaccaugggccacuauccauaggcuacacccagggagcugggaacagccaggagccccagugaagaguuggggagagaucaacccugccuacguggaguaagaacagaauaaagagacuaaaucgaggcauuauucacucuagaaagcugguaagguaagugcuuggcuaaaaccgaacagagugccauauccuugcugcuuuuggcuuuaaagguuuuccaucuuuuuacaagaugagaaguuacaguucaccuccccuguuucgaugaaacucuuguuuucaaaaugcuaacagguugguuuuuccucccauguuucaccuggcucugaacuacagucucacagauugaaaaaagauuuugcaguuaauuagaauuuacauuuucaguaguuaggaauuacccaaguuauuuuuuaagcauugauuuaaaaggugcauguaaaguuaucucagcaaacuaguuugccucuaagauaccagugucucccuuuaaccuucuccuuugaauauguuucugugccccaaacuguucuguuaagcuaauacaaccauaaggauuuuguuucaaugcauacuaacagcgcacuuaguagccacuccucguuucugcuuaauauaacuuuuuugcauaaacauaugcaugacuauuagugcacugaagucaauuuuuaaaaugcacaaguuauaaauacagcagaauaaccuaccaaacuuaacaaggaacacccaaaauuuucaaacuaucaguagauuucgguuaugcauacuuuaaguugaucaaaacuggaagaaaauaacuguuuauaucuuuauauguauuuauuacuugaugcaauaaagcuuauuuucauuaacacaaacaaaucugauaguggucagacaacuuacccaaggagacauauguuuaacaaauggcagagccaagauccaaacucaagucagucggcuuugguacagggcaugacucaauaaucuagcagaaccaaaaagugggcuauuucuagacaccccagaaauacgcaguucaauuaauuuaguaaaaaacugacaccuguccuuaaaauaguaaauguuacuucuagucaucauggcuagacaccuucagacaauuuauaucuaaaauauacagauuuaucagaguauuacacguauguuucuaauaagaaaugcuccuaauugaagaugcuucaauuuuacuuaaugauuuugcauugguuugaagguaaaguuaaaacauaaaggauuaauuuagucugguguagagggaaugaauuccuuuguuucauuacccaaauuaaauacuacauauauuuaaaaauucaguugcauuauuuugaauaaaacaagauguuuuacaaaggccauuaaaaugauguuggugacaaagcauaaguuccaucaccuauuacguaacccaaguuaggguaaugcugcacaaacacauaaaacugaauaccucaaauacauauugcuaguaaaaacagaguuaauucuaaaaaaacuuuggcuuuaauacauuagauugggggagggggacagcaggggaagaccaguuauguuauaugaagagauuuucuuuaaaaccaaguuucuuaccuaaucaggauaacuaaauuaaaugagugauuaaccuguuuuaacacugagguaugcuuggaacagaaaguauuuuuuuaaugaaguauuuacauuauguaaacauauauaacaacaucuauguaaguuaggaaguauaacgguagaacaaacacccacaaacugccccccgcuaaacuaagaacguuaucaacaccacugaaacucuuaugcuccuccucauccucuacucccacaccaggggcaauucuucuccagccugaaaucauucccauuuaauuaguuacuauauuuacuauguuuaguuacuauguuuauuggcuuccuuccuccacuaaaacauacuagacaaaggcagaaguuuuguuuacuaauacuugauuagacuuacuacuugucagucccuauucuacacguuauguauauuaccucauuuaauccuuuaaauaaccaccucaucuagguaccauuauuauucccauucauauagaggaggaaaccaaggcgcaaaggaguuaugugacuugauaaggucauacucaucaccacuaugaaaagcaaaaaauacuucugcacucuuaucauaacagaugcugucauguuuuaguaaucuucagucccuugaaagacugguuaucacuggaaauaguuuuuuuuuaaaauaauaaaaauucaacaaauauauauugagcacccauuuugugucaggaacuguucuaggcacaggggauucaguaugaacaaaauggacaaaagucucugucuuccugaaacuuacauucaacuggggcugaaaaaguaaacaagacaaauaaguacauauacaguaugugagauaaggacaaguacccaggagacaaauuaaagaacagaagcagggauaugaaagaucagagaggaugaaauuuuagcuagcuuucaaagaaggacucccugagaaaaugaguuuugaguaaagaccuaagagagaugaugggauuagucauggaagaacucuuccagcagggagaacagcaaggggaaaugcuguauucaagagacccaacaaagucaagacagcaugaugcaucauaggacugcgcaguaaccaauguaugauacaagagaucucucucacuuuugcuaucuugguuuucugaaagacucuuuuuuaaagaaacaugcuuacugagaccaucauuaugguacacggugcauuuaagaaacacuguucugcacuuaauagcaauagguauuacaugccacuuuauauucuaaacuaguuucuucaagaauuauuuugggaugcuuuucacuuuccaauaaaaacuuucccugucuggaaguacaaauaagucagguccuccuguagaaucaucugucuacaaaauuuaagcacuagauaugcaaugauagcucuuuuuugagucuugcuuuggauaguuucaagaagccaugagaauuaaucgcauagggaaucuauuacagagccuuuuaaagcuacuucugacuaagcauggugcaccgaacacacucauuuaucuuuauuucuaccucacaccacuaaagagaugagaacccaguuuuaaaugcauaaggauagaguaaauauaaaagagacgucaauuucaauaguuuuucaaagcuggaaaaaagacgguaauucaucaaguugaaaccugagcaagccguaaagaaaguccaaagaccauugauaugcaguaaagaacucaauacucaaaaaguacaaggugcagacaacauaagucuguauaagacagacccaaucuuacucaacugaauaacugagcaauuguaucuggaauugguuccuucccguggguuguuggucucgcugacuuaaagaauaaagccguggacccucgcagugaguguuacagcucagcucauaaagguagugcagacccaaaaagugagcagcagcaagauuuaucgcuaacaguaaaacaacaaagcuuccacggcggagaagaagacccgagcggguugcugcugcuggcuggaguagccagcuuuuauucccuuauuuggcccugcccacauccugcugauugguccauuuuacagagcacugauugguccauuuuacagaguaccgauuggucuguuuuuacagagugcugauuggugcguuuacaaaccuuuagcuagacacagagcgcugauugguccauuuuuacagagugcugauuggugcguuuacaaaccuuuagcuagacacagagcacugauuggugcguuuccaauccuuuaccuagacagaaaaguucuccaaguccccacccgacccagaagcccagccggcuucaccuuucacaaugacuaacaauucucuaguauagccaacacucagucaaaaggaaccuagaggaaacagagacaguguagggaacugaagaaacuuguaaaauccuaaaagauuacauggauaaaauaagaggaggacaacauucagaacacuagaaagagcucuuggaaacugaaaaauugauaugagagcauaagugaaaaugugcuagaauagaaaguaaaguugaagaacuaucucagaaacuagaacaaaauaccaaaaagguuaauacaggaaagaaaauaaauaacagcuauuaauauuuagaagggcuaacacccuaacaaaagaaguuucagaaaugugcaauauggacaggagaaaagugucauaaaauaauucaagaaaacuuccuagaacuacagaucaggcuuuuuaaaauuaacagagccuaucaaguacaaucuguuccauuauaaaacuuguuuggaaaacaccaauuuguuccaacacaauucauauguuagagaacaauuugagcguaaugcacauuucacauuugcuuaugugugauuuuguuugugagaaacaucaggugaacgcaggaaacugcacccagcugaaccaaaacugcaccuaggaaaacgcaaacagcacauaucucaaacauguaacagcuaccucaguucggcacguuuguuacucugcaaaauuauguuuugcuauucuuucgcaaaggauaacuuuucuauauaaaaacacgcauucaacaucucaaauaugucuaaucacacuggaucaaaaacaucaagcagcaugcacaaaagaaaagcuuuuaaauauugagaagccagaaauaaggcauuuugaaagaaaugagagaauaugugaugagaacaugugguaucucccaagcaacagaaauaaaauucauguugugggccuucacaaacaacgcauggaaauaaaagaaacgccuauugguaaagcaauuucaagggcugcaaaaagagcaaccccuaaagaaacagaagaaaaagaaagcuuguugaauauauguacugaaaagcaaauagcaaaaaaaaaaaaaaaaaaaaaggaauacuuuuucucagaaucaaagagaaagcacuauuuauauaaaaaggaaaucgcuaaauccugcagaauuugcuccuuuugugcuagcaguggcugguuuaguaguuucaaaaaucucuaugauuuccaaagccuucgguuguagggugaagcagagagcucaccuaagaaaacugcaaaaagaauuuccagcagugauacagaagcuaacugaagaagguggcuauauauugggucaaacuuucaauucugaugaaauaguuaucuauuacacauacaucagaucugucaacugacacuguuucauauucuuggacagaauuagaaaacuaaguuuccaaggauuucaaagucugcucauauaaaaguagaacaaguucuaggaucuacuuucacuuuugaaacagauaggugaaaucuuugaagccuuuccagucacuauauucuaucaaaucugauccuccuaauuucucacugugauucuaucagcaaaaauucuuaauguucucuuaauaguaugauccuuuuccuuuuuaauuccaacuaaagcaucauuuccaaacaaccuuugaaagcaucuaugauguuguuuuagccauuuaaguccauaaaugcaauuauaaaacaucuucaucaguacugacuuuagugcagcuuuuuaaagagucagauuuugagcacuggaguuagagccuaauucaaauuuccaaaaaucacuuauucauaguaaaauggaagugauaauacauauuucauaaugauggcaacagcagcccaucuagagcagccacugcaaagacgcuggcugcagcuggggaggcgcggcgggcauugcaggcuccagagagacagcaagggccaggaacaggcgggagccccacccccuaccaaguuagcaggacagaagccugcacucccaggcacagcugcagcugcccagccguaccuccagaccugggcaucccugugcucucggggacccaggaagccccacuucccccacaggcuuggaagggcccgauccugcucucuggucucuccccacucccagugcccgcucugauuuugcagcaaaguuauggccaagccugggcgcuguccgaccaggugugugugugcgcucggggcagcagcugacaugccagccaccccuacucugccucggcccccucuggaccuugggcaccgacaagugcaggaagaaggccaggguggggcugagggcagcuccaugcaaaccugcaggcaccccucaguacgaacagccugggcacuguggauggcauguugauggcgggaggcagacagguucuuggagagaaaggggaggaucccuagugaaaccccacuuucaagugguagauggccuaaagccugggggcugggcugccaguuccggguggaguccgugggauggcagugagaacuugugcuuuuuccaggcccacucauggccguccauggaccaaucagcacacacuucuucccuucuaagcccauaaaacacccccggacucagucagacuugcacagauguggggacuaccgguugcaggaaggagcgacccacuuggggucugcucgacuuguggggaaugaccugccuguggaaaggagcuauccacuaugggucuccucuccacugagagcuggacacuugccaggaugaccugccuguggaaaggagcuacccacuauggauauccucucugcugacaccuggacacuuauuggcacgaccugccugcagaaagcagccacccacuuugggucuccugagagcuguucugucacucaaugaagcuccucucugccuugcucucccuccaguuguccacauaccucauucuuccuggacacgagacaagaacccaggaccugccgaguggugggacugaaagagcuguaacagaaacagggcuugccacauugcaggugacaagaaagagagaagagcugcagcccuucaggaagcccagaccuaggggcuccccaacccagggcugugacacccucuuuggggcucugcaguuccuggcaucuccaagcuuccaggcgccacugcacuccccggugcccacaguggaagccacuuacaguaugccuggucuagccgcagccuugcacagagccggcgccuagagcugccuaccccgcugcagccagcacaccuggcugugcacaguggugagaccccaggcucguuucacacaccccuugccacugacccuuggcaggcaugggugccugucucauccuuggcaggcaugggauccaggacaguagcacaagcggagagcagccagcggaaagcagccagccaggccaaguggguggaauuauuagcucagagggccugagaaaacuccagcaaagguacccccagccacagagguuucuggcugaaaaagcgacaccccaaggauccugugacaauaauauuguuaugacauuuaaaagagauaacacaagaaaagaaccuggcucuuuccacaguaauuaaggugaccaauuaaggugaagcccuuguguucugaacuacuugguuuuagccauaauugggguuaaucaaaagagauccucacauuucucaaauuacuccuuaaaguagagaguugcuugagaauggccuaauauaaaaaguauuauuauagauuacuuccaaaggaaauuuuuuucaaauacgaaaaccaccuuuauacagcuugaugcccuuuuccaugacacagaauaauuaucuggagaagcaauuuauaagugacuucauuguuuuugguaaaagggcaacucaaauuuugccuuaaucccuaugacaugaugaauuaguucagagggugauuccuaauauuuuuuuacuuuaugucuuuaaagagaaccaccucuuacuuccucacccauuuauuugauguccuaaacuguguuagaguccuugcagccucuuucacagaggccaucucugcccuccuagacuguccucuaggaaaagcuauggagggaggccccauccgcuucuaguguucucuucccuugauuuugucauauuuguugcuccagcaggaaaucaagugaccuucuccccagaacaaggaagaggagauagucuuucuuucccaccacagcuccuuuccacaaauacuuaauucacaaacaucuugugccuggcauuauaguaguuacugggcuucuuucgaggagugaagaagcccuccuucuaaaaagcuuucaaaccaaaaaaugcuaguagaaaugugaaaacaaugguuuuucuuagcaguaggaaugauauaauuuaucaucuagcuuuaucacagaccaguagaacagagauguuuucagauaaaaacagcuuucuuguuauaaauuaaaguucaaagagaaaaggaaaugcaaaacaauacuuuuaaaccaaauuuaacuaggacaguggaauguuuauugaacagcuaaauccuagguaauauaauaagcaugguacacaguaucuugcuuaauauucaacucacgucuauuaucauugcauauacaaauuaguaguuaacugagacuaugcaaaauuaauuuguucacucucauacugcuaguaaguauaauagcugaccuggaauaugaacucagguuuuucugacucaaaaaucuaacuucuuuccauacacuuaaauauuuauuuagugccuaccugugguaagcauugugacuggcccauaguccagaaggggugguagauguguaagcaauaauuauagggcaaaguaauaagugugauaucuuagguauauggcagguaccaggaaagcauaagagaagguaaccgaguaaaguacuagauggugaguagucaguaaagauuucaccaaggaauuuucuccuaaauuaaaucaucaagaauaaucuuaaaaucauuaauuagaccagagaaugacuguauuaagggaaaagcagaaaauguccaaaacagaggcaguaagucaaagcaucguuauggaaggugcccaaacaguaggguccucugaaauaauuacaguauggugggaaauuaaggcagauaaauacucauucagagaucuucuaaucccccaaaacacugaaaacacugcuaaggaauccgaaauucaccccacagcacaugagccccagccaaucagaacagauaccaguuguaaauggccaguucaaccuaacuagugcaaaccagcgaaauaucaacccugccuuuaggaaauaggagcaccagugggguguuuaccgcaggggaguagccugaccagcucuguauuuuaggaaggcaauuccuaaauauauagcaugaagauauaauaugaaguaugaacagaaggaaggcaaaagcagagaccaggaauaaauucuguuaaaggguuucugcuggagggagaggggagauaaaugauuuuaaaagacgccagguaaucaaaauguaaacaucauuucaaaugagucuauuacaauaacaaauaggacuauguauuauacagaaaccauuacacaauaagaauaauucagacuggugacucugcgauuacccccacaaauauauuugaauguuauuucagcagaguaacaagaaaauuacuaucauuuaacuaagcaccuuguuuuguucaaguuacauaacaucaaacaucuauuuuacaaacauuuuuggaaaggugcuggaccauagaaaauaugguucuauaaacucuacaucacaauggccucauuuaaucuauuuuauggaaaaagaaagcagacuuguucaacaaaagaaagaaguacugauauauuucuaauaagccucugaguccuacucugugaucauuuuauuauagcaaauguucaagcuauauauucuggcccacacuacuuucaguuauauggaucacuacuccaguaaaccauuuacaagccuacaaauggcaauguguacaauuacagcacaaaaaucuaaauaaaaacaaaucuuauacaauaucaagaucuguaaaguguccauauuaugagauacaagauauuagagguuccucuacuuauaguauuugucugggugcuuuaaguaguugauauaggcucuauuuccaaaucaauaagauaauauaaaaauucagaaagacccucaaaggaacacaaaauaagucauaaaacuagaguacaggagaauaaggaacaaaaagaaucaagcaugguaugucucagauccauuaggacgauuaauguguuugggaauuuuuaaaaacuguucacuuauuugugaaaaguaaagaguuacagcuaacauauaauuacaaacuauaaauuauaaagauuuuagaugcauauugcacuuacaaagaguuugaggaacuuaaacaguuuaaauccugccagucaucaaugaaagagaucacuuaauacuuucuuucuuuccccuacuaauccuaguucuaaaauaaaaacuaaagcugaucauacaagaaaauauugccuaugaguuucucauguguuugauuaaagggaucaguuuuacuugacaaaguaacaaaaacagacaucaccaucucuguauaagcauagagaacaaaaguaauaaauagacauaaaagcuacaugguauuuccuaaaauuaugaauuuucagcaaacaguccauggaaauuucuuuuaagugugguaaugaccuaacauccauacaucaaauucaacuuauuugacaaaucugcaagcuucucacauaucuguauuacucuucagucuauccagaauuauagaaauagcaguucuagcuaaacugcaguuuaauuacugguugacuuugaauuagaaguuaagguggcuaaacagcccauauguuaaacauaaaaaacuuaaacucagaggugggucaaugcaaauaaaaucagauucacuguugaauuucauuaggagguuugcauaaagagaacaguucucucuuucaaaauggccuuuuuaaacaaauagcuaacuccuuaaauguguggcauuugauuagaggauuucaugaaaaaaauguauuugcaaauuaauggccauuugcucuaaagauauaauaaagaagaaaagguuuuaaagaauccuuaccuauaauccaaucaugguaauugucaaagaaugccagaguagaagauuaaaucauaagagaaaaauuagucauuucccauacuguuuacuguaccuguuuuugaguuaucuuacauguauguaccuagcuuaaauuuucauauucaagcaugaaacccucaugcuggccuauggagaguuccacagugcuaagaacugaggugcuuccugccaacagacagcaucagcuugccagccaugugagugagcugucuuaggauggaucuuccggccccagugucaagucuugggaugauggaagcccuagcugacaucuugaccucaugagagacccugagccagaaccaccuagcuaaaccacuuccaaauuccuggcccucagaaacuaagaugauccucauuguuuuaagccacugaauuuuaggguaacuuguaauguagcaauagagaccuaauaaaaggacauguaaaaauaauaauaguauuuuagugugacuguaauagaagaagacugggaguaauuuugucuucuacuuccuaaacuuucuuuaagguuaugucacuuucauuguuccauuuuuuuaaaagcguaauguucauauuacucccaccauuuucuuuggagaaguuuuaccgaagucauucacucauugaacaaaugccugcgaggaugacaagucagaauagucaccaucacugaccuuacggaguuuacagacuuuaaucaaauuugucuaggauuacagauagugacauagugauauagucuuuuuuuuuucccuauguuucuggaaggcaaauuaauuccuucuagaaggcaaaucaauuaagugauuaguaaaugggauaaugaugucagcauaacacaaaaauuguauugguucacaggguuuuuuccuucacaagagcacucaguacagcuggugaauuacagccuuuaucaagaauggaaagagcucucagcucugcuguauagcagcaggaagaaucuuuucauuuguauuuaacaagaccuaaaagcaagcacuuccaccaggagccccuaccagcuuugugcuccuuucagcuuaugccagguuacccugacucuuguacccaaccuuacugcagcgccccugguuuggagcuccacuuccuucuguguuauaucagcaccugccaccucugcucuaauuaaaauguugguagcauuucacucuucuuuguguauuuuuuaauaccuaccauuagagcuugcuguuuuacuaaacugguaccaacuuuuuguuuucucacugcucugguuacaaugcugcacaaguuuugagugguugacccccaccguguuuucuucauaggcugucuuauuuuuaacacauaaugcugcagaaugagguauuuaggaacauauauaucguggcauagaagaaaugucugaaggaaacuuucacgguacuaggacaguauguaacacaggaccuugaccuaauauggaaauagcaugugugaagguuuaaagcacagagacaggaauacaaggagagccucccaggaaaaaaaaaugcaggcuuaaacuuugucuuuacccccgaagacuuugccaggcuaagaaagcuauauucacgucauauggcugaagcauuccuuuuucuaauaggacucuguggggggacacgagcaugacaaugaugagacuaauucagugguucucaaccuuggaugaacuucagaaucauguaggaagcuuuuaaaaaauacagauguucaggcucaugccucagagauucagacuguacucaucuugugugagucagcugccacaggugauuucaaugugaagccagggcuacaaaccacuagaccagagggggcacuggcagcaaucagagcauuggagaauagcucuuaggaagaaauuuucuaaacaacaacaaagcccacgacugauauuacuuauguauuaaaaaguuggcaauuugggccaggcacaguggcucacgccuguaauccuagcacuuuaggaggccgaggcgaguggaucaccugaggucaaaaguucaagaccagccuggccaacguggugaaacccugucucuacuaaaaauacaaaaauuagccaggugugguggcaggcaccuguaaccccagccacuugggagccugaagcaggagaaucgcuugaacccaggaggcagagguugcagugagcugagauugugccauugcacuccagccugggcaacaagagcgaaacucugccucaagaaaaaacaaacaaacaaacaaacaaacaaaacuuugcaauuuuuaauuagcaaauaagacuguuuguucauuuuucccaacaaaauuuacaaggauauuccuaggacacaagcagggcuggaaauaagcagagcugcagugugagggccaaucccccaggagcacucaucuagacuucucaagaaggcagcacauagggcuggcauccaagggcuaggauuuacgauccucaagaagcuagggaagggguauagggagaggguggaagcuuagaacuaguaccagagggauuuggguaaacuauucagugcgacuuagcacauacaaauaauagcacguaccauuuuaaaacauggccaucuuuggaaugucaaaauaaaggacaaaaauguacagagugguuuaaauaccauccuauuauauggagguagauaaguggguggcaacaaaaguuuucaaacuugguaaucagagucacaggaggggauauuuuaaaaauacagauuccuuggccgggcauaguggcucaugccuguaaucccagcccuuugggaggccauggcaggcgaaucgcuugagcucaggaguuuaagaccagccuggacaacauagugaaaucuugucucuacuaaaaauacaaaaaaucaaccugguguugugaugcauaccuguagccccagcuacuugggaggcugagauaggagaaucaccugagcccaggacgucaaggcugcaaugagcugagaucauaccacugcacuccagccugggugacagaaugagaccgugucucaaaaagaaaaaaaaaagaaaacaauauauagauuccugagcccaaugucaaaccuuaugaauuagaaucuccagagauauaaaauaauaaauuagcaacaauaacugcuauggccgggcaugguggcucaagccuguaaucccagcacuuugggaggccgaggugggcagaucacuugaggucaggaguuugagaccagccuggccaacaaagcgaaaccccauuucuacuaaaaauacaaaaauuagccaggcaugguggugcacaccuguagucccagcuacccggagacugaggcaggagaauugcuugaacacgggagguggagguugcagucagccaagaucacgccacuguacuccagccugggcaacagagcaagacuccuucucaaaauaaacaaaaaaacaaaaaaaaauagcugcuaugaagaaugaaacuggaucccucccugucucucaccauauauaaaaauuaacuugagauagauuaaggacauggauaccugacgugaaaccauaaauauucuagaagaaaacccaggacacacuuucuggacacuagccuuagcaaauaauuuaucacuaagaucccaaaagcaaguguaacaaaaacaaaaauaaauaaaugggacuuacuuaaacuaaaagcuucugcacagcaaaagaaauaacagaguaaacagacaaacuacagaaugggagaaaauauuugcaaacuauacaccugacagaggaauaaucuccauaaucuacaaggaacucaaacaaaucagcaagaaaaaaaaauaacuccguuaaaaagugagcaaaggauaugaauagauauuucucaaaagaagauauacaaauggccaagaaacauauggaaaaaaugcucaacaucacuaaucaucagggaaaugcaaaucaaaaccaccacaaugagauaccaccuugccccagggagaauggccauuguuuaaagucaaaaaacaauggaugcuggcacagauacagugaaaagggaacauuuauacacuguuggugggaaauugguacaaccucuguagaaaacaguauggagauuucucagaaaacuaaaagaagaucuaucauucaauccagcaaucccacuacuggguauuuaccaaaaggaaaagagucauuauauaaaaaagacacuagcacucauauguuaucacagcauaauucacaauugcaaaaauaugggaucaaccuauacacacacgcgcacacacacacacacacacaauggaauaaaaagaacagccauauaagaacaaaauaauaucuuuugcagcaacuuggacagaacuggaggccaucauucaaagcaaacucaacucaggaauggaaaaccaaauaccaaauguucucaccuauaaacaugagcuaagccauggguaugcaaaggcauacagaguuguauaacggacacuggagacucagaagugggguagguagaaagggggugagggauagaaaaucaccuguuggguacaauguacacuauucgggugauggguacacuaaaagcccagacuucaccacuguacaauucaucuauguaaccaaaaaccacuuguaccccuaaagcuauugaauuuuuuuuuuaaaaaagcugcuaccauuuauucagcauuuacaauaugcuaggcaauuuucuaagcacuuuguauguaucaucuuauuucguuccuguaacaacccuaacagucaccugggacacagagaaguaacuugcccauaguagauggauccagguuucaaaacagucugugcuccuaaccaugacauucugcauuauuuaagauaccuuccaccugcaacaaaccaaguaauuuuuugagguagcugguauuuaauccagcauuugggaaccgcuauacuaugggaauguucaagucgcuuuagccauuucacucuuugaaaucagacacaaaaucaacaguaucuccuauuacuggucuuuauaucaagaaauauuaucaucuuuauuaugaagaauuuauaauaugcuaaaugcacagaaauaguuuuccuguagaagacuggcuuaugucuaaguuugcuguuucuaacaaaaauagaaauuuuauauaacauaguuuuuucuuaaccucaccuagcaaguugcuauguuuuaucaauucugcccuaauaauaucuuaaaggcuuuuaaauucuuucuguauuccuacugacaucacacuaauucagauuuauaucauaaaacuuccagauuauugauugccauaucaucucaacugguccaucuggcuccaaucucucuccagcuggauccaagcaaaugcacccugcgcuuucaggcuaauuuucuuaaaacauuuccugccugucacccaugcaauuacaagucuguuaaugauuacaggguaccuacaggguaagcccccaaucuuuauaaccaggcauucaagaucuauaaguacccaccgccuacccaucuccggcuucccuuuccuaaauucaacuacaguacaguuuuuaauccaaaauuccuucauaaagacaaauacaucuuaagccacauuuaaaaugagaaaaguauuuaaauugugggcuaauucuuuaaauccguuuuaauaaaauucuagcuaucuuggaguuaaauguucaaaucucauacuacuucaaaugagcugcuuuuacuaauagcucuuaaacuuuuggcagaauauguaggaggauguucuuaacacaaauuaagcucuugcaucugaucuuucugguaaucuugaaguucagaguuaguuuuagauguccaauuacucaaaaacucugccccaaagcaacagggaggguguagacuguguuuuaaagcacgaaucuuguauaauucacugagccaguuugucagacuugaauuguauuauuuuuacuugaaaacacauaguaccaugccaagaggaaaauguacccaauccuagaaguacaagcuagugaaauuuaucuaucuauuuaagucaugaaaguuccacuuacucgucuacuaugaaguuuaaaaaaaaguucuacuaccaagcagaacugagaagagucaauugacgaugcccuaauauccauuucagguggagcuaauuuaucaguuauuuccuguggcuucucuggagcucuuauaaaaguucuccauuaccccuugaggacugaauuuaagaugaggggggaaauaugaugauuuaugcagccaucaugcaaaauccauaugaguaagaaagugacagguagauaaacauuuuagagagccagagaaaggauugcugcuggaaaccaugcccucuccucuccccuuaagguagggcucaacuguugcuuucuuagugcuuaugugauguuaaacugauucaucuuuuaaaagauuagaaaaauaugcaaguaauuaaugaagggaacaaauaugaaagaaaacuucccccuagucaaaucuuuuauaacagguucgcagaacaacuccagaccuggaagccuguggaaagggaaacacaguauccacuaaugagcaaaccaagaaguccaaaggaugaagauuuuacccacugcuuguuguaucaccaauaaaggcauaaacugccuugaaacagcucuccaauuaccagagcagguaauuggauucgaaaggaaaauagauucgcgucuggccacauccuuuauaauuauuauuaucucauucauacaaaugauguacaacucagagucuaaaauauuuuuauaggaaagauuccuuaaaguugcuccaugagcaguuagauuuguuucuaauauuucucauaacuacagaacucauuccucauggucuggugcuaccuuuacgauacugguguuugaagaagaaauuuuaaggccucauaguuuauuuuccuucccccaaauacccugugucacaaaagccgcugggagaaggcaaugucugccuucauuugcuauuuaauuuugcaggaaagcagccauguuguaccacaccagaggcuggcacuucacaugauucacuucaccuccaauaggaaaaaaaugcagauaaagcaaaaagcaaguugacgucagacccagcuuuuaagagucacgguccagagucucugcugggaccaguccuuauucccuccacacuacuguuacugaccacuccaucuuaaucacauccaauaauacauucaaauggcucacugacaacagauaaguuauauucuacugcuuaagaaaucaggaaaugugaaauauaguuuaguuuuccaucaaaaaaguuaaaauuuaaaaguucuggcauauaaaguguguaauagccaacuaucuggaaaacuuagauuuuagauaaccaaugguuugcuguucaucaaagcaaaaagaaucuacaaaauacaauccugccaccuugugguaccuguucaaaaguacuucauacuuuaccauaaauuuucuaauuuuaaaaaaugugcuuauuugaaaaaauauuaaucaagauaaaguuauuuuaaaauauuaaauacucaugcugacauuagcuaaaaugcacugaaauuuguuugaaaugaaauuauuucucaggucaaaacuaaauuaucucuuccaacauaagauguggaaaugcaauuguguagcacuuggaucucuugauaaacucuuaccaucacacuuuccuuucugacaguuaaauagccggaauguuaaauaaauagaacugcaaaacuuacuagauagcauugcuugaucaauuuuuaacuacaaguagagauuaaguaugguaaauuucuauaucuuuacuaaacuuauaauuuuuagauuguucagacucuucaaugaaccuaaauagacuuaaguuucuuaacaucauauugacguauaagagaauaguucuaaaacagugaauuaaaauacagaaccacuggcaguuucagagcaucaucuacaauaauuacuuuuagaaaauuguuaagugaugacuaagucuccuuugacaaauaaaauauugaaagcuuauccugugaaaauauaaacuaccaauuacaggaguccucccuuaucugugguuucacuuuccauaauuuuaguuaccuauacuccaaaaauauuaaguggaaaauuccagaaauaagucauaaauguuaaauuaugugcugaaauccucccuuuguccagcagauccacauuguauacacuacuugcccauuagucacccaguaacugucucaguuaucagauccacugucagcgugucaaagugauuggaggauucaaguaacccuuauuuuacuucauagccccaaagugcaagaguaguaaugcuggcauauuguuauaauuguucuauuacuguuguuguuaaucucuuacugugccuaauuuauaaauuaagcuuuaucagagguauguauguauagggaaaaaacauacugaauauugguuuugauccuauccucaguugcaggcauccauggggagucuuagaaugugaccccuggaauaaagaggggucacaaaugcaaagauaaacuguggcauuuuucuguuauacagcauccuuugaauucuucuauuuaacaaauacuggucaucucuuuugucucacaacuugagaacuguuccuuuuuuuucauaugagacagcauguuuuacuuugcacacugguaucaauccuucagacacucucaaccauugacauaucugauuucugucuccccucucacccacucacucacucaacaaacauaugaggaccugcuauguguaccaggucccuaaaacggaaacaugaaaaagcauaguccucgccuguaaccccaauauugugggaggcugaggugggcagaucacuugaguccgggaauuugagaccacccuggacaaaauggugaaacccuggcuauacaauuaaccgguugugguggcaugugccuguagacccagcuacccuggaggcugaggugggaggacugccuuugccugagccugggagguugagacugcagugagccaugaccuaaucuucaaggaaaggcaauuuucuuuguuuugagguauauauuuuugaacauuccuucuaucccucaaauucuucucaaaauaagcuccacaucuaauuguacaacugcaguaguccauuuucaugcuguggauaaagaccugagauugggcaauuuaaaaaagaaagagauuuacuuggacuugcaguuccacguggccagggaagcccaauuaugacggaaggcaaggaagagcaagucacgucuuacauagauggcaguaggcaaagagagagagcuugugcaggggaauuccucuuuuuaaaacggaauugcagacccaauguacaucuuuuauucaaacugauuaaugcauuuuuagauuuaaaauauuaaauuuauuaaauaauauuaaaucuaccaaucacucaaguauuuuacauucauuuaaaacuauacaacuggaggccaggcacaacggcacaggccuguaaucccagcacguugggaggccaacgcagguggaucacuugaggucaggaguuugagaccagccugagcaacauggugaaaacccaucucuacaaaaaauacaaaaauuagcugggcaugguggcacacaccuguagucccagcuacuuggaaggcugaggcaggaggaucucuugagcccaggaggucgagguugcagugaaccaagaucaugccacuggacuccagccugggcgacagagcaagaccccugacucuaaaaauaaaaaauaaauaaauaaauaaaaauaaaacuguacaauuggaugaguacuuuugucagcaugcaaaucaguuuaaguuauacaaacaguagaagcaguauauauguguguguguguguguguguauauauuuagcauagauguauauauuuuuaaauuaagcuagucaggccagcuuuauuaagcauucacaaaaauccacauuucaaaagaaccaugcaacugaugguuuacauauaauuugaggaccucuauuccuaagacaaacuaaaguacagcuaacaucaucuuuaauuauagacuaauuaagcuaauguuuucugauagaaaggcucaauauaauacucaaucuuuuacaauuuuaagccaauuuguaauggcuucaacugaggaguccaacaaauuaaaaagcuguuaugcaacuaaauguuuaaagaucuuaagcuaaaaaaggacuauacaauucaucucaguuaaccaguaaaaaauuucuaucaugaucuccaaauaauccuccaagugauuuuuaaaauagcuuuaaaauuuuuccagcugggaaaaacaaagcaaagaacuaaaauggcugaacugaaccuuauuucacccuccaagcugaguauuuagaaaccaacugcuuuucaagguacuaggcaggacuuaggacaacugagagacaauuccuuccacaauuauuugaauuacagugagguacucacagcaggauuaucacuagacuauaggaaaagcuucacgcuacagacuaugguggcuuucuugggccucucuucccacccaggcccaacugacacuccugguggacaaacaagugcuucaggaaguagucccaaaauuccaucuguccccuaaggcaguuucuacuuaaaggggcagugguccaauuuauuuaugaugacucauuacuucaaagagaacaaaaauacuaugaauauagugauuuguuauguuucaagcauuuuaaaaggcaugggugauuuucuuuagguuuucuuagagugcaacaaguuaauaacauaagaccucuacagaucauuucgucuugaucccaaaaucaggaaaaucuagugaggguuuuccccacuuuugacacacuuaugucagaggugaaaaaacaauaaggaugcaagaauggaaggaaggagaagaggaagagaaaggaugaaggaaggguuaaaaauaagaauggagggaagaaggagggagaggagaugaagaaagggagguaggggaaggaggacgggaggagaguaaaaggagggagggagaggaaagggaagaaaaacuaaccagacaaguaaaccaaaacccaggcaagcagguaucaagaagccucagaaauguagaaacgagauaucugacaacuuuuucauucccaguacaauaaggccucauuguacuuccugcaauuuauaucuuagauauucuacucuagcccuagaaauauacuaucuuauuggagcagagguggggaaggggcgggaaacaaaaagaaaucuacaauucuuuguuuuucuauuauuuaaacagucugcaauguuguuccagaagguagacaagagacugauaaaaccaaccaaaaaaacaagugaaaggaauaaaagcagaaugguauuaauuaugagacggaaaauguauguaauuaguaaguaaauauacaaguuggaucuccuuaaaaaaauaaacuugagaaaauuaaaaaaauuuuguaguagaaaaaagauaauccaaaggguccaacaucacaaaaguaguuuuaaauuauaagaaugaaaugaacaaugacaaauguagcauauauuaaaacugcaggaugcaucuaaaguagcacuuaggggaaauguauagucuugaacauuagaauaaagccuaaagauuauugggauaaggauuucaaggaaacuggcagggugggagggucaggagagggagguaaaacaaacaaaagcaaaaaaaaaaaaaaauucaagaaaggagauaaagacaacagcaaaaacuguuaaaauagaaaacaagcauauauuagaagaucaacaaaaccaaaaauuggcuguaugaaaaagaccauaaaccagcaagccgccaguauaauuuaaucaagaaaaaaagagaaggcagaaauaagcaguaucaggaacgaaaaaaauauguaaccauaauuuaagagauauagauuaaauggucaaauagaaaaaauauaacuuacugaaacaaagagauauaaagucugaauaguccuauauugccaucauauaaaauuaaaucaauauaauagugaaaaauauuuccucaaauaaaacucccagacuagauagcuccaccaaaaaguccuacaaagcacuaagugacccagcucagccagucccugcaauggccaaaggaaagaucaacaacaaagcccaacaaaaguggcagucuccagugaaaaugacaaaaccuuaguacauggccagaagaaaaaaauuaaaauuaaugccaugugguugacacccagagcucugcaugaaccauauaauauacucuggggacuccaaaaaauauuuggaagaggcacugguaucccacauuaggugggggcuacauggauuauaauuaauaaaaacuaauauucuaaugaaaacuguuuacaucuuaagggauauggaguuuucaaauauuagcugagaugugauuauugacauauacauaaauuaaguauuacucccagucuauccaacuuucuacuuuaauaguuauauaagcuauauacaaacuguagggaaacuuguguuguguccaggaauuuaaauauaaaaauacauuauguuuauuauaaaacagaaucauuaauacuguaucagucaacaauuauauaaauuauuuguaacuugaaauaaacagaauaaugaagugauuuuuuucuuuuuguugauuauuaucuaauaaaaaauaucaauauacaaaaacagggaugaugugcucuauuuuaaaaaaagaaaguuaucaagagugcccauaaacugcaugaucugacacuugaauuaugaaaaauaaaucuuauacuugaagucaaccuuuaauuuaaaaaucauagacaauuaugagucaaagggaaauuuuaugauggcuguuuucuauaguuaguaauuacaaucuacauuaaaaaucaaauuucuuuuuauauuuucuuuuucuuuuagagacagggucuugcugugucacucaggcuggagugcaguggcaugaucauggcucacugcagccucaaccuccugggcucaugugauccuccugccucagcagcccaaguagcugggacuacaggugcaugccaccaauuuuuuaauuuuuuguagagaugggggucuugauauguugcccaggcuggucucaaaaccccuggucucaagcaauccuccugccucagccucccaaagugcugggauuacaggcacgaguugccacaccuggccuguuuuuuguuuguuuguuuguuuuauuuugagcagaguuuugcucugucgcccaggcuggagguccaguggcacgaucuuggcuaacugcaaccuccaccucccagguucaaaugauuuucgugccucagccugccaaguagcuggcuaauuuuuguauuuuuaguagagacgggguuucaccauguuggccaggcuggucuccaacuccuggccucaagugauccacccgccuuggccucccaaagugcugggacugcaggcgugagccaccaugccuggccaaccugaccuauauuuucucaaacacaaacauuuuacuaagacuauauuagacuauccuagucacugauugauuuuaaaaauuuaaagauuguugcauggaucuucccagauggaauauauuuaacaauaaaauacaaucacugcaaaaauaagaauccauuauuuuuccugaaacaauauauauuauuuauauauaauaauggcucccuuucauuucugggcauuuaaacgucuaauucugccugaaaggcauguccuuccaugguacaccuuuucuaguuuauaacucugaucacucuuuggaucucaggaaguuccuuccugaagugagccuugcaugaacccuuagaucaagugaggucucccuaucaaaugugcucauagauuuuuuuuuuuuuuuuuuuuugagacggagucuugcucugucgcccaggcuggagugcagugggcaugaucucggcucacugcaaccuccgccuccugggcucaagugauucuccugccucggccuccugaguaguugggcuuacaggcgggugccaccacgccuggcuaauuuuuguauuuuuaguagagacaggauuucaccuugguggccaggcuggucucaaacuccugaccuagugaucugcccgccucagccucccaaagugcugggauuacaggcgugagccacugcgcccagccugcuaauagauuuaaauaccauuccuuaagagacagaagaagagaccaugaagaacacagaaguauuaacacuauuuuaaaguaaaguccuuauauaaaaagcaaauaguaaaauaauaaguauaauaauaauaauaaguaaaauaaugucuauagauuccuugggaaaacuaggagaaaauuuaaaagcagaacuauuuuuaaauuacuuaaacaguuaaaucacaacauucucuuagagaugccagaaaauucugcaagccuuaaguuacaagaaauauuaaaauuuacucacauuuaaaauuuacuuacauuucuguauguuuuauacagaaaaaauacauguagaauaauauuacuaauauugaacuccacacacuaaguacuuuauacguauauuaccucauguaauccucaugauaacucuaacuuuguuuuaccauuuuauaggcagaaaaacugagacacagaaagacuaaauaacaugcccaaguucauaggcauaaauuaauaauuuuuugucaggcuuggaaccuggcagucugaugccagaguguauaugcuuuauugucucuacaaagaauaaaauaaauaggaagcucaaaaucugggggggaaggguaaaauaaugggguauuugaauuuuuucacauuuuucaugcauagcaauucuuuacauaauuaaaaugagccaaugauaguaaauuuacaccacauuccaaaacauaagccaccaucaaacuauuuauggaaaacucaugauuaguuuguuuaccacacucuaccacgguaucuaguuuuccuacuauggacgccacccagcaagagagcccaguaugcagacauggacacuaauugucaaacagcacuagguagggauuucuggcagugaaccaaaagaaacgagauuaaugaauuuuugcuaugucugauauauaaacaaacacacagguaguguguguguguguguguguauuuauguauguguguauguuuacguguguguuuguguauguguguagcuuuucagucaggcucucuauccuguaucaucaaagauuauaggucucugaauauuacugaauaaaaaauauuaagcccucuuacuugguccuagauggcccuaggagcagauccaaugaaauaaacuacacaagagugacugauacuaaaaaacaccagaacuagguuaucuaugaauggaaaaugcaucuguguaucuagaaucagcaacccuaaccuuuagcacacagucuagaaacuugaagaaugaaaaccaaccucuacaccaagcuugcccaacccacgggcauggcccaggacagcuuugaaugcggccuaacucgugaacuuucuuaaaacaguaugagaucuuucugugauuuuuuuuuuuuuuuuuuuagcucaccagcuaucauuaguguuaguguauuuuacgugcggcccaagacaauucuucuuccagcguggcccagggaaaccaaaagauuggacaccccuacucuaaacaguucaaaaagcucucauaaagccacuguaccaaagcaauauacugugcuuuuaagaucuuguuagaaaauuauugacuuguauaucguauaauccuuaaaacuuaauuaucuggcuuccuggguuucaggaaaguaaaagcaacuaaacaaaaauggcaagcuguuaccagccacauacaccagcauucucaagaagagauagcuuucaaccuaauaagacaaaaaguaaguacuggccaccaaaugagacaacucaucaccuguaugcuaaaucugagucacuaaggacacacagucuucucagaagguuaaaacaagauuagauaaaaguuuaagcuucaauuucuguguaucaaauacucaaaccaaugaaaaaucagguaaauaaguuguuacuauucagaaucuacagcaugccauccuauuauuuauuuaggacuaaaauggaaaaagucuaugauucuaggcuggcccuaucaaggacugcuguaugaaaauuuuauuucaaaaauagcagauggaagacacagcucuguauuuaacaaacaugaaacuauuaagccaccauuugagagcauucaaugaauaaauacugagaaauauuaaauuugaaaaauaguguuaauaacaagacugauaaguuuggaucuuuuuuuuaaauugaauguauaagauguguacaaguuccaaaauguuaucaacagcaccugaaaaaacuuuccuuuaaauugagcaacuguaaaagacaaagaucuuaaaaguauuucauuuuaauauagcaugaauuuaacauucauuaacauuaaaaaauuaagauuggaaaaucaauuuucuuaugguuuuggcauuuuuuuaagacaacaggguaaugcuauuaauuccuugggaauuagugauugcugauaaauucauuuuuacauauaaaaguauuaguugaacacuuaauacuauaaaaauuguaggugccugggacauaaagauucuaaugaaagaaauagacaugaaucaaauaauuauaauauaggaaauucucucacagaugagagaugaaggcagcagcgaucccaggaccagcuguugagaauaaaguagaauuuaggaugaugcaggguuugggcuuaagguagaguacauguugguacuaguagcugugagagaauacaggagggguggauuaugugaaaacaggaauaaauaagaggcuguuuggaggagacauccaaguagauauguucacagggaaauugaagacacuccagacaacucuagaauuucuacaaaggaguccagggacagggguuaggagacacuucuugaggccaaguuuccauacuaaccacacuccuuuuacauaaauguuuguuuuuugguuguuuuacauagauuguaugcuuacucagugaagcuuucauguguaacaggucauagagauuauggggggcugcugccuacacccucuuccccuuguguuaugagcggcugaauuggguuccacagauaaauugggucgcuggaguacaaagaaaaccuacuauaaaaagaagggaggccaagcaacagaaccuagggaaacaccaacguuuaagagagcuggggagagaagccaaacaaauaguaaaugagacugaaaaggagaaggccaagagacagaaggagaaccagaagagacuggugcacuggagccaacagaggagaacuucaggaaguaacaggcagcaaugccaaagauacagagagaucaaaugagacaagaaggauggaaaugggauccucggggcuugagacuucgcaguuaggaagucauuggugacaucugcagaaaaagcuuggggugggaggugguaaggaaaaaggaacagccacaccacagcaguguagaugaauggguaaaaugaggaagacagguaacuggugaggggugggugguucugguucacuuagguugucaauaaaguggaaaagauuaaacaagagaugauauauccugauaaagcaaagucccagagaacacaggaaggaaugagcuauuuaccauuugacauagaaauuuaaauuagcgugugaugagaacacuagccucagucaguguaauaacugugauacagacacuuucauuuguucauucaaauauuuacaagcaucuacuaugcucaggaacaauacucggugcugaucauuuaccaacagagcccaccuaacuccacccacccugaaggcuggauauaucuacagucgugguccaugaugcuggcagauaacaugaaaucaacaaauacuucuaauaauccacaaguggauuucauccucuuuauguccuccuagaaugugcaaugggccauacuaccaaaaaauuauagcaauaauaacaaagucggugggggacaugcaaucuagguccaauguagaaaguauuccuccuuugaauuaaaaaaaauucuguauauuuagcaaucacauacaaauauuacugacugaaccauuauucccaguuaaaacucuucacguuucuauuccauccucaauuauacuucuuaagaugucacaauuucuuuguuccuucucaaacuccaucagcuuuucaaauauaaagggugcuuaauauauuuuuauuuucauauaaguaauauaaagcaaaauuauggaaacacgugcauguuaguaaauuugcaguauguuauaaaagaauugacaucuaugcuguuagucuacuaagugccaagaaugacuuuauacauacauuauauaauuuaauccucaaaacaacucauuuucaggugaagagauugagcuuuagagagguuagccaggugcaguggcucacgccuguaauccaggcacuucgggaggcugaggcaaguggaucaccugaggucaggaguucgagaccagucuggcccacauggcaaaaccccaucucuacuaaaaauacaaaaaaaaauuagccaggcaugguggcacacaccuguaaucccaguaccucaggaagcugaggccagaggaucgcuugaaccugggaggcaggggcugcagugagccgagaucacgccacugcacuccagccugggcaacagagugagacuccaucucaaaacaaaacaaaacaaaaaacucaguagagagguuaaauaaccucaaguuacacugcuaguaacugacagagcugagacugaagacucaacuuuguuguuucugcucuaccauacuacccuuuacucuaaaugauaugcagaaacaaacaguaaacauuuugaacauuuauauucuuaaguuacauauuuuaugucaaauauuauagguuucauuaccaaaaaaguuauuaguuacuaagauaaaaauauaguuauugaaacauuauguuuacuuuggauauguaaacauugauuaaaauauuaaugauagcaacuaacauuuauugagugcuuacuaauaugccagauguuauuccaagugcuuuagaaagauauuuaugcuucacaauuaucccaagaucauaaaugcaacaagugcuaaagccgguauuuaaacucagagaaucuaacuuuaaagcuuauauuccuaaucaguacauuauauaaagcuauuuuuguaauauucuuuacauuaagaaauuuuaaaaaaguaacuacauuauuuagauauagguuuuccccuaaauuacgaauacacuuaauaauguacgaugcagaguuagacauucagugaauuaacaagcaacauauugagauacagcuuucucuagacagucuuucagcuacaaauuggauguucaauuuuaauaucccagucuuuauaacaauuaucaauuagcaaauuuuaaaacaaggaugcuuuguagaaagcuagcacaaucagcuagcuuuauuuuaaaaucaugaacuaucaagaaaauuguaggaaauuugccauugcuacuuuaacaagaauuaugggccgggugcgguggcucaagccuguaaucccagcauguugggaggccgaggcagacggaucaugaggucaggagaucgagaccauccuggcuaacacagugaaacgccgucucuacuacaaauacaaaaaauaaauaaaaaaauuagccgggcgugguagcaggcgccuguagucccagcaauaggcugaggcaggagaauggcgugaacccgggaggcggagcuugcagugagcggagaucgcgccacugcacuccagccugggcgacagagcgagacuccgucucaaaaaaaaaaaaaaaaagaauuaugaaacaagaucuacaaaaauuggcugacccugaacauagacaggauauuauuugaauagcuuaaaacgcccacauucuacagacuggucaauuaaguuaaaggacaugcagaaagaugcuggacuuggaauaugccauugggaaaaauccaaacguacaccaagaaguaauuauucugaccuaacaguagauggcgcuaauacaacguauccuuuucauuaaaaaaugguccauuuagccuucuagauuauuuuuaugaaugcaaccagggcucuuaaauuagguacaauuugauucauauaauuucauuucuaaccuaauuuugcuuaagcugaacacauagguaucuuauacacgaaucuuggcccuuuuuaaaagcauuacuuaaacauagauuaaaaagcuacaaaauuugcuaacaaauaaaacagacauacauacuaucacaaaguuugaaacugaaaaaaguaggaacagguuuuaaaaaacccucaaaacaaauaguaucugaacguuuugagguuugaguagccuaagaguuugaaauuaugccuacaguucaacuaugggaaugcuaaaaaaaaucccucaaaaaucucuagucucuacaguaacaagauuuccauuucuuacuguaaaacccuuuaaggcuaugaagaauauacuaauuucuuguugacaagcaagggaacacaguccuuccucccuucccauacuagcccauccuauauacuuuauaaauaauagugcuucucaauucagagguaaauaaugucucugaaugugagcacagaaacauacguuacuuuaauuagucuggaagcggaaaaaugcauagcuguguauuauuaucauguuagucuagaaugggagaugcgguuggagaaggcaggaaaugauggaaauuguuaaagguacaacuaauauucaugauaaacauauuuaacaauuuauggcccaacgcaaacccuagaaguaaaucuaaguauaggccacaccacagaauaauaguacauaugcagcaccacagaauaauaguacagcaguaucauuagcugaugggcucuuucccacaucgaaccucaagccacacagguggguaucccuucugcuuacugggcugcauauaaaggacugauuaccagaagauauuuuaacugauaacacuggaauuguagaaaauacaugagcaucuguguuuugacuccuagucccaacacuuguauacuauaacucaggaagucacuuaacuuucaaauucgauuuccucauuuacaaaaugaaaguaaagugggauuauauguagugagaacugaaaaagaauagauauguagaguauguaagaugaguaguacauaaagagucaauaaauauuggaguccauccucuuucuuuuaccauauuauagaagcaauaaggagcaggcagcaauaauaguacauauccacuuaagcugacuccaaucaagacaauaguuagaaaauaagaguuuuaaagaauagaaugcaugcugccccccaucaccaagaacuaauaaaguacaaguuuucugaaaaaugagugcuuaguauaaguaaaugaaacucaaagccauaagcaauaggcccuauaaauagugacuccagcuaugaaucuaaaagcaaucaccaagauauauauauggaaaguucuuuuagucauauuucagucuuuaauuguauagcaauucuuucaguauaacacaaacuuuguacaagguuauuaaaaguguuuuuaguaagauuuuuaaauuaaucccauacauaacaaauauuagaccucuagauuaccuuucuaauuagaaagacauuucaaaaauguccuacuaguucagagagaacagaugccuagaauaaccuggaaauggguacucagauauuuguagaacuagaauaaaauaaaggcauuuuucagauaagcauaaaaguuuaccaccauuugacauucacuaaaggaauucacaaaaaauauuauuuaggaagaagaaaaauacuccauuagaaaggucugaguuacaagaaagaacaguaggcaaagaaacugguaaaccugugggccaaucuaaacaaacauuaccuauauaaaauacugucaaauuuguagaauuauuuaaaguuaaaauuauggauaagaguaucaaauaaauuguagguaguaggggaagguuaggguaauuaguguuaaacuguuguaaggcuucuguauuuuuucaagggggauggguuuuuaaauauggaauaauuuuagauuuuguuagauggauuagacaaaaguauaaacuaaaggaacauuaauacauagcuccccaaccagaaaaggcgaaaaagaaaauguaaauaauccaaagcaaaaaucuuaaucuaaaaaaauaaggcaagaauggagggcaaagcauagaaaaagcaggacaaacagaagaacagggauggaauaaagaaauucagauccauaaucacaauaaauauaaacagacaagacucaccaaagauuuuaaaugucacccccacaaaaaaacaauccacuauaugauauuuacaagaaacacacuaaaauauaagggcaugcaaaugcuaaaagaugaaaaguggaaguagaaaaagauaccacuggcaauauuaaccaaagaaagguggaauaaccuuguuaaauaagacaaaauaaaucuaagcaaaaugcaucauuaggguuaaagagaaucgugacauaacaggcuucaaugcaccaggaagauauaagaauucuaaacuuacaugcacugaauauagauaaacagacaaagaaaaauuugcuagaacucuaaggaaguaucaaauaaucucuauauuacuguuaggucuagcagauaaaauuaguuaagauacuaaagaucuaauuaaagcaauuuaaaaacuugacugaauggacacauagagaauccucagccucaaaauuaaagaauuacaggcauacauggacaaucuauauaaacuguugaugugcuaaaccauacagcaagaccaaauacauuuaaaagaaucaguucauacaaccacguuugcugaacacuaugcaauuaauuaauguguaauucacuaacaaaaugacaaagcauaaaagcacccacacuggauaauuucaaaacacuuuaaauaauauguggaucaaaaaauaaaucuuaauagaaacuuaagacacuuagaaugaaaaagaaaugcagauuucuaaaauaugcuaugaaguagucagaaggaauuguauagcuuaaaugcuuauauuauuguaaaugcuuacaauaagguagaggauuauaaacuuaggaaauguaaaaaaaaaauaccuauaagguuuuaaaugcaaaguuucuaccaucuaccaaacugccaaguaacagaagaugaaacucuuguauaaaaacuuuucuagagauuuuacauauauauaaaauuauuuacucuccagcuuauuuuaagaggcuaguaaaaccuuuaaaccaaaaucagaaaagcauaguuaaaaaaagaaauuacuggccaggugugguggcucacgccuguaaucccagcacuuugggaggccaaggcagguggaucaccugaggucaggaguucaagaccagccuguccaacauggcaaaacccugucucuacuaaaaauacaaaaauuagcugggcguggugaugcacaccuguaaccccagcuacuggggaggcuaaggcaggagaaucacuugaaccugggagguggagguugcagugagccgcgaucgugccacugcacuccagccugggcaacagagcaagacuccaucucaaaaaaaaaaaaaaaaaaaaaaaaaaaaagaaaagaaaaagaaauuaccagccauuccuuuuaugaacaauguaaaaauucuuaaaaacaaaauuaaaacaaaucuaguagugaauaaagagguaucaggaccaaacugaguuuaucccagcaauacaagaguagcuuaccauuagaaaaucaagaaagaucacuucaagagguuaaaaaaaaaagauaaauaaauuucuuguuaagaagaaaacacaguacacuaaaaguacaaaaacacuucuuggcuagucgcauuagcucacaccuguaaucccagcacuuugggaggccaaggcaggcggaucacuucaggccaggaguuugagaccagcccuggccaacguggcaauacccccacucuacuaaaaauacaaaaauuagcugggcgugguggugcacgccuguaaucccaguuauuugggaggcuaaggcaugagaguugcuugagcuugggagguggagguugcagugaguugagaucauaccacugcacuccagccugggcaacagaucaagacucugucucaaaagaaaaaaaaagaaacuucuuuaauaacauaaaagauaucuaccaaaaucuacagaacacauccuucuuaauggucaaaugucagaaguauuuguuucaaaaugaguaacaaguacgugcaguaucagcacucuacugguaacugaaguccugcauugucuaauacaauagcuacuagccauacacacacagcuaugaggccuggaaauacagcuaguccaaacugagaugugcuguaagugcaaaauacacaccagcuuuuuaagauuuaguacccccccaaaaguaaaauaucucauuaauuuuauaaugauuacauauugaaaugacaauuuugaguuaaauaaaauaaagcaaauuauuaaaacuaacuucaccuguuuuuugcuuuuuuuccacugugacuaccagccauuuuuaaauuacgcauaaggcuaacguugcauuuccauuggauagugcuauccuaaucaguuaguaaaacaagaaaaaagaacagaacgaaccaauauuggaaaagaaaaaacaaagcugucauuauucucagaugcuaugguuaucuacacagaaaaacaaaauaauauauaaagaaucuguuagaaucaauaagaagguuuagcaaaauggcuaauugcauucugcauauaucaacacuuagaaaauguaauuuucaaaaagauaccauugacaaaagaaacaaaaauauaaaacaccuagaauuuaacaaaggauacacagaauuuuauugaacuauauuaaagagacugaaauaaacagagaaauucaauaucgaaaauccccaaauucaucuguagauucagcaguauucuuaaauccaaugguauucaccaaaaucccaaaagaguuuuaugaggaaccauaaaauuuguauggaagaccccacaauagccauggcaucuuaaagaagaagaaagugaagagaccuucccagauaccaaaacuuuucagcaaagcaauauuccauuaaaagaauagauugcagaaaugaaauuaacccuaaauauauggauuuaugacaaaagcagcacugcaaaaaaagagaaagucuuuucaaauauuggugcugagucaauuagguauccacauggggaaaaaauuacuuuugagccuuaccucauuucaugcaaaaaaaaaaaaaaaaaucagaagaauuauagcucuaacugugaaagguaaaacuguuccuagaagauaaauaggagaauauuuugggaauaggcaaagauuuuuuaaacaggauacaaaaacauuaacuauaaaggaaaagcugaacaaaguaaacuacaucaaaauuaggaauuuaugauuauuaaaagacaucaauaagagaacaaaaauuuaagucacauggagagaagagauauuuguuaaacaucaaagagcucauuuuauaaauauuaagacaaguccuaaaaucaauaauaaaaaaaaaagacaaauaaaccacuagaaaaauaggcaaggcugagaacacuggcucaugccuauaauuccagcacuuugggaggccgaggugggaggauuguuucaggccaggaauuccagaccagccugggcaacauagcaagaccucaucucuauaaagaauuuuaaaaaauaaaaauaaauuacauaaauaaaaaagaaaaauaggcaagagacuuuaacaggcauuuuauaaaauaauauauccaaauagucugucugccuauugauagaucuaugcucaaucucaacagcaauaagggaaaugcaauuuaaaaccacaaugagguaccacuacacaccaccaagauggccaaaauuucaaagacugacagggguuaaaccuaagagauggauggaauguggaacagcuggaacauucacagacacagcuaggagugaaaacagguacaaccacuuuggaaauguggcaguaucuacucaagacgaacauacacaaaccuaccagcaguuccauuccuacaaauauccccaacagagaugcaaagguguacuagcccccagauggaaaaaacccaaauaucuaucaacagaauagagaaauaaaauguggcauacuuguacaaauaguauauaucuaugaaaaugaacaaacuucuauuaagcucaacaugaaugaaucucacauaguauugaacacggaagauaagaaacaaaagaauauauaguauauaauuucauuuauauaaauuucaaaauggccaaaacuaacugauaguguuagaggucuguagaggagguaucgcuagggagaagaauaguacuuagcaggucauuugagagaaugcuaaguuuuuuuuuuuuuuuucauguagauggagguuacauacccauuacuuuguaauaauucaucaagugauaugauuuguacauuuuccucucuguaugcuauauuucaauuuuuaaaaauaauucugaauaauuaaagauauaaauguucaaccaaaaaaaucaauauuuuagaagaaauuauaggaaacucucuugaugacauugagguaauaaaagaugucuuaaacccaagaauugcuaacuauaaagaauauauaggcugggcauaguaguucacgccuguaaucccagcacucugagagaccgaggcgggcagaucaucugaggucgggaguucgagaccagccugaccaauauggagaaaccccgucucuacuaaaaauacaaaauuagccaggcaugguggugcaugccuguaaucccagcuacucgggaggcugaggcaggagaaucacuugaaccugggagguggagguugcggugagccaagauuacgccacugcacuccagccugggcaacaaggcuggagugaaacuccgucucauuaaaaaaaaugaaacuccgucucauuaaaaaaaauauauauacauauauauguauauauucauaaauuugacuacauuaaaguuaagaacuucuguucaaaggauaucacaauuagccaggccugguggcacaugccuguggucccagccacuugggaggcugaggcacgaagaaucauuugaacucaggaggcagagguugcagugagccaagauggugccacugcacuccagccugggcgacagagcaagacuccgucucaaaaaaacaaaacuaacaaaggacaucacagagaaugugaaaaggcauaccacaaaugaggcaauaaugucgacaauauauguaaccugaagauuaguauccagaggccgggcgcaguggcucacgccuguaaucccagcacuuugggaggccaaggcggguggaucacaaggucaggagaucgagaccauccuggcuaacauggugaaacccugucucuauuaaaaauacaaaaaaauuagcuggacguagugguaggcaccuguagucccagcuacucgggaagcugaggcaggagaacggcaugaacccggcaggcggcgcuugcagugagccgagaucgcgccacugcacuccagccugggaggcaaagcgagacuccgucucaaaaaaaaaaaaaaaagaaaaaagaaaagauuaguauccagaauacauaaagagcuuccguaaauaaguacaauccaaaaaaauccaauagaaaauugagaaaaugaauuuacggaaaaggaaauaugaacaguuuaacagauauaaauaacaugcuuagcuugaaauuaaaaccacaaugaacuaauauuuacaagcauuauaucagcaaaauugaagcagcccgacaauaucaaauguuaggaaaacaauaaucagugggguuuuuuauguauugaugguaggaaagcaaaguggaacaaucauuguagaaaacaaugcgauaucaucuuguaaagcugaacauguauaucuuccgugauucaguuauuucauuucaguggaaacacuauacauaucuucuuaagcacacacauaaaaauguucauacuagcauuguucaucuucacaaaacauaaaaacuggaaacaacccuaaaugcccaucaaguagagagcagaucaauugugguacauucacgucuaaguuucauucauucaugaaaugaacaacauacagaugcuccuuaaucuacaaugggguuacauucuuauaaacccaucauauguuaaaaauacugucagucaaaaauacaguuaaauagcuagcuuacugaacaucauagcuuagccuagccuaccuuaaaugugcucagaacauuuacauuagccuacaauugggcaaaaucaucuaacacaaaaccuauuuuauaacaguguugaauaucucauguaauuuauugaauacucaaagugaaaaaacagaauggcuguacaguuuuuacugaauguguaucgcuuuugcaccauuguaaaguuggaaaaucuugaauugaaccauaguaaguuagagaccaucuguacagcuauacacgacauugacacucuuagaucaauacugagugaaaaauguaaaacagacaagacucuguacaggauuccauauaaagcauaagacaaaacuaagcaacacauuguuuagggauauguacauaucuagguaagcugcuuuggagucugcuuuguuuuaaaacgcagaaauauaagcuccccccuccaaacaaaaaaaaaucacucuaguacuuaucucuggaggaaugguggaggauggggcugggaggaauacaauaucguuucaaaguuacuaugauguguuagcuuuaaguuugguauuagauucacagggguuuuuuuuccuaauaauuuacuuaaaaguuauguauuucuuuuacaugaaucccauaacaaaugacaaaaaaaacuucuuaaaauacauaaauaugaguucuaauauuucccuugaaaacugcucaagagauauaccucccuuguagcucuuggcaucugcuaacucaaaucccucucucucuagcucagaaacucuucuaucaaauuuauucuucaaaaaaaucacccacgggaguaaugucagcaaagacagcagaguaccaauggcccuucccuccagaaaaacacacaaacaaaaaaaugagaagaaacuaucagaauuaacuucaucugaacgcuggaaaauagucaaagguuuacagcaacuaaguaaauaguggcucaagacagaggaaacaugaaauuuugguggcauuuuuacuugcccuugccccaaugcccucccugauuuagugacaaucuugacaauggcagcccacauuuccagcgugggacuccaguucuacagaaggcagagcagaucuuauuuucaaagaacuguguuugucuguuuugacuuaucuggggacaaccuucaggccugacaaaagacacuugccuuacuuucaccuaacucaagacuuucucaaggcagaaaaguggcuauacagagggcauucuuugaaaacauugaaaggcaaaugaacaaaccaccgucaccugaagcaaaagauuacuguuaaggcacacaaaagauaugcugcagccugggaagaaagauucuuuggagauuuagugcauugaaaagcugccauguguuacuggggaauuuagaaagccauaugcaugcccgugguaggaugcauauucagaaaagaccugagaagaccccaaacuuucacaucuugcugaucuuuaggcucaguucaagcaggcuaugagaggacuguaaauaaccugucuaagcuuugaaaaagugccccagugcagagccaaucagcaaauuuuagaagaauacauuuuguuguuuauuuauuuuuauuuuggaaguaguggugagguggguggugaggcuccagguauucaaggccaucugucaaaacaauugcuaaccacaagcuaacaaacagacacuucagacaucauacaugacaaagguacagucuuuacaaaaauagcuuacaaaaguuggccaggugcaguggcucaugccuguaaucccagcacuuugggagggugaggagggaagauugcuuacguccaggaguucaagaccagccugggcaacacagcacgacaucaucucuacaaacaauuuaaaaauuagccaagcauggucaggcaugguggcucacaccucuaaucccagcacuuugggaagccaaggcaggcggaucacuugaggucaggaguuugagacuagccuggccaacauguugaaacccugucucuacuaaaaauacaaaaauuagccaggcguaguggugugcacguguaaucccagguacuugggaggcugaggcaggagaaucgcuugaacccaagagguggagguugcagugagccgagaucacaccacggcacuccagccugggugacagaccaagacuccguaucaaaaaaaaaaaaaaaaaaaaaaaaaaaaaaagauuagccaagcaugguagcacauaccuguggucccagauacuuaagaggcugaagcaggaguacugcuugagccugggaggucaaggcugcacugagccauaauugugccacugcauuucggccugggcaacacagcgagaccccaucucaaaaaaaauaaaaaauaaaaagaaagucaccaaacaauuacaacccacacaagcaacaaaaacaaacucugaggaucugaggaaggggaagaaucugaauuccagcauuaucacacauuacaauaauaaaauguccaguuuucaaaaacuuacaaagcaugcaaagaaaaaagaaaauaugacccaucauggaagaaauuaacagaaacuguuccugacauuggacuuacuagacaaagacuuuaaaucagauuucuuaaguaugcucaaagagcuuaaaggaaacauggacaaggaacuaaaggaaaccaggagaauuaugucucaacaaauacagaauaucaguaacaagacagaaaguauaaaaaggaaccaaagagaaauucuagaauugauaaauacaauaacugaaaugaaaauugcacuagggagguuuaagagcagaucugaguaggcagaagaaagaaacagugaaacugaaaauaggccaauugaaauuaucaaacuagaggagcagaaagaaugaagaaaaaugaauggaggccaaaagaccugugagguaacaucaagcacucucaacacauaaugagaguuccagaaggaaagaauagacagaaaaggaaagaauuauuugaagaaauaauggccaaaaacuucccaaauuugauaagccaauuucucagcagaaacuguauguaagccagaaagcagcagggugacauauuuaaaaugcuaaggaaaaaaaaaaaaaaaacagucuaacgguaauucuauaucugacaaaacuaucuuuuaaaaaugagagagaaauuaagacauucucccuaguagaccugcccuacaagugaugcuaaagaaguccuucagguggaaaugaaaggaugcuagauaauaacacaaagccauacaaagaaauaaagaauacugguaaagguaacuguauagauaaauaugaaagucaguacuauuuuacuucuuaauuugcaacucuucuuuuuuuacccuuaugaacuaaaagacaucuacauaaaacaauaaucauaaaucuguugacagugacaccacguaaaagaaguaauuuguagcaacaacauaaaaaaaaacaggccaguggaauaaaacugagaaucuagauauaaacaccuacaucuacaaccaacugauuucagaaaagggugucaagaccauccaaaggagaaagaauaaucuguuuuaauaaauggugcuggcacaacuggauauccauaugcaaaaaaauuaaguuggacaccuuaacauauacaacucaaaauauaccaaugaacuaaauguaacaguuaaaacuauaaaauucuuagagcaaaacauagaguguauauucauaaccuuggacuugacaauagacagauauaauaccaaacauauaagcaaaaaagaauagauaaauugaacuucaucaaaauuaaaccuuuuguacaucaaaaugaaagauaaccuacagaaugggagaaaauauuugugaauuguauaagagacuuguaucuagaauacauaaagaacucuuacaacucaacaaaaacacaacucaauuaaaaaaugugcaaagaauuugaaaagaccuuuuggguauacaccugggaguggaauuaagaagauauacaaauggcugacaagcacaugaaagaugcucaucacuagccauuagggaaauggaaaucaaagccacaagaggccaguguaguggcucacgcccauaaucccagcacuuugggaggcuauugcuuaggccaggaguuugagacuagccuggacaacauagggagacccugucuccacaaaacuuuuuuaaaaaaaucagugggguggccgggugugguggcucacaccuguaaucccagcacuuugggaggccgaggcggguggaucaccugagggcaggaguucgagaccagccuggccaacauugcgaaaccccaucucuacuaaaaauacaaaaaaauuagccaggcgugguggcaagcgccuguagucccagcuacucaggagguugagacaggagaaucacuggaacccgagagguggagguugcagugagccaagaucacgccauugcauuccagccugggcaacaaaagcgagacucugucucaaaaaaauaguaauaauaauaaaaaauaaauuaguggggcauagugguauacaccugcagucucagcuauucaggagacaaagauagggggaucgcuugagcccaggagugugaggcuacuacugcacuccagccuggacaacaaagugagacucugucucaaaaaacaaagccacaagauaccacuucacacccacuaggauagcuacaaucaaaaauauggaaaauaacaaguguuggugaggaugagaagaaacuggaucccucauacaauggugagaguguaaagugguauagcugcugugcuauauauauauauagcaguuucucaaaaaauuaaacauggaauuaugagucacucuuccacucuuagauauuaccaaaauaauugaaaauggguaguaagacacuaccuguucuaauguucacaggagcuuucacaauagccaaaaggugaaaacaccucaaauguccaucaguagauaaacaaacaaaaugugguaaauauauacaugaaauaucauucagccauauaaauaaaguacugauuuguauuauaauauggaugaucuuaaaaaucgugcuaagugaaagaggccacauacaaggucacauaguauaugauuucauucauaugaaauauucagaauagguaaauucauagaaacagaaagcauauuggugggugccaagggcuggggcagaggcaaacugggaauugccacuuucuuuuggggugaugaaaauguuuugagacuugauaaaggugacaguuacacaacacuguggauguaccaaauacuauugaauuauauaguucaaaugguuaaucuuauguuguuuauaaauuaaaugucaccucaauuuaaaaaggaaacaagaacaacaacaacaacaaaacaccuguggccuuaaucagaaagccacaaauuaucuucaauuucuuuuuuccaucaucacuuacaccccaccugucacugagcuaaggcagauucuacuuccacuuuagaaggugauuuucccccuuuuuccuuugcaacugucccugccuucauucagaaccaucacuucucaccuacuaauuacaacaguuucauagauugucuaguugucaacagcacuguucccacauuuaaucccuucugaaguugcugccagauucaccuuucuaaaaaugcaaaucuaaucauauaaguuuccuacucaaaaucuuuccuuguucccugauagcuuucaggauaauaugaagcuccuuauccuagcacaaaaggccauuccuauucuagccccuuccuaucccucugggcucacuuccugucacuccuccccuuccuccacuauacagaggguguagucuuccuacuuccaagaucuaugcucagccugggcaacaugauaaaaccaaaaaaaaaaccaaaaaaaaaaaugucuccacaaaaaugucucuacaaaaaaauacaaaauuagcugggcaagguggcaugcaccuguggucucagcuacucuggaggcugaggugggaagaucaccugagacugggagguugaggcuacaaugagcugugauggugccacugcccuucagccugggcaacaaagugagauucugccucaaaaacaaacaaacaaacaaacaaaaccaaaaacaaaaacaacaaaaaccaugcuguuuaauuaaguucucuacuucugccugggauacucuuucccaagugagcaacuucccuaaaaauucaacuaaacgucucauucaguuuccaauucucuauuuucacagcauaccaaccauuucacagcauaccaaccauuuaugccaugcuuggauaaugguugguauacaguuauaccacacuguaguauaacuggcuuauuuucuaaucaacuagauaaucccccaguagacucucagagcaggggccaugacuuuaucauacuucugucucaagaaccuagcucagcaaauguucauccauucagucauucagucaagcauaaaauaauucagggauccacucauccuucacuaccugauccucaguagugaggaucacuauucgucauuccccacucaccguugcccucauccuucaugacuagccaguaucugagaauaacuggcaacuuguuuguguaauguuucuguuuaguacuccauccucaaacuaaguaaaacaagagcuuuugacaugauuaacacauuugauacacgaaagaauacuuuuuaauccuucuuauuaaaaaaacugaaaacuagucuaagucaaucuaaggaaauguaaaaaaaaaugcaaaguuucauuaaauaagacugcagucaaggcaaaauccuuuaauuaguuuagaaaauuuuuaaaaaccuuaaauacaaaaauuuaacuaacuguucucucccucacuggaaauacaauucaauuucagucuuuagaguuugacauaguuauacucacuccuguaccacuaucuaccaauccccuaaggcauauugccaaguucucaggcuugccaaaucauuugguuggcauuagauaauaugcuggaaacuagauucuuuuggaauauuuuucaaagaaaguauucucuacucuuuccuuuuguuugugcugacacacuugauaucugagaauguuuugacaaucugaauguacccaggugagcccaagaaaagccagaauauaucucaggauuuccuugaugacuagagauaaauuaauauuuuaaaauaucuaaaauauauaaauauuuccuauaaaauuacauuugugugacacauuaaaguguuuuguuaaugagguuaguuuuacucuaguuguucaaauccaaucuaauucugcccacuuuacaacaucuauagauuucaaacccuggaaggcaugaagcacaacuauaaacuuucuuagaaucaagacugauucuuccuagggcuauuucugcuggacccaaagcauuucccccaaguuaauauuugauaaauucccagaaaagaccucgggcaaacauuuucucaaugccaccaauucuugugcuuugccuaaguaauucauuuguuuuauauuuuacagguuugggaucacuuuauuauuauuuccaucuuugcaauuggcuacuaaaaagcucacagcuagccgggugcaguggcucacauguguaaucacagcacuuugggaggcugaggcaggcgggucaccugaagucaggaguugaagaccagccuggccuacauggugaaaccccaucucuacuaaaaauacaaaaauuagccaggcgugguggcaggugcuuguaaucccagcuacuugggaggcugaggcaggagaaucacuugaacccaggaggcggagguugcagugagcugagauggcgcccacugcacuccagccugggugacaagagcgaaagcccgucucaaaaaagaaaaaaaaaaaaaaaagaaaagaaaaagaaaaaagcucacggcuaacuuacggcccauuuuuaaacuuccucauaugcaaucugguuauuauccucauucugagcuccaucuuauuaaacuuuuuuucuccuuugccauuauauauauuuaauuuugucaugcuggauauauuuuuguaaacugccuuuaaucccuucuggaagaaauccuuuaaaaaaaccucauauacacacuuggcuaauuauuagccagucuguuucugggccuccaaauguuacaggagccagacauaaaauuauuucacagcuguucaacaauccuuguguucauucuuaguugacuauauaucuauucccccauauaaaccauuauagggauuuuucauucucuuugagccaucacaauuuaucucacucuaaauaaauaaugucacugccuaaauuucagagaugaaagaaccaagcaguuaagcuuccucacuuuccucaccacaccccaucucaaaauuucuaaauuauaaucuugaccaaaagaaaggucuccaucuggguucuuaaugcuaacauuuuucaguuucuuucuauggacaugcuucguuuuuguuuagagacagggucucacucugccacccaggcuggagugcaguggcgcaaucauagcucacugcagccucaaauuccuggguucaagcaauccuccugccucagccuccugaauagcugggacuacagaugcacaccaccaugccuggcuaauuuuuuuauuuuuugugaagaugagugucucacuuuauugcccaggcuaguuucaaacuccuggccuccagcgauccuccugccuucgccucccaaagugcugggauuacaggcaugagcaacuaugugugguccaacugguauauuuaauggcauugauucugcuggcuccuucaugugccagaggaauuuuauaaagaacacuacauucucugcuguugucauuuuccagguaguaccagagguuccugccauggaccgaaaagaauagugauuugggacuagaaacugcgagguggugaaccaauagcaagcagugagggacaauuuagaagguauaauagaaaacagauaaaacccugaaaggcaacaguuaauaaucaggcaaguggcugguuugagggaaguucagcaugcauuaacagauaucccaacgauaggaaaucacaaaugucacacaucagagagaccccucuccaaaggcuuaggguuaucaaaccaaggacucuucaaagagaaauguaaguagcccagguaccugaauuggagugcaagguggggaacaaaucacuggaauaagguaguauacuaauuauaaauacugaauaaagcaucaaacuagcaacaacuacccuuacugcugaauccccuggcauugaaauggaacucuaaauccuuccuaagggcacacuuggucccagaggcuaggccggguggaggggguagcguauuaguaggaaucaaguggaacagaugaaagaaaaugaucacggcagugacaugcagaauaaacugccaggaagagaaacccuaaaagaaggauaaugagcuaagagucuacuguaauaaacacaugaaaagcuaaacuuaagaagcauauuaccuguaucaaagccucauaaauuuacuaauaucauauugaaacuaauguaugugugugagagagaaaacauaagcgcuaacacaugugcugugggcugaucguccauuaaaauggcucuuucccaaagucgccaaaugaucuuuauacuuaacagccaguucuucacacuuaaccuaccuaaaauuguacucacauggcacugaagaccaagugaaauaauuugucuuuauauauagcaacaaaagguguaucaguuuacacaucuuauccuacaugguucauuuccauucaccaucucuuucucauuagaaguuuuuaaggcuuacucuuaugugcacucucucuccuaucguuucaauauauuuguaaauuuugaugauucugauacagguaauaugcuuauuaagaaucuuuuuucuaugugugagccuccuuccaaauguuggaugccuuccugauuggugaguacguuguugauuuucccagucccauuugguuccagagacacaaaguaauuggauacuugcuuaagaugaaaaacauuuucauauaaaccuuugauuucucucaggcugaaaacucucaccucugauuaauuaaauugucuucauuuuucagaguccaacaauacuaguuuuaaaacuuccaggccuuguuuucuguuauuuauuauauguuaacucauuuaauccuuaacuaagauuccuucauuggaaccaccacacacagaaaaugaucugagugccuguuuucucaaauaucccaaggaugguugaugaccaaugcuauuccagaaccacaaaacuguuguauucauucauacaacaaaugcuuagcucauuagggcucaauuuucucaagaaauaccaguaaagaaaggccacaagucacaacuauacaguggguagguuauauuaucgucaccauuugacagaugaggaaacuguugacagaugaggaaacugugccccuacaguggcagggguugaguugcuugacuaagcuuacauagcuagucagugguggauccaagauucaaauccaggcuagcuucaaaaucuaaccauguuauucugaaucaacuuagcucuuccuccauguacagacuacaccuuaugaccuaaucuuuaaugaucugcuuuuuuaaaaucuguauauuucacaugcauacauuuguauacacaauaaaacugcaaacuauuuaaaguaagaaccacaauaaacuucccucauauuuccacagugcuagcucacaaaagguauucaaaauuuguuugauuguugcaauaauagccauaagaaaucaagaaacaaagaaaagugaauucaaauaggugugacuagcuuacaugauauaagccucucgagccaaacuauagucaucaguuguuagagacaugcuaauauguguauauuaaacauucugaaauuugaagauaaaaauacaaacaagauuuacauaacauaaacauaucaccaauaauuuucaaguuaucauauaauacuaauauaaaggcugcuauuucagcaauuuuacuuccuaguucccucugauaguuucuuagguucccacacagauauccuaaaguacacagaaaaaaaacagagaagagagagacaacauaguuaaagacgaaagucuccagaaaucuguugggauucuauuuuggaaucuacacauugagacuaaaguugacauggcagaagugaaaggaaaaaaaaaaugauuuccacccaaacuacaggaugccauacauaaauaccuucaaauuuucauauuguugccauugcuaauagauuuguaaaucauccaguugucccaauaguuuucuucaauuuggguuggggcuggggggaaaagauacaaucuagaauagaaaagucuuucaguauuuccaacucuaaagcagagaaaaaagaaguuuacaaaauaaacuucuuaaaagguuguaaagacaaaugaaacagaaacagagguuagaccuggcaaguugaugaguaggucauuuuacauuugaugaauauuucaucaugacuacuugauagcuuuccuccuuuuacuugaauaccgaucaauuacaaaaccuaauuuuauaauuucuugaauauaucuacauuuuuauuacaacuagaaauacuuaaaauacuuuaauauuaaaaaauauuuuaaauaaacucaugacaaaauaauacaguaaauaaaccuuagagaauauuaacaauaaaagauaaagauuacauucuuaacucugaaauaugcaagacuauauagcuggacucuauuuuaagucaugauuacuuaaugggaauuugagcuauguguuaauuucauaacagaaaccccaaaacauugcaagugcuucuuugucagacccaucaaagccccuguaaaauguacaaaugaaaaaaaaaaaaaaaacuacuugacuugacuugaagccagaaaaagcaagccuguauuuaaugaauauuucuuccuuccccacccgccccuccccggaaaccaaauaucacucuacauuucaccuguagucuaguuuuagagcauucuuaagucucucuuaaaagucucaagugacucucuuaaaagucacugggugggcccaguagcucaugccuguaaucccagcacuuugagaggccaaggcaagagaaucacaggaguucaagaacagccugggaaacaugaugaaacccugucucuacaagaaauagaaaaauuagguggacgugguggcuugcgccuguguucccagcuauuugagaggcugaggugggaggaucaccugagccugggagguggagguugcagugagcagugaucguaccacugcacuccagccugggugacagagggagacugucucaaaaaaaaaaaaaaaaaaaaaauuuucaagcaaacugauagaaguaauuugaaugaaaugucugccccaaugauaauguuuuucauuucuugaaaaucauaaaacuaacaccccaaaugaugucaaauacuuaaaguugaaacaucggauuaccacaaucuacaaugcauuaaaguuucacauaucaacaucaacagcaaauuuuaauccuggacaucucuuauuuaauucuaagagguacuaaaaagcucuaucaaauauauguuaaaggccaaaugcauacauaagcuaaaaaucccagaauggugcuuuuaaaacuagugcucuugaaagaaaauuauacaucaugacuggaucuacucugggaucuuucuacucugggaugcuuucauuuagaagguuaucuccauugcaggcaaauuuuugccuaaugugaaucguagugcucuuuuccuuuaaugucaaagccugugucuuauauuuuaguacucacagguuugccauuucaucauccuuguaugauuuggucaaaauauauauuuuugggucaagcacaguggcucaugccugcaaucccagaacuuugggaggccaaggcaggaggaucacuugaagccaggcgcuugagucagccugagcaacaaagcaagaccucaucuccaaaaaaaauuaaaauaagggugggugcagcagcuccugccuguaaccuugggaggcugaggcaggcagaucacuugagcucaggaguucgagaccagacuuagcaauauggcaagacccuguaucuacaaaaauacaaaaaauuagccaggcgugguggugcgugucuaugaucccugcuacuugggagguugaggugggaggauugcuugaucccuggagguugaggcugcaguaagccaacacugcaccacugcacuccagccuggggcagaaugagacuccgucucaaaaaauaaaauacauacuauauauauuuaaacuauacaguuuuuuaaaauccaaauugugcaauuaaacaaggaaacaacauauucugcuauuaaauuaucccagaaaaaacucugugauuucacuuuaggaucaaaaccaaaaaucauuguuauugaacuacuagacuuuucaauaaauuuccauuucauuaaguacuuauuuauugaaugcuuacuauguauaaggcaccaugcuacauucugugagggcauccaaagaagaauaagacauuucuuaaccuaaaggggcuuauggaacagaagaaaucuuuuuuaacauguaaugauaacagcagaaaucucucuaguacugggcaguguuuucaguauuuuaaacauacauuaacucauuuuauuccuccuaacagcucugugaaauagguaggaaaaugagacucagagagguuaaguaaccagagcaagguggggaauaauaagaggugaacugggaugcgaaugcaggcaguguggcuccagaguccaugcuucuaaccacucugccccacuuacucucaagcacugaugaagguauaacgaaguaauaaugauggcaguuucuuaaagcuacagaaaaaauguauggaguuuccaaaauuagauuacauuccaucaaguagaaauuuaaauauggucccagaagggcaggugaguuucaggggaacaguugaguaggaauucugggaaagagagaugccuaagaaaaagcaagacauugugugaaagcagucuaccuuugcagggucauggauagagcuggaagccauuauccucaccaaacuaaugcaggaacagaaaaccaaaugccgcauguucucgcuuauaagugggagcugaacgaugaugucauaugaacacuucagggguuauaacacacacugggaccuguugagggggcaggggagggacagcaucaggaagaauagcuaauggaugcuggaccuaauaccuaugguugaucugugcagcaaaucaccauggcacauguuuaccuauguaacaaaccuacacauccugcacauguaucccagaacuuaaaaguggaugggaaaaaauaaauaaaaaguauauguaagaagauagcuagaagggaacagggaaaaguguucuaccacuaaagauuucugagcuggguaucgagagaguauggaaaagauggaagugggcuuggacacugggugaccaguaaggugucuccacagauaauuuaaagaggucauacagccuggacuacaguggugauaauggggauagagaggagaagaacaaaaaggcaagacacuacagaaucugagauuucacaaugggaugaauguguacacagugccugcuguguaucuggggacucaggaacaagcaugucagaggcaugagaaaauggagucaaagguccuaggcuuuuagccuggaguacuggaaaauugggacaaucaucaauagaagcuauaaacugaggagagggagcacauauaaauauaaggcagcuaucucagcacagggcaaugggaaagaggcccagguugaagauaaagauuuggagucaauugcagaguuuagacuuuaagaacuacagcaaaugcuucaggaguaaguagacagaaaggaacagaacuaaggagauaaccuuuuauaccuacagguaccuuaugggaggaaggguuaacagccaagaaaggagauaaaagcagcagagguaagaauaacguugcuacaguagcgcaagguucaaaaugaggaaggcucaaaaaggagcgaaaggccaagauuagggaggucugagaaggcgucagaguaauacauuauacugaaggacuaaggaagauguuuucaaacuaaggagauguuuucaaaguuuugcaaagcaaauaucuuacuuuacuuuuuuuuuuuaaugugcaaagacuaauauguauguauugaugcuagcccccuauagcuaacacaggagauggauuuaaaguacacaaaauacuauagaauugcaaccccucagacugaagaagauacugaaaauagaugaagcugcaauauaaacaaaauuuacagcuugcuguaaugucaauuuuauucauuagguaaaguauuucauaugaaaacaaaaccgcauuaagaaaugaaguagaagauucccaagacuucaaagaauuuucacucuugccucaaucccuucaguuuugcuuccccaacuccccauguuugcauucauucucccgaaucuuuggcucuguccucagagugccauauaauucagcaugauaaaugccuaccacaggggaagauauaaggcacuacgacagcacaaagagggauccuuccugagcccuggggaaucacaggcagcuuccuagaggaauuauacaaauucuaacuugcgacagcaguuaagugugggaauaauuuaacuggugucccaagaauaauauaucccagaacucucaagucucauccauacacugaaguuauaauagauuuggagggaauuaaacuuaaaacauguuguuaauaaaauggugcuugcagcuaggagaaacugacaaguguuuugcuuuuuauuucaguacuauaaaugaccagacuucccauucuuccuauguaaaauagcaauauuaguaucuucugaauucacucaaucauuuauaauuaaaguucaguuaacuucacagggauguucaaagacagcugacaguaaauguuugagauucacauacauagaaacuauauuuagccagggguuggugagcuugguuaaaguaugauacuaaugaacacaugguuccgauguucauacguucuauaagcuuaacuuuuccauggaguaaacuuggccaguuaucuucaguugugcugcagauggucacaauaugaauuguuuuuuuaaaaaaaggaaacgaaucaguuuaacacugccaccuggauaacauaaaucaugucccaacacaccucccagcuuccacucuuauuccucuauaauccguuucuccauccaacagccaggaugauuuuuuuaaaggcacauuagacuauguugcccaccacccaguuccaguuaaaaaucuuucaacaaagcucuauucacaguauaauaggaaccuaacucuuacagggcccuacagcaucuggccccugcuuaccucugcagcuucaucucacaccacuguccccuugcuccccaugcuccagccacccaagucucccugcuguuccucgagcaaaucaaggcuccuuuccacagcagagccuuuguaccuccuguguccucagccaauacacacagucagacacagcccccgugcucauggguaagaacugaggaaggaaauguccaagcaaaaacaaacuauauaaaaagcacaugaggccccaugugauaagcaugaaguggcagauaagcaacaaucuugacaggacaaaauaacaaguuuagggaaaauuaaaauuaauguuaauaagccauacucauugaaugaagaacucugaauuauuaucaaacaacccaagacccaauauaaagugaaaaucucaacuuuacccagugcgcuuccacacucagacaggccaauaaaauuauuagaaacaaaacaguaccccccccaaaauggugcacuaacacuaacaaugcuacagucaauaccagugaauucugaagccaagauuauuacgcuggaggaguaaucaaaaugaugaagaggguaggacgcuggugaugguugcacaacaaugugaauauacuuaaugccacugaacuguacauuuaagaaguguauaaggcagggcgugguggcucacgccuguaaucccagcacuuugggaggccaaggcaggcagaucacuugaggucaggaguuugagaccagucuggucaacauggugaaaccccgucucuauuaaaaauacaaaaaaugagccggacgugguggcgggcgccuguagucccagcuacucaggaggcugaggcaggagaaucgcuugaacccaggaggcggagguugcagugagccaagaucgugccacugcacuccagccugggcgacagagcgagacuccauccauuauuuuauacacuuaaaaaugguuaagauggugaauuuuauauuauguguauuuuaccagguuuuuuuucaaggaauaggaaaguuucaacagaucuguaagacaauuuuucaccaugaaaaaacauaaaagcuaagaaagauaccuucuaaaucuauuaaauugaagaugcaguaagaauauguaaugguucacuaacagaaaaaagagacaguugaaagaaauauauuuuuaacauguuuagcuucacuaauaaacuuacauuauuaaaacaagauauuauuuucaccugucaaacuagaaaauaagcaaaaaaaaaaaaaaaaaaaaagcuaaaaaaaaaaaauaaccugggcaaggaaaaugaguucucauguacuuugcuagugaagcuauagucaaggcccuuuggaaaaggaacuugucagcauauauuaggagucuuaaaaauguuuauacuccgcuaggcacgguggcucacaccuguaauccuagcacucugggaggcugaggcggguggaucaccugaggucgggagaucgagaccagccugaccaacauggagaaacccugucuacuaaaaaaaaaaaaaaaauacaaaauuagccgggcgugguggcgcaugccuauaaucccagcuacucaggaggcugaggcaggagaaucacuugaaccugcgaggcggggguugcagugaaccaagauugcgccagugcacuccagcaggagcaacaagagugaaacuccgucucaaaaaaaaaacaaaaaauguucauacucuucggcccugcaauugcacuucugugaauuaacucuaacgaaauaauccuaagugucuaaaaagauuaaugcacaaauaugaauguucuucacagcacuauuuauaaauauaguagaaaaugaaaugaacaucaggcaauaagaauaaagcucugguacagccauauguuuuguuuuguuuuguuuuguuuggagacaaguucucucuguugcccaggcuggagugaaguggcaugaucucggcucacuacaaccuccaccucccagguucaagggauucuccugccucagccuccugaguagcuggaacuacaggaaugcaccaccacacccagcuaauuuuuguauauuuuuugguacagacaggguuuccccauguugaccaggcuggucucaaacuccugaccucaggugaucugcccaauucagccucccaagugcuggaauuacaggcacgagccaucauguccagcccagccauauguuuuuuauaagaaacucacaauguuucugaagaacucgugguaauuugugaaaaaauuaugaaaaauuguauauaccaaguauaauuucaaacauuuucaggccaauguggugguuuacaccugcaaucccagcguucugggaggcagaggugggaggaucacuuaagcccagggagaccauccugggcaacacggcaaaacccuaucucuacaaaaaaauacaaaauauuagccgggcaugguggugcgcaccuguaaucccagcuacucaggaggcugagaggcuggaggauugcuugagcccgggagguugcagcugcagugaccaugaucacaccacuacacuucagacugggcaacagagugagaaccuguuucaaaaaaaaaccaaaaaaaauuuucaaacaacauaaacaaaaaccuuugccuguaauucuucugcuuuucuauagcugagcucaugucacaguaauagugggaaaggaagaaguuuacuucuaacuuauauuugggaaaagaaagcuaugaacgucauaaaacauccacccagcugucuaucaucucaauuaaguuguugguacucuaagaucaggagccaaguuuuauuuaucgcuaacaucuggcauauaacuaauugacauauaguaauuguucaauaugacaauccaaaaacaccuauccaucuaaaugacagcuuucugaauaaaaagaaauacacacacacacacacacacacacacacacacuuuuuuguuguuguuaaacaaucaggaaucagacaaccaagccaaaaaaccugggaaucucugaaguagaauuuaugauuuuuuuuaaaugcugccaccaaugaaugcuuuuuaaaacaaucuuuagaggaaguaguagaaauggauucaugaagguaaguuuuaauucagacacugaaggagggccugauuauauuugguuaagugaagagcuuggagagcaauuuagauaaacaggagcuacccaagcaaagggcagaauuaggaucuuccauccccuuuaaaugccaaugcucccaaaaguuguaccuucaaccuucugcuuuucucauucucauucuacacacauuuucagggcaaucgcauuuauucucacagcuuuaauuaucacuuaagaugacagcucccaccaucaacaucuucauuucagaauuguaucccaaucuucaaacucaaauuugaacgcccacuggccaucucuacuuggauauuuauuucuuuuuuuguuuguuuguuuucuuuuuuuguuuguuuuugagacggagucuugcucuuucgcccaggccggagugcaauggcgcuaucuuggcucacugcaagcuccgccucccagguucacgccauucuccugccucagccucccgaguagcugggacuacaggcgcccaucaccgcgcccggcuaauuuuuuguauuuuuaguagagacgggguuucaccguguuagccaggauggucucgaucuccugaccucgugauccgcccgccucggccucccaaagugcugggauuacaggugugagccaccgcgcccagccuuggauauuuauuucaaacucaacaugccuuaagcuuaguguuuccucuguaaaccuguuucuccuauauucccuauuacugugaaacagaaccacuucccaccuggaaaaucagauuaucuucaucccuuucucuacaucuacaucuauaaauuaacaagacuuaggaauuccuuaguaaaagcaaucuuuuuuguuuuguuuuuugagauggagucuugcucugucaccagugcagcgacgcgaucucaacucacugcaaccucugccucccagguucaagcaauucuccugccucagccucccaaguagcugggacuacaggcgugcgccaucacgcccagcuaauuauuguauuuuuaguagagacaggguuucaccauguuggccaggauggucucgaucucuugaccuugugaucugccugccucggccucccaaagugcugggauuacaggcgugagccacugcgccuggccucuucauucuuaucucuaaagccuguguccuaauucaggaucagguuagcuccuuccuaaauccugaaauugcuuccuaguugacuuucucaccuccaguccuaacuuucaccaauucuuuucagaaaucagcuuaaaugucacauccucaggaaggucuugcccauucucuaggucagguuggauuuaacugcaauugaucucacaguacuccucuacuuccccuaacacuaaaaaauguccuuguaaugguugucuuuauccuauuaagugagcuucugcaugagagaagggauugucucucugauaccauuuugcuuuacugcaucuaggaguucauuaaaaucacuuauaugugaucuaacaugugacuaauaauugccucaugcuuuauaucucaaacaugaacauacuuuuccaaacauauauaaauguuuuuggugaucaauacuauaccaauuuaaaucacugcuagaaaugauagguuuuugucauguauuuucaaaagucacaauacacaaaacacauaaccugugacuuuuuuugauaacagaaauaggucuucauacuugaaaauguggagauaacuagauugggaagaaaauggccuaacaaaauagagugaaauauuuagcaauagaaaacacuccagaaauaaagugaauuggcuaggacagagauccacuuauaaacccuggcuauguuuuuucauucagauucagaguuuguguaaaccacuggaaacccuaacaacaggagacauauccaacuacagucaccauaagcaguaucaaccagggcaaugcugaaccgcaguagagaaucuuuucucuucuaacuucuuuuaacuuuguucucagcuaauuaaggccuucgggaaaagagaauucagaugacaaguuacuucaguaagcacaaauaaccucagacaccaauuaaaaacaguuuuaauagauaaaccuugaggauaacccacaccaaacucaaaccauguaguagaaaaguugcuaaaaguuccuuucaacuugcagguauagacaacuaaaguuuuggcaacucaacuaacaaggaaacugagaauagaaaauguuaccuuuucuauuacucauuuauucuaucacccuuauaugcaaauuugaaggacauuccaauuaaaacucauucugaauaugaucugaugaucuggagaaaauaugaauuauucauuaaguguuauuagaacaacuagaagccaucugcaaaaaaauacaauugaauccacucagugcaccaaaaucaauuucaaaggaguuaagauuuauguaggaaaaaaaaagaaucaauaaaguaaauguaaaauaauuccuuuaucgccuugaaguaaacaagaucuucccuacucaaaauucuagucauaaaaggaaacuuugaugaauuugacuacauaaaaaaaaccuaugcaugccccccacaucacacacacacaaaaaaaccaccaugaacaagaucaaaagauaaauaucaaacugggaaaaacguuuacuacucauaucacugacaaagggcuaauccaaaacacacacauacacacacacacgaugauacaaacugacaguauacggaaacacaaauauuuauaaaaagaaguuuaggccagguaccgugacucacaccuguaaucccaacacuuugggaggccaaagggggcagaacacuugaggucaggaguucaagacucgccuggccaacaaggugaaaccacgucucuacaaaaaauauaaaaauuagcuggacauggugguaugcaccuguaauuccagcuacucaggaggcugacgcaggagaauugcuuguacccaggagacggagguugcagugagccgagaucgcaccaaugcacuccagccuaggugacagaacaagauccugucucaaagaaaaaaauaaauaaauaaaagaaguuuaaagucauuuauuaaaaacaugcaaauuaaaauuacucugagauacaguauuaaccuaauagauaagcaaaaauccagauguuuaauggcauacucuaaugauaaggcagcaggaaaagaggcauucucauccauugcuagugggaggguaaucuggugcaacuccuauagagggcaauuugacaauagucaucaaaauuauaaaaucauacccuuugucccagcaauucuacuucugggaauuuaacuuaugaauauauauaugcagauagacaggaacgacaccuguacaaaguuacucacuacaguauuauauuuaguagcaaaagauaauaaacuaucuaaaauaagcauugauuagagauugguuaaguaaaaugugguauauccaugagacacaauccucuacaacuauuuuuuuuuuaaaaagaauaagguagucaucuauuuacuauauggaaagauggccaagaaauauuaagugaaaaaaaagcaaagagcagaacagcauauauaguguacaaguuuuguguaaaauuuuaagugaaaaaaaucuuuuuuuuuuuuugagacaguucuuucuuucacccaggcuggagugcaguggcacaaucucgguucucugcagccuccaccuucuggguucaagugauucuccuaccucagacucccaaguagcuggaauuacagacaugugccaccauacccggcuaauuuugguauuuuuaauagagacaggguuuugccauguuggccaggcuggccucgaacuccuggccucaagugaucacccaccuuggccucccaaagugcugggauugcaggugugagcuaccaugccuggccuaagugaaaaaaauucuuaauugcaugaauauguauauaucugaaauaacauauaaaaaacuuaauaguggcugccuagggcuaggaaggugagaaguauuuggugaauuuaaaacagguauaagagcaaaacuuugcaauauguaccauuuuacaccuauuacaaauuuucaaaagaaaaaccaccucacuucaaauaagcaguagaacuucacagagggagaaauaaggauauuaauauaaacaaaauccacacuucuaguauacuauuuucaagaguaggcaaacuuuucauguuuucuaauacuuuuugaaaugaacagcugaaauagaaagugggguugauuuuaauaaaaacauauccaauucccaaaaagugguuucaaguguuuuagcuauuaguaguaugcaguauccccggaauaauacauuacuugaccugcagaacuuuagcaccuaugcuacuaaaaaaaaaguucucuuguugaacaucauuaguuuacuugagacuuugggggcacuagaaauugacgcugaauggugagaaagcaccucccuuuaccagcuccccucuaccacagguuaccucccucuaauucugaagaaccugcuuuuuaaaaacaaauucucuuaauagucuuuuuaaaaucucuuaauaaauaaaaguuccugaagacuugaaaucaagcucccaaaggggacuucggcauaaaggcuuauggaaacuagccacaugguggccaucagacagaaaagaaacccaggacaccccaacacaucaaagacacccaggccauuuucaaagcacaccagugacugcauuauaccaguaaagaaauauucuuuuuauggggggaaaaaaaagcaaacuaauauuacaagugaauacucacuugaucuaccuuuguuaaaauuagcaaaauguauaaagagacauuuuuuaaaguaccccaucaagaauccauuaagcagaagaaaugaggcugaggcacuuaguuuucuucccucaaaggcaggauuuuuaaaaguuaaauuuucccucuguaauucccuucauuucuccuccuauuucuggaaacagcaacacuacuaacaacagaagcuuaucaaagcagaaaacauuucagcaaaagcagaucaauuaccuauaagauggaggaagaaagggauagcagucucuuccuaaguccugcccaguuagucaccccgccuucuuccugccaccugcugaucucagcucuacaccagggcaacaauccuaaaaaagcaaccuggaaguacagcugccugauccaucauguucccuuccuggucugagaucaaugaaagguuuacacagagauauacacguguguguuuguguguauacacauguauaccuguauauaaaaauuugaucuagauuauauguguguauaugcauuuuaaaggaaauaauggaaacggaccuauuuuucaaaccucucuauucauccuguacuacaaccuauuuuacaaacuaauauuuauuuuuguacacaaugugcucuuauguaugaccauuacuucuaaaacagagagcaauaguaaccaucguuaccguaaaaacaaaaacaaaacacacacacacacacacacacacacaaauguacuccuuccucacaaaaauuggguaaagauuagaaaaaauaaacaguaagcauaaauuagaaaauuucccacaagaaauuaucuacaauuggcaagacauaucaauaacaacagaauuguuaaauuuucaaacugaaaaugugcaggauuacuauccauugaucaaucaaaaccugagcauuuugaaguauuuuccgggccaggugcgguggcuugcgccuauaaucccagcacuuugggagacugagguggguggaucacuggaggucaggaguucaagaccagccuggccaacauggugaaacccuguuucuaucaaaagaaaaaaaaaaaaaguuuaaguauuuuccagcuuaauacuauauauauauacauauauacguauauauguguguguguauauauauauauacacauauauauacauauauauacacacauauauauguguguguguguguguguauauauauauauauauauauauauauauuuuuuuuuuuuuuuuuuuuuuaacaaggucucacugagccgaggcugagugcauuggcaggaucacagcucacugcagacacggaccucccaggcucaagcaauccucucaccuuagccuccagaguagcuggggcuauagacgugcaccaccacgcccagcuaacuuuuuuuuuuuuuguagagacaggucucuauguuguccaggcuggucucaaacuccuggacucaagugauccuccagcguuggccuccaaguguugggauuacagaagugagccaccaccccuagccccuuauuuucuuuaaaugacuaggaauuaaaucucaaagauaugucagcauguucaaaauaauuuugaugaaaaaagaaguuaaacaucucagaagugcuaugcugcugcaaaauagagguaaacaaacgacagucacaaaagguauuucuaauuaggcaaacugugucaucccucaaaaaagggaaaaauuaaaaacagguuguuuauuucauucaguucuaauuauaguaucuagcuagcaaaguaucaugaaugcaguauuacuuucaucaaauuuugguuuaauauuuaucuaagauuguacaauuauuuuauucaauaaaaguucaaagauguuggaaaugaaaaacaaaugugggaauuaaggugauggaaaacccuauuaaggcuggaauuuaauuaacaugcaaauuauuuuaauuuuaaaggccuaugagagaaaaaaauuuuaaaccauacucuaaaccaguaacuuccaacacaggugugagaaacaaucuacuuggugcugaauuaaaauauuauccaaauuacugguuuuuuaucuuaaaaggaaagacauugcgcuuugauuguauuuaauaggcaaacugacacugguacacuuacuuaguccaucccuuaaucagauggucucccaucaacucccaguguucaaguugagguuuuuaaaauucaggcuaucacuaaauaucccuucccagagaugaucacaagucaaaaucaccugagaguucugaaaguggucaaaccuucuauacuuauauccaaauuaauuaaaacuaucuugaaacuuuauuuucaauguuagaaacacaauguaauuuuucaguuuugaaaggccugaaacaguggauuuagugccaauuauuuucuuaagguguuagaaucuagaaccggucuaaauuuuuuuucuucaauagcauuuauuuuaccauuauagaaaagcaaggggcugggagaggauguuauaguuuaaguuaguucagcuuuuacagaaaaugauuucaacaauaucauugugaucuuaucuuucauugauucaaagcaguauguuuuacaucuaucauguuagguuucuucuuucacugauuacuuuccuucccuuuuuuucauaguaaaugaaaaauaaggcugacaucuuaaaauucaauguaugaaggguauaagccaauuagcuaugcuaauaagcaauggcaaaugguaagcaaaaguaaacaagauccuggucucucacaggauuuuagcuacagggagaaauggcacgcaaaaauguaaaaccaggaguauacaaaauggaguauacauggcacaaugacagcaaacagaaugaucucaccuauucaagaacaucacaagagacgucccugaaguaaguaaaugggcaaaagagacagccaaaaaguggucaaagguaagacuggaaagguaaauggcgacucucagguuuucaaaaauuauagcaagaauuuuugucucuacccuacccaugaaucccaaaauuaauuggaagccaauauaauguuuuaauuaaaggaauaacaucacuccagccaaauucuggagaaugaauuucauuagcauaagguuauauacaaggagaccaauuagaacucuugcauccaaguuaggaaaucauggauugagacaagguaaugacaacaggauauauggcugagauauuucagcccuccagcccguaaaaaaaccaacaggacuagaugauggauuaugguguaaggacuacagauauacugaaauacgacacccagguuuccagcauacauaacugaacacaugugggugacagucacuaagaugagaucucccaaaagaaaaccagauuugaaggcgaagaucauaaauucauaaagcauguuugaagugcuccugggacacccaaaaagagaagucaaauagguagaucuaugaaguugaucaguguuauaaacacgagucaucugugugaagguauucaaucugugguauugguagaaaugcccagagaauugacacaugauaaccaaggacccugccuaagaaacucccauauauaaaguccagguagagugagaaugagucugcgaaucagacuaaaaacuggccagaaagacaggaaaucagaggacuaaagauuaauagcacccaaagugugaagagagaauguagucuacuguuucaaaugcugcugaggguacacauaugacuagauacaaagcuguccacuugaucuacuaauaaccucaauaguauuauuucagugagguuaucagagguggaagcaagauucaagugggcugaguaggggaggaauggagagauuacagaguuuuuaaguuuggguaugcagaggaagcauggggaaguagcuagauauaaaucaaugaaaguuuuagacaaacuuuaacaugcuucuaugcauaagagaaggaucuaguugaaaggaaaaaguuaaauaugagaaagaaguaauuuuuuaaaaaucuuaagaucucagauagcagaggugauaagauauagagcauaggugaagcugaaggaagggguguugaacaugucagauuuauguuugguaucagaaugaaggauaucccaucugaugguuucuaauuucucuguaagguugaaaugaaguauccacugaaaaagcugcauauuacucaacguaaguguacuagaauguaauaaaauuuuggcuaaaugagaagcccuuuauguaguaacagagacuacuuucacauuuauugcagggucuggcacauaguaaaugcuuuacauauauuagccaauguauuccucaaaaccaucccaggagguagguguguuuauuagucccuuugcagaugaggaaacugagacaugcaguuuaaaugacuugcccaaggugaguggcagugcuggauauucaaauccaaacacugacccuagagagcaaaagcucagugcgcuaaaagaccucuuauugggcuuaagacugccccuagagcacccauauugucaauacagauggaugguuucuuaagacaauugagaaccuaagucugggacuucuaggacgcuaaccccccacuaucaaauaauaaaagauacaaacuuacuuuuagcuaagaaaccuaggcaauuccauugugaugaugucaaacacagugaaagcuuucagucaugcuaugggauuuaauuguguauccucauuacuguaucauuugugggguacaccccuucccccuuuuuuuuaaauuaaauacagcucauucuuacuguggcuuguagcauuccccucuucuggccuccuggacuccuccccuucaucucucuuacccuugcccccuccacccggucuugauagugguauauuaaaaaaagaaagaaugaaagcacauaaaaugagucaguuuggggucagugguauaaaggggguauauguugugaacaaauguuuuaauaacaguuggcuguaaucacuccucgccaugucuggcacugaaaauaagggaaaaaaaaccuacugaauaaaagugacaaagaauggaaaaaaaaaaaaaaagaaaccuaggcaauaagacuucauaaauugacagcuauaaaguucacacacuugaggaagaauccgaaagauuuuucuuucuuaaccuuucauuacuuguuuuccaaaacuacaacuuucuaacagcacuaaaauggcacuauaauuuaccuacauacauauggaucuuccucacuaaauuugggcaucucaaaggcugccuaugucuucuuccuuaaaauauuuguuuggcgccuacuguguagcagcugcuaaaaaaaacaauagcaaacaagacagacgugaucccuggucucaggaagucagacaauaaauagaccaacaauauaugcuuuuaaauugggcaaaauaguaguaaagaauugauguaauguuagagaguaaaagucaaggaagagaacuaaauguuuagauauaaugacuagaaaaggcaucccugaagaggaaacauuuaagcugagacuuaaaaggggcauuccagucauuaggaauccccuaagguaguagacaguaacacauucagagacuaaaugagccaaagguggcuggagaggaagaaugaggguaaaguuggaagaaaagguagggccugaucauuuagggucucacaggccaugauaaagaauuuggauuuuguuguuuguauaaaggaaagcaauuagauauuaaacagaaaaggcauuuuauuuaugccuuuaaaaucacaaaucauauucugugaauaaaacagggaucaacagauaaggcaagaccaguaaggacuacugcaauaauuaggcaagagaggaugguggcuugaagagauugaaaauggagauggugagaaguggacagguuugacaaagauuuaagagguaaaucugaucuuuggcaaaaguacaaagacaauucaguggagaaggaagagucuucauggugcuggacaaccacaugcaaaaggaaaaauaaucuauccaacacugaccuuuuaucuuucacaaaaguuaacucagaaaguaucacagaccuauacauacaauucaaaacuguaaaacuuguagauaaugaggaagaaaaucuuguuuggcaauauauuuguaaacacagcacgaaaaucaugacccauaaagaaaaaauugauaagguagacuucauuaaaauugaaaauuuuucuucucuguaaaacacuguuuaaaaaaaaugaaaagacaagccacagacuaggagaaaauauuugucaaacacaucuuauaaaggacugguaucuaaaauauaccaagaacucuuaacacacaauaaagaaaaaaucuuaaaaaagagcaaaaaaucugagcagauguaucaccaaagauaauagagaaaaaaaaaaaacaugaaauggagcucaacacccuauaucacuagagaaaugcuaauuaaaacaauggauacuaccacaccccuauuagacaggcuacaaucacugacaacaccaaaugcugcuaagaaugcagagcaaaugaauucauauucauugcugguggaaaugcaaaaacaguacagucgaguugagacagucugcagucucuuacagagcuaagcacaggcuuacuacaugacucagcaauugcacacacagguauuuucccaaaugaguugaaaacaaguccacauaaaaaccugcacaggaauguuugcggcagcuuuauucagaacugccaaaaacaucaagcaaccaagcuguccuucauuagaugauggauaaacaaacugugguagauauauacaauaauaagaaaugagcucccaagucacaaaaagacaugaaaaaaacuuucauauugcuaagugaaagccagucugaaaaagcuacacacugcaugacuccaacacuaugacauuccaggaaaggcaaaacuagacagauaguaagaucuguggcugccagagccugagguggggagguaggaguauguggcacgcagagaagaaggauuuugcaacagggaggacccugaugacagagcauucacagugguaucagaagcgacaaccagaauggaauagauugaaaaguaaacuaaauuugagagauuguaacaauauaaguagacaacucuugauaaugaaagugaacagagauugcagaaguuaggggguguggaaagacccaagguggcuuccuuaagaugauguaugaaagcauaauuagauacucaugagaaugagcuaauagagaaaaacauuugcuaauagaaggaaagauaaaauacaaaaggcaacaaaucuuuagcaaaauauaagagauagacccauccucuagagaacaaugagaaaaagccuuugaaaaaagaaguauggggauagaagcaucuuaauauuuccagugcaugaaauacuauacauaauaaaagaugcaugaaacuuaguagauccucaauagagauuaaaugaaucaaauuaaauaacuguaaugguuuaaaaagcuccuaguagaacagccuacuucuaagucgugggacucaaacuaaauugaaggcaaauucagacacugaaaaauucauacuacuuccaguuuugaguucaacuagugaagcugucacuccuguccacacaacagaaaaaaaaaaaaacugaacuggaaaucaguagcuucucuuagauccaucagagaaccgagaucacaggacaaucugcugccuccuccaaaacuaaagaaacaagcaaauacagaaaaucacagcuuaccagaagcagcaacuauugcugaagccaacaacuggaagaaaaacuuaaauagauuaauuaagacagucuaaauauggacuaguuugacagauggaaacuccuggcaaaccagccuuaaggggcuccccacacuuccaugauuuuuuuuguuuguuuguuugagauggaguuucacucuugucacccaggcuagagugcaauggcgcgaucuuggcucacugcaaccuccgcuucccggauucaagcaauucuccugccucagccuccugaguauuaacagcacccgccaugcccagcuaauuuuuguauuauuuuagaagagaugagguuucaccauguuggcuaggcuggucucaaaccccugacuucaaguaauccaucugccuaggccucccaagugcugggauuacaggcgugagccaccgugcccagcuacuuccaugauuuuuaacuccaaaagccccaucagguugucaggguaaagaaaagagaaaaaaaucccugugcuucuggaaggagaaaggaaaaaaggaaaaaguaaccauauucaaauauucccagaacauucuguuauccuuaacaaaggacugaccuuaaggaaaauuauuuuaccagaggcuaaccaacagcggguauaucaaagccugaccaaguggaauaaggaaaauauccaacuaggguucucucucuagcuuucuuguuccaccuaagggggguaaaaaagcugagaagcauuuguaaaggugaaagcccaggggcacugucccacaaaaaaccugagccuaaucacaggacuacauacagacuauucuccccgcuccacaacacucaucuuacuacaaucaacagagcuccuguaaaacaggaaaucacaacugaaagaaugguaaggcucaggcucuauuuaaaaaggagucucaugccuguaaucacagcacuuugggaaaccgaggcaggaggaucacuugagcccaggaauucaagaccagccuagcaacacagugagcccccaccucuacaaaaaucaaaagauaaauuagccaagcauggaggcgcaugccuguaguaccaucuucucaagagccugaggcaggaggaucccuugaacccaggaguugaaggcugcaguaagccaugaucgugccacugcacucuagccuggguaacacagcaagacccugucucuaaaaaaguaaaaauaaaagggagucucuagggaaacccaaauaccacagaguagacaagaucaaggacacuauaggaaauucuagccucugacaucaacagcaaauaaacacagauuaaccccuagccagauaaacaugaaacuucauacucaaguccuacugaucuuaguuccuuuuacccaauacaucauaucuagcuuuuaacaaaaaaaaaaaaaaaaaaaaaauagccaggcucagugguucacaccuguaaucccagcauuuugggaggcuaaggugagcggacugccuugaucucaggaguuugaaccuagucuggacaacauggcaaaaacccaucucuacaaaaauagaaaaauuagccagguguugguggcuugcgccugcagucccagcuccucacgaggcugaggcuggagaaucucuugagaccgggaaguggagguugcaguuagccaagacugugccacuguacuccagccuggauaacagagugagacccugucucaaaaacaaacaaacaaacaaacaaaaaacaccauuagacaugcuaaaagguuaggaaaaauaaaacagucugaggauccaaagcaagugucagaaucagauucagauauggcagauauuuugcaauuauuaggccaacaauugcaaauaacuacuaacaugcuaagggcucuaguggaaaaaguagagaacauguuaagaauugauggguaauauaagcaaagagaugaaaauucugagaaucaaaaggaaaugccagaaauaaaaaaaaacagcaacagaaaaaaagaaugcauauuaccagaucaucugcacauggccuaagaaucagugagcucaaagauacgucaauaaaaacuuccaaaacugaaaagcaaagaaaaaaaaaaggaauagaauauccuaagacuguaggacaauuuaaaaagguaaaauguaugcauaauaggaauccaagacagaaaagaaagagagaaggaaacagaauacagaugcuccuccacuuaagucccaguaaguccauccugagugaaaauacugucagucaaaaaggcauagcugacuggaagcugaggcuugcugcugcccagcauagcaagagaaguaugguuucuacugaaugcauauugcuuuugcaccauuguaaagcugaaaaaucauuaaaauaguaaucgaagaaaaaauggcugaaaacuuuccaacauuuaugacagacaccaaaucacagaggcagaaaguuuggagaacaugacauaagauaaauaccaaaaaucuacacuuaggcaugucauauucaaucugcagaaaaucaaagacaacaaaaagauacuuaaagaagccacagaugguaguuaagagaaaccuuaccuauugaggaacaaggauaagaauuacaucagacauuucuucaggaaccaugcaagcaagaagauugaaguuaaauauuuagugcugaaagaaaaaacuagcaaccuacaauucugcauacagcaaaauucuugaaaaguauaagagaaaaaaagacuuucucagauaaaaauagagaauuugucacuacuagaccugucuugaaaaaaauguuaaaaguucuucugaaagaaggaaaauauagguuaccgaucugcacaaaggaaaagcauuaaagaauaaaagauaaaaacaaaacguuuauuuuaaaaauucuuaacugaucuaacacauaaauuuguucaaaauaaugacaucaacaauauauugaauaauuauaauuuauggaaaagcaaaauaaaaaacagcaguguuauaaaaaaugggagaaauaauugguaaugcuauguuauaagguaccagcacugcccauaaaacaguuuuaauguuaauugaagguggauucguuguaaauguacacugccaacucuagggcaacuaaaacaaaaauuuuuuaaguauaauugauaugcuaugaacagacagaaaauggaauuauuuaaaauguucaacuaauaacagagaaggcagaaaaagaguggaaggcaaaauaaauuuuuuaaaaaagaacaagagcaaugaacagaaaagcugcaaaccuagaccagauaacuaauccaacuaaaucaauaaucauuuuaaaugugaacagcuuaaauacaccaauuaaaacacagagacuuucaaaguggauuuaaaacaacaagauccgacuguacacuauauguuggcuacaagaaacccauuuuaaauauaaaaacacauagagguuaaaaguaaaaggauagggacagauaugcuaugcuaacacuaaucaaaacaaagugggaauaacugcauuaaucucaaagcagaccucagaacagggaaaguuaucaaagacaaagggcauuucauuaugauaaaggggccaauacuccaagaagacauaaccauucuuaauauguaugugccuagcaauagagcaucaaaauaugagacaaaaacugauagaaauguaaggaggacuagucaaauccacuaucauaguuaaagacuuaaacaccccucaaucaggaauugacagauccagaaggcagaaaaucgguaaggacauaauugaacuaaacagcaccaucaaucaacaggaucuaauugacaucuauaggcuacuucauccaacaacaaacagaauacacauucuucucaagcucacauaaauguucaccaaaacagaccacauucugggcaauaaaaacauaaaacaaauguaaaagaauacaaaccaagcuuucagcccacaauggaauuaaacuaaaaaucaauaacacauaccaaauauuuacagauaguugcaaacccacaaaauacuuagaaauuuaaaaauacacuucuaaauauaacaucggucaaagaagccucaauuuuuuuaauuguuucaaacuaaaugaaaauaaaaauaguuuaucaaaauuuuuggaaugcagcagaaacagugcuagagggaaauuuauaacacugaaagcauauaaaagaagacugaaaaccaauaaucuaggaaaacugaaacagaagagcaauauaaaucuaaagcaaacagaaaaagaaaucagaucagaaaucaaugaaacugaaaacauguuaauacagaaaaaucaacaaaaccaaaaucuaguucuuugaucaauaaaacugauaaacuuagggccaggcuagccaauaaaagacaccaaaaaauaauaccacaaaucaaaaagcaugacuacugaucccauggguauuaaaagaauaacaaguguuaugagcaguucugucuccacaaauuuguuaaguuagaugaaaugggcaaauuccuugaauaaucuaucaaaauucacaugggaaaaaacagauaaacugaauaggcccauaucuauuaaagaaauugaaucaaucauuaauaaccuucccauguagaguucuaccagguaucucaugauaugauaccaauucucuauaaucucuuuagaaagcagaaacaguaaacaauuccuagcucauucugugaggccuuuguaacagaacuagaaaaagauaauacuagaaaggcaaauuacagacuaaucucucauuaauauugaugcaaaaauccuugacaaaauacaaaucaaauccaacaauguauaaaaaaaauucuacaccaugaccaagugagauuuuuccauauauacgaggcugguuugacauucaaaagucaaucuauaaaaucuacuacaucaauaggcuaaagaaaaaucaugugauccuaucaauaaaugcagaaaaagcacaugacaaaaauccaacauccauucauaaaaacucugggcaaacuaggaagagagggaaacucccucaaccugauaaagaguaucaacaaaaaaaaaccuacagugaacaucucacuuacuguugagaaaugucuuucuuguuggugaagaaggaugcuuuccccuaauauugggaacaagacaaggaugucuccucucaccaccccaauucaacauuauacugggaaguccuagcuagugcaauaagcaaacagaaugaaagguaugcagauugaaaaggaacaaauaaaacuuguuugcagaugauaugauuguguauguugaaaaccgcaaggaaucaaggaaaagauuccugcaacuaacaccuauagcaagguugaagaauauaagguuaguacacaagucaauugcuuucccauacaccagcaaugaacaauuggaauuggaaauuaaaacaccauuuacauuaacaccaagaaauuaaacacuuugguauaaaucuaacaaaauaggaucucauauaaggucuauauaaggaaaaagcuaaaaaaugcuaaucaaaaaucaaagaucugaaaaaauggagagauauuccauguuuauagauaggaauacucaauaaugcuaagaugucaauucuucccaacuugaucuuuagauucagugcaaucccagucaaaauccuggcaugguggauacaggcaaacugauuugaaagucuauguggaaaagcaaaagguccaaaauggccaacacgauaccgaagaaccaagucagaggauuuacacucuccagacuucaagacuuaguaaaaagcuucaguauucaacacaguaugauauuggcaaagaaaagaucaguggaauggaauaaagagcccagauguagaaccacauauagucaacagaccuuugaaaagagagcaaaggcaauucauggagaaagaacagucuucaacaaauggugcuggaacaacuggacaucauaugucccucauccccccaaaaaucaauguaaacacaaaccuuaccccuuucacaaaaacugagaccaagucauagaucuaaauguaaaucacaaaacuuaaaaaaaaaucuguaggauauaaaacaggggaaaaucuagguggccuuaaauuuuuagauacaccaccaaaaucaugacccaguaaaggcagacuuuauuaaaauuucuuugcaaaagacaauauuaagagaacgagaagacaagccacagauugggauaaaacauuuaccaaacacccgauaaaaagcugguauccaaaauauaucaagaacucuuaaaacucaaaaaaaaaaaacaaaccugauuuuuaaaauggguaaauaauuuaagcagacacucagcagauugaguggaaaguguaugagaagauguucaacaucauauaucauuagggaauugcaaauuaaaacaaugagauaccacuacacaccuauuagaguagcuacaaccaaaugauaacaucaaaugcuggugagaauguggagcaacagaaaucacauucauugcugaugggaaugcaaaaugguaaagucacuuuagaagacaguuuggcaguuucuguacugcaaagcuaagcacugacuuaccauaugauccagccaucacacaaauaagggaacaaaggacauuucuaggucaaacuauucuguaugauacuaauggugaauacgugacauguauuugacagaaccuauagaacugcacgacagaaagcaugaaccccaauguaaacuauagacuuuaauuaauaauugaucaauacugguucaucaauuauaacaaauauaacacacuaacacaagaugguaacaggaaacugugggagggaggaggagguaaaugggaacucucuacacuuacuggucaacuauuccauaaauguaaaacugcucuuuuuuaaaagucuauuaaaaauacuaaaauaacccuuuaauucagacacugagguucuauaugaaauucugagaauaugcaaaugcauuaucaaugguguaauagaucaacagaucugccuuggaaugccaucuucauugcuuacagauuauauguccuuggccaggucuuguaaacucugagcuucaacauuuuuauguguaaaaugaaaaaauuaucaccuuucucacagguuaacucaauuaaauuagguaaauauaccugaagcaucuagcaaagguacacuuaguagguauguaaauguuuguucuuauuuucccccaaauucuuucuaaaucaggcaagacaggauauauccuaacucaaccaguguuucucaaauugggguaucuauacccuuagauguacaugcaaccauuaaauaaauaaaacaccucaugucuuccaggaguucaagauuugggggaggaaugauaaauauuuuaaaugguaauuaaaagcacuauuauacuaaaauaauguugcuauagcagaauguuugcacuguauuucaauaugcaacacaagacugugccugaauuagaacuuaggccauauucucaaacuuucaggacuacuucuucaccaucuucugcuauuugauauauguccuacacuuuuccacuaauuuuaauuauguuacuaaacucaaguuuauuuucuucucaauaccagucacauaacaagugucuccaacaagccugguuacccuuaaauuaguaaauacaacccgaaaaauaacauuuuauguuuacacaauuuaauauacaauuuaaagucagaauuaaagcaaacugaaaauaacuuaaauggggacuguacuuuuguauuuaugauuucucaagguuguggcuguaacacugagucaauuucuuuuauaagcugugcaaaauacaaauacuuugcagauacggacuacuagccuaauuuuuagaaacaaaauacuuuuucauaucacuauaauuucuuugccuaggagaaucucaacaugcauaaaaucaagcacuuuacuggauaaauauuuaaggagaaagcgguaugaguauuccaggccaaagguaacauaaggucacguguuauaagcccaggcagagcacaucuguaaugugcugguuuggugucacacacuaacagaagcugcagugcgcucacagaagaucuacaaaaucuuuuuuuuugagacggagucuugcucugucgcccaggcuggagugcaguggcaccaccucggcucacugcaagcuccgccucccagguccucgccauucuccugccucagccucccgaguagcugggacuauaggcgcacgccaccaugcccggcuauuuuuuuaauauuuuuaguacagacgggguuucaccguguuagccaggauggucucgaucuccugaccugugauccgccugccucagccucccgaagugcugggauuacaggcgugagccaccacacccagucgaucuacaaaaucuuuaaggaucucaaaagcaugcuacaugaauaagagguaagaauauggggauacuuaauauguagaagacuugggcuuggaauugaugggaaauuaauagcuaucuugaaggcugucacauuugaaagggaucagacuugcucugucgucucaaacuaggaucaacaagcagcaguaaguaguaaagugguacaucugguagugaagagacuugaguacuacagacaauuuguuuaaaagagugugguauuagaaacguaugugguauuuuuggauaccaauuaucuugcauguaaaauaagggugcuaaacuagagaauucuaaaguaauuuucaaguaaaaauggcaugggagcgggggccaggcauggugguucacuugagggcaugauuagccaggcaugauggccgcugccuguaaucccaauacuuugggaggcugagguggauggaucacuugaggucaggaguucgagaccagccuggccaacauggugaaaccucaucucuacuagaaguacaaaaaauuagcugggcauggugguccgugccuguaaucccagcuacucacgaggcugaggcgagaaccacuugaacccaggaggcagauguugcagugagcugagaucuugccacugcacuccagcuuagguaagaguaagacucuguaucaaauaaaauuaaaaaaaaaaaaaaaggcauggaagcaaauucugaaucaacuucuuagcaaagaguauccuuucccagcacucugggaggcugaggcggguggaucaccugaggucaggaguucaagaccugccuggccaccauggugaagccccaucucuacaaaaauacauaaauuagcugagcaugauggcaggugccuguaaucccagguacucgggaggcugaggugggagaaucacuugaacccaggagguggugguugcagugagcugagguugccccauggcacuccagccugggcaauagagcgagacucuugucuccagaacaaacaaacaaacaaacaaaaauaguauccugaauguacauggaaucagcuaugaaaugccaaguucuaucacaaaggacuuagcaaagguaaugauggcauguugauucacauuaucacuuuuucuacaucaaaagguaagguggaauaaauagcaaauuauuuuaagaaaagccaggccaggagcaguagcccaugcccguaaucucaacauuuuaggagacugaggagggaggaucacuucucagccugggcgacauaaacuccaucucugcaaaaacauacaaaaauuagcuggguaugguggugcauaccuauagucccagcuugagaggcugagguaggaggaucaccugaaccuggggaguucgaggcugcaguaagccaggauugagccacugcacugcagccugagcgacagaguaagacccugucucaaggagaaaaaaaaaaaaaaaagcagacauggcagugcacgccuguagcagaaaaaacugaggcgagaggaucacuuggugaacuauaauggugcuacugcacuccagccuaggugacacugugagaccccgucuuaaaaaaaaaaaaaaaaaaaagccaaaaauguccacuagcaguucuuuuuaaagaacucaaaaacaugaugcaggauuacugcauuuuucgauguuauccuuuauugaguaaauuacacuaguaauuuaauucuagggggaaaaguccuaaucuauuuuccuaucuuguccauauucaauauugcauuuuucuuuguuucuagauaugcuauuauccuaacacaacccuuugaaccuacuuaauauucccuagagaauaauaguauaucacuuucuccugucaauuauuuuauauaccaggcaacaauauuauuucuugauccucaguacaagacuuccgaguuacagugcuaaguaaacauuuacagaauuccuuaauuucucaaaccaaaauaaaaguucuaagucaagcaauuguuuucuaaguucuagauuuuaauacaaacagccaaaaggagauuguacuuuccuuuugcuuugccaaaaucugcaaaaauuuugccaaaaauauuccaggcaauaaucucaugaaauauauacucaacuuaccaaaguacaguauuuuuacagugcucaggcuugagaaauuaaauaugaaucauaaaugcugagagcagggguaggaaaugccuuggaauauuggaggcuacauauacacagaguacaaugucuguggacauguuucuaaaugcacuccaaagccacacaaaaacaaauuugugguuuaucaauuucacuucucugagaguuuuaagaaaaauuauuuuccuaauucuccaucuaucugaaaacccaaggauaccuguuguaguuuacauuauaauccaaacauuaaacauauuuugaauauuuuucuaccuaugccauaccuuaccucuucagcagagaucccuuugaucauaauuccugaaaacuccgaugaauacuucaaaguucacuaacauuuuuaaugcaguaaucuaauuaccuuagauguacauauuaguggaaaaaacacuccagaguaccuaagugcugaauuuugaaacaagucuuucacauuuuaggacuaaauuacuaugaaauauuuuuaaagggaaacaaaaauaccuggauaaaaauaaaguaaaaaaauugcuuaggacaucuaagcacugacauuugucagaguauuucaauauggcaaagaaaauaagaucuguguacauauuuacaauaaccuauaaagucaggacuuugcagucacacugcuugucauguuuuuuuaaacagaagcuacaaaaaacaaacaaacaaacaaacaaaaaaaaccauuuguuuccuuacuaaagaacaaucaaaacagauuuuuauacuauaguuaaccucgucagugauggugaaaccauaagccuauguuccuauaccucaaaaauacaaugguaagccaaauucaacauucuguaguauuuuuauuuugaagguuacugaugauguagaggagagucuauguuuuaaaaauuacuuuuuaaaaacucaugucaccauuaucuuugcaauauuuuucagguuuccaaugcaggguguauuuuaacuuccaugcccaaccuacccuuucauacacauauaggaaaagcuuauagauuuuuuuuauauucaaauaaaauacagccuuucauugaaauauacugugucuguaaaccuuuuaauagcuuuaauucuaaaaacaaaauuuugugcacagaaucuuuacuuuuuuuccaaacuuaccagguuaauaaagccaagaauguuagcuuccuuucccccacccccaauacaacagcuauucuaaaucauaacugccuuuuagaaauuugauuucuuucagaguauuaauuucuuuggggagccaaauuauuacauuuuaauccaccaauugucauuaauucaauuuuuacuucuugccuaggaccccaucuuaauguuauuuuuaauuuuggggguccauuucuucaauaacuuuucuucaaaucugaaaggaaauccucuugcuucuaagcaaauccugcauagaaaagguaaauuguuccuguggcuucaauuaaguaaaauuauguagcuauaaaaacaagaaucaauaaaacuaaauauuacccuucuccaugcugucuugauaagauuuaaaaacaagagacuaugaggccaagauuucucccacuacaauuauuugcgcaaguagaacacuaaaauacaaaacauuuuucauuucaacaguucuuaugaauugcauaguucucuaaucagccauuauuuucaaauguucuucuggguaaaggaacuguuuuuggaugcuauucuguaagaguuauauuuugaucaaucuagcauuaaaagacuuggucaaauuacucuugauauuuacaguauuaacucaagagaguuuuaaugguuugcaaaauugagguacaaaaauugcaucuaaaaaaguccaauucuggaaacuaaucaggaaagaugaugcuaaucaggaaaaugcaaaaacauacaaaacagaucaccuauuucauacauucacuggugacccccacgaagaaucaccuuaacaguucaaaaaaguauuuuucugaaaaaaaaaaaaaaaaaaaaaaaaaaaaaaaaacaaaaaaaacuaacacacagaaagaauacauauucagaaauauuuagagaaagacacagaaaauuaaaauacauuuaaaaauacuguugcaguuuucacuuucuacuccugaaacagaaauaagccauuaucaguaagugcauuuuuuucauggagaaaauauuuauuagauuucaaauuaucacauaauacagauauuacacaauuagucauucuagaaaaaaauaguuuauauuaauauucauaaacacugaaaaauauaggacuucauuuugugacauaaaauauaaaaaaacucaaagguaaauucaccaaaauaaaaguuuaaauaaacaaaucaguucacaauaauauacaaaaaguuucacuuuuaaauaaauagcuuguaguggcaugaggugacuagaaaugcacuuacauuuccuuuugcauauuuuaaggaacagagcuaaaauucaaucaaagcaugagauuaagagauuaaaucacuuuucaucuucaaagcugaaacaaaaagcuuauaaucucacaggccacacaaagcgguuucuacugugguucaaagaguucaacuaacuuaauuuccaagcaaauaucauuuuuaguuccuucaguucuuccuaaaacgauggacaguuguuuuuuuuaauuuauauguguuuguaaaccaauugucuuauuaacauuuacuaaaaacaagucgggaguaaaagcuguaaucacuuaugggaauucaaagcucucuggggaaauuucaguucaaauugaaccuuuaaacuuacuuuuaaauacuauacuuaacaaaaauuuauuuauaauuaaugagaaaaaaauacagauagccaagaaagacuaagugcagguuaugcuuuagcaaauguggcuucuaaaacuuuugagauuuccuaaaacauuuuagcugcuuccauauuaauaacucuagaaugucuauucuuaaaauguauaccaaauuuaacaaacuggcagcauuaggugacuuuaaaaacauucuuuaauagcuuuugacugaccaguuaauagauaccaaagaaagaaacagaaacauuuugauaacuacuucaaucaauuaauugacagcuuggauaaauaacuauuuugcaacacuuauuccuucacaccuacaggcuuauucuaauacuaagugcuucugcucuguaaacuacuguuuugugacaguaccaaacuuuagaaugccuucaguaugaaaaaaauaccucaaguuuaacagguauguauuacuuuagaagacagaccaagcuacuuacaucucaaaagauauuucuucuacuucucuauuagaaacuuuguugauuugacaauuauaauaagccucaagaccagcgaagaugagcuaaaagaguauauccuaauauuaaaagcaguuuucgaauaauuaagaaguucacccuuuauuuacuaguuacuuucagugucaggcaacaaaaaaaaccauuucauuaaguuuucuggacuuccucuacuacuuaaaaaaauguuugccuacuucauuaaggugauuuucaaucccacaaauguuuuaaaugaaacagauacagagagccgcuuuuaaaagaaaggagucucucaagcuuccucuauuucagucuucugaauagaaagaaauauuuucauggccauguaaaauuccaaucugaaaagauuauuucauuauuugggccuuuccauuuucagaccaaaaguaaaccagaguaauucuuaaaaguuuauaaaugacaagaucagguggcuggcucauccuugugucuucuagacauauugcauggauccauucaccacugccuuccaaacugcaggugcuggcaugugugacagauaucauccaugaaggcucugcuagaagaauuccuuuugcugaagaaguaugauguuuuaccaguugaaagaaaucugggcaauuaaagaacaaauaaaccagucucccauuaucaagauaccuggagucacagaaggaauccaccaaggaaaaaugaaaacuugccaaagguaacaaguucacauucuacccauuguaggugauaagaacuuccuggaaucaaauccuacccuuggcaucaaagaaacuaagagaaaaccaucuuaaugccaugggggaaaucuaggaaaggguucuuuuaccauaaauauuuauuccuagggacuagaaaaugacuuuugaguauauuaaacauagcuuucagggauacuguauccugaaacuuacauucauucauacuuauguuuuauuaaagaauggagccuagaauugacaguaaaaccauaauaguacuaucauugcaucuuuuaaaagaucuaauaugaaguccuaacauuugagguaggaagaagaccaaaagguucucacuaacaguguaggauaacacuuggacaugugacuguauaaauuagacuucaaauguccaguuugcccaaagaugaaauacagaaccuuuuaaauuacuugaauauaaaagagcacuuagaaguccacuaauaccacaaaggccaaaauggguagauauucccguuuuaaaauuccuguggacuacauaggcauucgucaaaucaugugccccaaaucauccacugcuuuaauuaucuggagagaaaauuaaauuuuaggucucauuuuugaaugaguacuaguuagcauucucagaaaaacaaaacagauugcagucccaccugguucuuaaaugaacccaaggaguuuaccacagaauuaaaugggcaauggaaggacacuccaaucuauaaauuaacccaaguaaauaauggaaagcacccacuuguuuauuauccuuucccacucucuccagaagcuggauauucugucuccaaggguucaguggagaaaguggaccccugacgucaaaagcucuccguggucuuggcuguaucugugguucuaggaucacuccuugcaccucugguaggagagaagcacugaaauagagagcugaauauagauuuaaggaaaaauucuuauuaagaaauuacauucucuggucauuugaguuuguaauggcuuaauccucaggauaaaaaggagcuaccuuugggcauacuuucuuuagugccuucuuaauuugaauuuuagaagucugucaccacaaaugauuaauuccucaguaacuauuaagaagggaccuguauuggucuaagccauaacacacucugugauaaaccacucaacucugaguggaagaccaaaucaaaaaugauaaauuaugacuggaaacaagaucauaguugucuuuaagggacagggaaaaggcacacaaccucagauauaucaaaggaggagucccaguuaauucuucugucaaagaaaagaagauggacugaaaaguagaaacagaaaaaaccaaguauauuaacaggaauacuacuaaacuuugggaaagucuaagaagcugaauuucuucucugaguucaagucuucauuaacuuaaagaauuaaucacacuauaggcccauauuauagcaauacaaagcuaagccuauauuuuaugaaagcuuaugacuacugucacugaaaagauuuauucuucaagcacucagcuuuaaaacugggaaggcagaauaguggauauaggcaauacagacucaaaauccuuuuuaaaaugcauaaucauuuucuuuugggucaagaagaaccaggaauaaucauuaauggcuauaacauagaaauuaaagcaguaagauauacccaaauuauagaugauggcaaagauacuagaaaauaguuagcuuuauuauaggaauaaauaagagaaggaaguucaaagcacauagcaucugaucaaggaaaagcugaaaggagaauaagauaggcagauacauauuuaaaguuacagggacugcaggauaaauuuuaacaguguugccuuuggaaaacagaucaauuaugcuuugugguacagaguaauacaucccuauuaaauuucagaucuuauucuaaauauaaaggugcugcguauccuuguucuacggaguacagucagucacaguauccuauuucuaggacauguuauauuuugggauaaaguuuuuaugaaaugcuaucaaguaaucucccucucauaccaacuaguuaucacaaggguuccuuaccuguuaguggaacgaggauuguguucucuuguucucuaucaaucaaccaacaaagguuauagucucagcacuaagacgguagcaaccaaccaaaguuaguguuucuaaugccuucacuuccuccuggcucugccagccaguuuggaaauguaccaaaagcugaaaaggaaugguuauuccauuaccuaacaacauuuagacuaaguaauuuuaaaagcuuaaagaugaaaagaaugagcuaacccuucugcacagggacauauccaauucuguacaaaugagaaaugacaguuuggccuaaguaaagaaaaccuaugaauuuaaccaucaaaucugcaauuaccaaauauuaaagaaaagaaaaaagaaacuggaaagaagaaggugaaacugccaucuaacaagagguaucaaauaauuaugaaaguacuuuaugcaccuaaaguggcagcuauuuuuucaauuuaagcuuccaacagauuuuaaguccaaaagccuuuuaguauuuaaaagacuguaucuuuagaucaguaggcuuuaaaaaguauuuuacaguauaaucacaaugaggagguauaugauggaugauaagaagaaaggagcacagauuagaaaaaggaucugaaugcugaaucuuaacaaaugcaaucuaauuaaguaguuucaagagucuaaaacacccuaguagauuaacaaagcauuccacagcuggaguuguuaaggaguggcucuuuaacagaggaaaaaggcuuaaaaucaguacguuggagcuaucuacauacauuuucacaguaccuauauggugcaaauaggugcuauaaaagugcuuuaaaaauuauuuauuaaacaaucauccucuagccuuuucuaaucaauuuccuugacaaauuauucuuuuucauauaguaauagcucaauaucaaccaugaaaauuaucuaagauuucuaaauuaaugaaaucuaaguaaaacuuaacuacuuuaaaauaguuuaaaaccuauucagaaauuauaauuaagauacgauuuuccaaauuuccuuuaguuuccuuuccagucguuuucaauaguuaacuuuccaauaguuuuccuucaguucuugaauacuaauccauaauaauauauaggugagugaaaauacaggcaaaaagaaagagguacauuuugauauaggaaauacaccucguaauuuucauuuuuaaguuuacaggccuacuucacuuugaaaaugaaaaacaacucacaaaaaaccagaucuugcucagauuaauauuggucuaaauuuagaauuucuccuacaacaggaacuuuacguuaaaugcauccaaaucuuuauuuaucacacaccacaguauaauauagauaaaaaguacaacaaacuuagauuuaaaaaaccaaauguccgaagguuaaguuacacaacaaguuaaauaugagagcucacuggagaaaaugaaucuuuacaaacuuccccuaagucagaacgcuuucagaauauaacuucuuuauuuugccugaaguaccaaaacauaauaauucaacacucauacucagaaaugaauaagcagauuucucuaaguagaaauuauuuugaaaucacugaggagagcugguaaagagagcuugcuuuaagaguuaauaauuuaugaagacucugaauuugauaauguaucauuuauauaaaaaauguaaagaugcuuucaaaauggggucauuauuugaaaaagaaagugcagccuuugugagaauauuauugauggaagcuccuaaaaaugauacaggaagcccuuaccuaauucuauuuuaguggacaacauucuucuaugugauauuuuaagagggagaaauauuuauuacacugcaagacuuacauuucaaccacuagagaaaaaauuucaaaccaaagcuaacaaaaucagcaaugcuaagcugcuaccucaaauggcuguuauagaucuauuaaccuaccaguacaucaaugaaaucauuuuaacauuuucuguaaauaaugaaauuuuuaaagauucuuacugaaaauccauguauauucaaaucagaagcaguauuuuauauauaaauaccacugagaaaauuuuaugagaaguacaucaaauuaggcuguuugcaauauuuguucucaauauuaaauuaugaaaugagcauacacagcuuauuaguuuuaagcauuucuaauaucuaagcauaagggaaggcuacaccuauuuaagcuaugaaauagaaggcacuauguuucuacaaagacugauuucuacucaaaugugcuacaacugacugaucuaaaguugaacuuaaugguuuauaaauuuaccgauuauucauuaaccuggacauucuacauacauuggaaguaucuuuuuauucuuuaccuauuaucacccauucauacugguucuaaggcacuucuacaaagaaaacaaauucuucacaaauuccucuaaguauccaaaacaguccuagcuggcaguaagaagaaaaggaaagaacaugcuuaacagaagcagugugucuuuuaucucuagacccuagaaaagugcuuggcacacggaauagguaacucaguaaaugcuuuacaaauaaguuacugaucaaaaaacaaaggagaauuuugucaaguggccgauaucuaaaguagacacuaaaaaguucaacuuucuaauccuaaagaaaacaaaaaauuuaucaaaaguauaacuuucggccaggcaccauggcucacgccuguaaucccagcacuuugugaagcugaggugggccgaucaccuggggucaggaguucaagaccagacuggccaacauggugaaaccuugucucuacuaaaaauacaaaaaauuagcugggcaugguggcgcucaccuguagucccaccuacucgggaggcugaaggaggagaaccgccugagccugggaggcagagguugcagugagcugagacugugccauugcacuccagcaugggugacacagcaagacuccgucucaaaaaauaaaaaauaaaaaauaaacuuucauguauccaucucuuuuuggggucgucaacuucuaaggauuaauuuuuuaguauaguuagcagaaauuucaaagguauuauccugagagaugauacaaauguuagccaaauugcaacaauuacagauuucuaauauucuuuuucagagauuuaaaaguaguacaaaaaccagauacugccagaauauccaauuucaaaaagggagagaucuuacccgauaacaaaacaaaaaggcaaaaaaaaaaaacccacccaaguucuucggaauuaguuaacuaagguauuguacugacacuggagguaaagauuauuucuaaaccauaaaucuuguguguauuaucaaauggaauacacauuuuuugaaaaaaaauagggaagacucugagcaaaguuguguguuaaaaagaauuuuuuuuuuaauuaaaaaaaaaaaaaaccaacgggaaggaagucugaacuuaaggggcugaauaccaucaagaggauaugugcuuaaucauggacaguaauuuccuaaaagagaagaaagcuguaaugaaaacagaaaaaccuaacuauuaaagcauuuuuagagcucaacaucuagccaaauuccauuaucuguauauuuucucuucaaccuuuuggaaaauauaccaucugaaaauguuaccgguauucaaguuaguccacuagauauaaauaucaaguauuuguuaaaagacaaccaacagauaacccaaauguguucaugcuccacugagguagaagaugaaguaaaacagaugaaaaagaaacaaucuacaauauauauauuuuagaguaguuaauucacuauagaauaaaagauaaaaggcaaucauagaaacacaguugcauaaacuauauugacuauaaaaaaggauaaggcaaccuaagggucaagaaaacuaaauauaaaaaugauuaaauuuggcagggcacaguggcucacgccugaaaucucagcacuugggaggccaagguaggcggaucaccugaagucaggaguucaagaccagccuggccaacaugguaaaacccaucucuaauaaaaaauacaaaaaucagccgggugugguggcacacgccuguagucccagcuacgugggaggcugaggcaagagaaucgcuugaacccgggagguggagguugcaaugagccgagaucacaccacugcacucuagccugggcaacaagcgagauucugucucaaaaaauaaauaaauaaauaaagcuuaaauuugccacugacuccuuaaagugaaaaaggcuaguauaugucauuaaaaaaaccuuaguaauuuuaagaagaucucuaaauugcucuaacaaauacuuuuuucauaauuaaccuauccauuacuuuuaccucgcuagugucuucuucgucuugcuagcaugaaauauuuagcuuuauucuuauaauggccagcagcacauuuuggaccuauaagguacugaaaaaaaaaaaaaaaaggauaaucuuccuacuguauuuuuucauucuaggaucuuggguugcguuacguucauaagagugcacuuagaaaacucagaaaacaugaaagaccaggccaggcgugcuggcucacaccuguaaucucagcauucugggaggccaaggcggguggaucacuugaggccaggaguucaagaccagccuggccaacauggugaaaccccgucucuacuaaaaauacaaaaauuagccaggugugauggugcaugccuguaaucccagcuacuugggaggcugaagcacaagaaucacuugaauccagcaggcaaagguugcagugagccaagaucgcgccacugcacuacagccugggugacagagcgagacuccgucucaaaaaaaaaaauaaauaaauaaaaauacaaauacaaauagauaaaaaagaaaagaaagaccauagcaacaaaaccacuuacguuuugcgaauuaggcugccuuuacauuaauuccuuugggucuuuauccauuuaugacaaggaaaauaauguaucagucaaugaaacaaaaaaagauguuaaauaauuaaauguaaaagauucugaucaagcaagaaucaucaauggauacuaaaauuaauggaaguaugaugagaaauaagauuauuuacacagucucaaaauauucccaagacauguguuaauuacaaagugaaaaacaguaacuugauaguuuagaaaccuggcaggcaccuccuuaaccaaaugaucaagaugacaucaccaauaaugggauggaucacaaucauguaccuccuuaucuacuaauaagaauauaccaucacuucugucauauccuugccaaaaacgcacagauuaaggaccaaugaaacuaccuaguauucuucaaaagugucaaagucaugaaaggaaagaaagaaugaagagcaggccuagauuaaaggagauuaaggagauaugacaaccaaguacaauaugaauuccuaaacuggauccuggaccagaaaaagaucauuuaguagacaaggucaaaauucaaaaaugccuagaguaguugguauuaauuuccugacuucuguacuaugguuauacaugauacaaacauuaaggaaagcugggugacagguauaugggaauucugugugaaauacguguguguguguguguguguguguguagguauguauguauguacuuaggguguggcucugucgcccaggcuaggaugcgcugaaacaaucguggcucacugcaauguccacuucccugacgagcgaaccucccaccucagccucacuaguaccugggacuacagggacacaccaccaugcuuggcuaauuuuuguagagacagaguuucaucauguugcccaggcuggucuugaacuccugggcuuaaguaaugugccugccucagucucccaaaauggugagauuacaggcaugagccaccacaccaagccuguguacuaaauuuuugcaacuuuugguaagucuaaaauuauuucaauagaaaauuaaaaauauagaacaaaacauccugaauaugguuccauacucgacacgccuauggaauauccacugagaaauuaagaaacauaaaucuccgauuuuucauucagaugaaaaauuuaguccaaucuuucuuuaaaagcuaauccuaauggaaaugauagcauuaugucauguucuguacuaauaucagaaaaguaaccagauguuaauagucuuuuucuuucccuuugguaaacaguucucuagagaacuuuaauucagaagauaauaugugagagaucaaaagggaaaaucuuuccuacaaauagaaaaacaauguuuacauuaaauagcaaguguggaaauuaacuccagacuacagcaagcauaucauagaacaggugaacaaaaaagcaaaaguucuuuccaauuuacauuaucauguauguuuauuccugcauuauuaaaacugaagaccuucuccucauuuguuucuucaaaaauuuucgcaggaaauagaguuuagugccauaaauauccuccuuccuuuuuuuaaauuaaaauucaagagauaaacuccaauguauuaauaccuucacuuacaaaguugguuacagguaaauauucauaacuuuuuguuuuaauuuuuaacuuacugagagcuuaguauaugguagguaauguauuaugcuuuuaaaaaaagagaaacaaggucuuccuaugaugcccaggcuggaaugcaguggcuaguuacggguacaaucacggcacacuacagccucgaacuccugggcucaagcaauccuccugucucagcuacccaaguagcuggaacuacaggaacuugccacugugugcauuauuauuaugcacuguauuaugcauuuuauauauauugccucauucaaucuuuagcauaacccuaucauauauggaauauuauuaucacaacuuuacuugauaaggaaacuaaagcacaaaguggugaacuaacucaccuaagaucacaugucuaguaaagaacaggaaauucaaaaccaguuugacucuaggacucugagguuuaauuuacauuuuuccaaaucauauuauuuugauuaacaacugaguacuucuuuuuaaauacuuaguauauagacuggggcugggcgcgguggcgcaugccuguaaucccagcacuuugggaggcugaggcaggccgaucacuugaggucaggaguuagagaccagccuggccaacauggcgaaaccccgucucuacuaaaauagagacacgucacugcacuccagccugggugacagagugagacuccaucucaaauaaauaaauacuuaguguaugauaaaagcuagaauaaacauacuguuuuaaguagaauucugaaacaacuucaaauucauuuaaacauacaucaauugacaguuaagcaagcuaagcuuaagcaaguuaacuuguuuugccauuucuaucaaccuaagaaauagggaauuuuacaagacaguaaaacuauguaaaaauauggaguuuuacaagacaguaaaacuucaaaauaaagcguagcaaaauuuaacaacuuaauaccagcaagauaaucuaggaaaagauguuucuauugaaacuaaaaagcccauaucuaaacauguuaaaaugguaaucagaaauuccuuucaccuuuuaaguaucuucaaaaaccaagacacaaaaaggauuuuuucuaacuagaauuucuaguuuaccugauacauaucuauugauuugcauaacaaauauauaagauagacuuuuaaauguacaagaacuucauaauuuaauaaguuuuauuauccuaacauaauguaaacauuauagcaacaguuuaagucaccauuuguuauaagcaugauuaaaauaauaaucugacaauaauaaacuagauucagagcucaauucugcuuaaagacccagagaaacagucuuuaguuuauuacagaauagauaauaaucuguaugaaugcuguggcugaccugaauuuuaauauauuuuaaguauuacuuaugauagcuuacaauauaucuauucaaguuccuccguauauaauaagaugaaaaggucauugccuuaucucaacuugaauuuaauaaaaaauauaaauaugauauuagacaucugcagaagcaaucaacauuuuaguuaaaacagggcgcuuuccaauucuuuaucaauaaagugggguagguuuuguaaaagacagaacacaucuacuuacaaauaaauccuuuaaucuacucuaucuuauuauaacuuauacagcaauugagccuaaagugacaaggaaauaucaguagcuuccaccaaucucagaaggcauccucagccuuagggcccauuucagcaaacucagaaauuaagaaagccugggcugggcacaguggaucaggccuguaaucccaacacauuaggaggcugaggagagaggaucucuugagcucaggaguucaagaccagccuaagcaacauggugaaauccuaucucuacaaaaaauuagccaggcaugguugcgcacaccuguagucccagcuacuuggagaggcugaggugggaggguggcuugagcccaaggaggcagagguugcagugagcugagaucacaccauugcauuccagccuggggaacagggccaaacccugccucaaaaaaaaagaaaaaaaaaaaaaaaaagaagaaggcggcggcggcaagaacagcaagcaagcaaccaagcuagcugugucugucaacuacucaucugguaguugauuucuauacaguaaugaggcuacaaaccagaaaaauuuuaaauguccaacaugacauucuaaaugucaauacuggaaaaaauaauuugaauccugcuaccuuacugacuauucacaguuuccacagcuauuuccacuuuccaaacauuuuaggaauaaaauuuugauagcgacuaauccacgucuggaaaguaaaauguugccaaaaagaaaaugaaaagguauuaagaaagaacaucaacccaccauuaaauuaacaauuuuaaaaauaugcuuugauuuaaaaaguauguggagucuaguuaacauuguaauaacuaucaguaaaacuucacaaaagccacaacggaucuuaguuuaugucuuugaaagugcuaauauuacuagaacucaaguucuuuauuuggcaagcuccauuaagaaauaaagcagccgggcacgguggcucaugucuguaaucccagcacuuugggaggccggguggguggaucaccugaggucaggaguucgagaccagccugacuaacauggugaaaucccaucucuacuaaaaauacaaaaauuagccaggugugguggcgcaugccuguaaucccagcuacuugaggggcugaggaaggagaauugccugaaccugggagacagaggcugcagugagccgagauugcaccauugcacuccagccugggcaacaagagugaaacucugucucggggaaaaaaaaaaaaaagaaaaaaagaaaagaagugaagcuaguguacauucccuucaguuuuuaauaagccacuucuuaaaauauuauucagaauaccagauuauaguauuucuaaauagaagaaaaguuuauuucccuacuuccuucaaaaccaaucagcccagccugggcaacauagugagacuccaucucuacaaaaauuuaauauuagccaagugugguggcacacaucuguggucccagcuauucgggaggccaacgugggagaaucacuugagcccuggagguugaggcugcaaugagcuaugacugccacuguacuccagccugggugacaaagugagauccagucucaaaaaaaaaaaauaaaaauaaaccgggcaugguggcgcccaccuguagucucagcuacucaagaggcugaggugggaggaucaccugagcuuggggaaauugaggcugcagugagcugugauugcaccacuguacuccagccugggcaacagaauggaaucccaucucaaaaaacaaaagcaagaauuaggcauggugacauguaccugcaguccugguuacucagggaaacugaggugggagaaucgcuugagccugggggcagaaguggcagugauccaagaucucaccacuacacuccagccugggugacagagcaagacccugucucaaaaacuaaaacaaaaacccaaaaccccaaucagcugggggugugugugugugugugugugugugugugugacccugucucaaaaacuaaaacaaaaacccaaaaccccaaucagaugggugugugugugugugugugugugugugugugugugugugugugucugagacagagucucacucuguuguugcccaggcuggaaugcaguggcacaaucuuagcucacugcaaacucugccucccagguucaagcaauucucgugccucagccucccaaguagcugggauuacauaagcgugccaccacgccuggcuaauuuuuguguucuuaguagagacgagguuucaccauguugggcaggcuggucuugaacuccuaggcucaagcgauccaccugccuuggccucccaaaguggugggauuacaggugugagccaucgugcccggccgccaucagcugguauuuuaaagauuuugacauaggcuggguacagugguucagaccuguaaucccaacacuuugggagacugaguugggaggaaugcuugaggucagguguucgaggcugcagugagcuaugauugugccacuacacucuagccugggcaacagggcaaggcccugugucuaaaaauuaaaaguaaaaaaacaaaaaaaagaccaacacuuucaaucacucuuauuuggcacaguaguaagagcagacaccauuuacgaacgaccaagaacuucacuaggugcauuauacaccucucuccuuuacaaggguagcuguuauccccacaugaaguuuaugcuggccaucguaaaggaauucccaaaagaaccaugaauucauucccuaauuuaccuguauaucuucagaaaugucucccaauaaccaucuuuuagccccaaaucuuuuagcaaaucuuauucucaaaaugacuucaagguuucuccauuuuugacaacccuuucuguacuucauauuucauuuuucugauaagcauaaccuaggaaauggauaaauaauagacaagaauguucaauuggcuccuuuacuucacgaacaccaucaaggguuaacucuccaacaugaggaacagagaacauaaagcuaguaaaauaucccauacugauggcaauugaagcacguaacaaacugaucauuucccuacauuuaugaaguuaacuaguucuuucuaacuuauguacaagauuuccgucaggaauaugcuaccacauagaaagucuauucccccacuaaggucugcaaaccauuuacaaagacagggccaauuaaaagagccugcaaauaugucagugccgcacuucucaaaauguguucuuuaacaucugccagaucucuacuuguuacaaacacucucacaugacaauaauuauacuuuuauuucuaauaugaauugaauacuaauagaaaauaaggugguaggccgggcgugguggcucacgccuguaaucccagcacuuugggaggccgaggcaggcggaucacaagguuaggagaucgagaccauccuggcuaacauggugaaacccugucucuacuaaaaaugcaaaaaauuagccgggugugguggcaggcgccuuuagucccaucuacuccggaggcugaggcaggagaauggcgugaacccggaaggcgaagcuugcagugagccgcgaucgugccacugcacuccagccugggcgacauagcgcgacuccaucucaaaacaaacaaacaaacaaacaaaacgaaaauaaggugguaaacagaaagggaacuguuacagcagaauaauaaauguagagaugggcugcaguugaggccugccgucacuugacuauacaugaccaacgacauuucucauauauaaaaugaagcaaacgaacauuucucaaucuguguuucaaggaacacugguucuccaggucaguaacagguauuauaugaugaaagaguuggauuucaauaaaaccgucuuucuucuucaaaauguaucggucuucaauaaacuaaaauguaaugucaacuuccaaaauauacagacaaaaagcauucccccaaauuucugggcucuaauacuauuuuuuuuuuucacuuuuagaaucaguauuagaaaaaaacuaguuuugaaacuuuauagauuucaaaauccaguucaaugaauguuugaaacuuaaaaaaccagauauugacuuauaaucuuacuuaaaacaaacagcuuaaucccauucauucuaaggagauaguuuucgggcccauaugggacugagcauggaagagauggucuucagggcauaaugcccaucuaaaacaaucuuucagaaugaaaaaguugagaaucacuuaauugggguaaugguucuauuuuagaguauuaacaaacugcuacaugacgcuguauuucuuccaaguauuccccacccccauuuaaaaaaagggaaagguugcuuuuacaacaacuuauguuuuugugaauuuaggaauuucaaagaacugcucaauaaucacauauaauacuguccuggcagcaugagagucagcgaaagaauuaaucccugaucgcuccacuguauguaaugaauucgcuauuuucuuaugcauuuagaaugauggugcuagauauaugccauucuuagaacuaagagaguaggcacucuuuuccuguagggauugucuuauggaccccaggugagaaagacugcaccaaaaaugucacaaagguacagaaccgcugcuuuagaaaauuauguauaacgccucugaacaaguaaacaagcuuuccauuuuaacuuacagugcuuaagaaaggaaucacucuuacuuagcacaguaauaaaaacagccaucgauuuacagaacuaucaagaacugagccaggugcauuauaugccuuucuccuuuuauccucacaacaacagcacggguagcuauuaccugcacauaacagcuauggaaaucaggcuuaaaaaaguuaacucauuuacaaaggucauacaaugaagagguagcagaaauaagaugagaugccagggcugaugccaagacuaacguucauuaaacucuaccucauuaugcuuauucaucgauaguccagaugcaucaauucauuugaauagaaaaacugucauguauaccauauacagaauaacaauugagcacaauauaaacuuauuuggauaauugagaagauaaaucaagaucuuaugaugcuugaguguacuagacgaaacuguugcagaccaaaaccaugucuuuuuuuuucuucauacccuuaguaucuuuguucagugcuagguauguaacaagcauucaauaaauauugaaugaguauuuuugaaguaaauaaaucaucccaauaccaggaacaaaaaaaaaaaaaaaaaaaaaaaagagguacuguuaaaaaccuucuaggcuaaaagacaauugcuuaaacuaccuuagguaauuuuucuaaaauaauuuuuauauagauaaauucgcugaugcaggcaaugaggacacagugacccugaccgcaaacugcaccaaauguuuaccaaauuauuaucaccaaauccccuccuucucuuccacuccuucuaauggucuucaacucccuauuucucuugucuccucuccccuucucauguguuaagccuaauucagauuacugaaugaaugguacuaauggcauuuaagucagacauucaugaacucaaauauaguauaacuugguuuuuguuaggccaauguguccacuuguuagaagcuuuuguuucuacauauuggaucaauuuccuaauaagccacuuguagaucccuaagggcuaagagucugaauacaacuggaaagauaacuagaccucuaaauuaaaaaaaaaaaaaaaauccaaaguugaucuuagccuguccauuuuauaaaagguaauccaguuuuaaaauauuaucucuuaagaagauucaauaaucacaagugucuugcaaaaaugccagaauguuauucuuaggcccuugugaauuuuuuuuuuuccagaaaacguaagcaaacaacaacaacaaaagacuaauaagaaauacguaggucgggcguggugcgucaugccuguaaucucagcacuuugggaggccaaggaggauggaucaccugaccucaggaauuugagaccagacuggccaacagugaacucugucucuacuaaaaauacaaaaauaagcugggugucguggcgcgagccugucaucccagcuacucaggaggcugaggcgggagaaccacuugaacccacgagguggagguugcagugauccgagauugugccacugcacuccaacuugggcgacagcaaaagacccugucuaaaaauaaauaaauaaauaaauaaauaaacaaauauguacagccauccuugucuucaagcacuuugagaacauuuuagccauugauguuuacauguggcacccacccaugcaagauagguuucuguauuuauacauuaaaauaccaaaaaaaaaaaaguaugaaaugccuucaaaaauguucaaagcuugagagaaaagcuuuuuucauuagucaagguguuuugauaugguauuaaaauaauaucuaacaaaaugaaaaaaaauucucuuuucuccaugaaugcugacacuggggagaauggcaauuuuaggcugucaagagcauacuaaauaaguaaaauaucuagaaaugcaaucgacuugcacgggaugugaaaauuacuggcuuucagucacuuuuggcuauuucauacuggcagaaaguaaaaauuauggaacacacaaguaaggcuuauauuacauuacuauuaaaugauaaauaaagcuacuauaucuuuuaagauacaucuuuacuauuguuaacuauaauucaaaaaaauuccaauugcuucaauagcuccaacauuuauaagugaaucaggaaauaaauaauggaaacgaaaaaaacaguucuacuguuaaaaaaaaaaaacaaaccaccaccaccaccaucucuuggggccgugcacggugacucaacaccuguaauccuuguacuuugggaggccaaggcagauggaucacaaggucaggaguucaagaccagccugaccaacauggugaaaccccgucucuuaaaaaaaauacaaaaauuagcugggcgcaguggugcacgccuguacuuccagcuacuagggaggcugaugcaggagaaucacuugaacccaggaagcggagguugcagugaaccgagaucgugcaaaugcacuccagucugggugagaaugagacgccaucucaaaaaaaaaaaaaaaucugaauacuuuaaaaaauuuuuguagccaggugcaguggcucaugccuguaaucccagcauuuugggaggccaagacgagcagaucacuuagggucaggaguucaugaccagucuagccaacauggcaaaaccccgucucuacuaaaaauacaaaaacuaguuggacguggugacgcacaccuguaaucccagcuacucaggaggcugaggcaggagaauccuuuaaacccacaaggcggagguugcagugagccgagaucaugccaccucugaagaccuaaugcagaugucuaagauucaaggccgagcauggugucucacaccuguaaucccagcacuuugggaggccgaggcgggcggaucaccugaggucgggaguucgagaccagcuugaccaacauggagaaaccccaucuguacuaaaaauacaaaauuagccaggcaugguggugcaugccuguaaucccagcuacuugggaggcugaggcaggagaauggcuugaacccgggagucagagguuguggugagccgagaucgcaccauugcacuccagccugggcaacaagguagaaacucagucucaaaggaaaaaaaaaaaaauuacaaaaaaagaaaaaguggccgggcgcaguggcacacaccuguaaucccagcacuuugggaggccaaggugggcggaucacaaggucaagagauagagaccauccuggccaaugugguaaaacccugucucuacuaaaaauacaaaaauuagcugggcaugguggugcacaccuguaaucccagcuacuugggaggcugaggcaggagaauugcuugaaccugcgagguggagguugcggugagcugagaucacgucacugcacuccagucuggcgacagagcgagacuccgucucaaaacaaaacaaaacaaaaaguuaauucuaccuucuagaauaagcaaaaggacaagcuaaauccuauuuuucaaaugaauauuaaagcauucauauaaacuaucauuuuuuuuauacuuccccaagugaguucacaggaaaauuaucacuuucuuguuccaauaauaaauaugaugugaagauaaguuguaaccacucaaaauuaaaaaucugauucauaaaaugugcuauuauucaacugauuaaaauuagguuucuacuuuaaaaguauuuuaauagaauuuuaauuugauugcauuaagcuuauaaaaaauauccuaaguaucaacagcuuauagaaucugagaccacuagaaggccaguaaucuaauaauuuauugaaauauuuaugucaugaaacugggugucuccauauucacuuauuuuucugaaauugcaauuuacuucagcaaauuuuccaaauuuaaaguuuacuuuuuagcaauaaauuuggagaauuuaaccacugggguagaaacuauacuuuuuaaauguacuaagagaaaauaauaauaaagauugaaggaauuauuagguacacucauuacuggacaacuccauaaaauagugaccgaaauaaccaggaaagucuauagugucaaaugccucuauacucaauaggcuaacgacugcuuuuuauaguugucagcugucaccuuuuguucuucucaauggacaaaagaaaccuccagaaugugguugagugcaaguuuuggaaugaaaucaccuaauggaauacugacuagcuccaucacuuaguaguuaaugugaccaagguccuuaacuucacaauauuuuauuuguaguaacauaucaaccaauaauacaguaaaaaaaauuuuugaaucauuucccugucauauaauccucaggucucccaugaauuuauuaucaaucuuauacaagcuuacaaaaaagaggagcuaaacaguugccaauuuaaauguuauguaccuucaggcugggcgugguggcucaugccuguaaucccagcacuuugggaggcugaggcggauggacagucugagcucagaaguucaagaccagccuggccaagaugacgaaaccccaucucuacuaaaaauacaaaaauuagccgggcauggugccacaugccuguaaucccagcuacuuaggaggcugaggcagaagaaucacuugaacccaggaggcagaggcugcagugagccgagauugugccacugcacuccagccugggugacagagcaagacuccaucucaaaaaaauaaaauaaaauaaacauuauguaccuucaccaaguauuaaauauacuuguuccuaaaaggauuagggugugauaucaugaucguuauuaugggauucagagauggagguaggaaaccgcuaaguuaucuagggugaaauucucauuuccaucuccucuuucuguaccacccuuccugccuggaaccucaaaauagguaaaauuccuaauaauaaaacauaaccaauuguacaaauguauaaauccugcuauccauuauuucagagaauaacugaugaauguuugguggaucuccauagaggaaaauaacacauugaaaaugaagaacaguuuaaaacucuuauuccaaauucuacaguaaaaugaaccaucaaccaaagacaagacuuggcuccauguuugacucucaaagaaaaguuuaggugaacuacagcaauaaaaaccuuuuaaaagaggaagaaaaggaaagacucagauaucugagcaccuaagcaguggacagucuauagcccaaaccagggauuuucucaauucacacaucucacaccacaccuuguacccaaaggaacaaccuuaaccaaaaauaaagcaaaaaacauaacuuauaaagcagcauuuuuuccuaaauuaaauucacuaagacaaauuucacuaaguaccaccuuuuuuaaaaaguaauuuuuaaaacaugggaguguauuuccucaacaggaagauguacuggucauugucaaaaguaccacaacaaauuuguuuagaggacacaaccaagaaaaaaaauuaacuuuuuuuuucuugagacagggucucacuuggucacccagucuagaguacaguugugccaucacagcucacugcagccucgaacuccugggcccaagcaauuguccagccucccuaaaugcugggauuacugguguaagccacugugcccagcccaaaaauuucuuuuuuuuuuuuuuugagacacagucuugcucugcugcccaggcuggaguacaguggcgugaucucagcucacugcaaccucugccuuccagguccaaacgauucucauaccucagccuccucaagaagcugggacugcaggugugugccaccaugacugccucauuuuuguauuuuuaguagagaugugguuucaccauguuggccaggcuggucuugaacuccugaccucaagugauccgcccgccuuggccucccaaagugcugggauuacaggugugagccaccacacccagucucuaaaaauuaguuuaauauuaggcacaaacaaaagcuuccuuaugaaagaaaccaaguuggcuugguugucaauuucuaaaaaaggaaauaaaaacauauacaaugagaaaagucaguuuuccuugauauaguauuugauuuacugugguaaucaggccaggcacaguggcucacgccuguaaucccagcacuuugagaggcugaggugggaagaucacuugagcucaggaguuugagcccacccugggcaacauggugaaaccucgucucuuuuuaaaaaaauaaaaagguaauuaauaaaaauauuucaaagagaaaaauuggggggggaucuucauuauaccuaaacaucuaaaucauuaaaugucuacaaaauaccuuaugcagacuuaguaccuaauaugucauucacuaauuuaacuaaaaauaaaaauuaucacuaccaauuacuuaaaucuuagcaccuauuaggaacuuuuaauuuuacuucugaauauuacuacaaauauucuucguaauuucuguauguaaaggucuagcuuuuauuuuuguaacauauuuagaacauauguuaagaaugucuuagagaauaaccuugcugcccuaaaagguaaaaaaguaugaaacaacuugucuuauuuuagaacaggaaaaaagcaauauagaggaguaaaaggauuugucuaugcuuaaaugauacaguggaggcaauacgacuaaaacaugguuuauacuuguccauagcucagucauuaacaucauuuggaauuuauucuuacacccaugauuccuuaaaacaauauaacgaacauaaucuaacuuucaacuagcaaauauucaauauccuaucacaguucuuugggguuuucuuaaaauuucuaacuccuaccuucaugucaggcuauaaauugcuaacuuuccugacgucaacuuacaugccucagaaucccauuucuuuucccucccuagucucaucugcuuuaagauaacaaagcuaguaaacauaaggagacuuaauggaaguccaaaaaaggaucagaaaugcuaugcaaaaauaccccccggggcgucgggggaccagggagaggaggggacauggcuuugauagcaauuucaagcaguuuuugggcuccuuacauuccacagcugguuuaaccucuggauuaaguggaguguuaccauauguggacuggguccuaaccuccuuacuuuuccuaauuaggccaaagggacugauucaaaccauuaucucagacaaugacagagaauaugccuccauuucuaccacugaggaaaaaggaauuauugaguuucucauacucaauuaaggaaggaagcaacuagacaucccaaguaaagccaguacccuccuaaaacauaguacugaucaggccacugcaugguacaaaaacaaaaaagagcccuccauuccauguccaaucaaauccagacuucucaaucuuacauuuaaggcuuuucaaaguuagccuuauguauacaaagcccaucugauaccaacuuggacuaugucuuauauucuuuucuauaaacaucgguguacuuugaaccucuuugcuuaauguuuucucuacuaaaaugacuuacuaaacccaguagcuaucaaacuccuccucaagcaugugaucuuaacuucucugacucccaauacuccuuuauuaguaccucuccuaaacauaauuuucuaccuuguuauacuuuucccaaaugcgauuagauuuccaucccaagccauuccuuaaaauauuuaaagcagcuuacaaagacagaaauguuuugaaacaaaauaaauuuaaaauaggugaaaaaaaguugaaguaaaggaccaaaaauuacaggaguaauagaaggaaucuuuugucauuuuucuuaaauacaaacacacguuuauucuugaauucaacugcuggcucuccuuaaggagagagagcgagcuaugcacauacuuauuaaauaaauuacauucuuucagauaccuaagagauuuuauaaucaucuaaggacaauuucaaaaugaccuuuaaaaaauuauauauauauauuuuugagacaaggucucacucugucacucaggcuggagugcaguggcgccaucucaccucacugcaaccuccaccucccaggcucaaucgauccucccaccucaaccucccagggagcugggacaacaggcgugcacgccaccaugcccagcuaauuucuguauuuuuuuuguagagauaggguaccauguugcccagacuggucucaaacuccuggacuccagcaaucaaccugccucagccucccaaacugcugggacuacaggcaugagccaccaaguccagaccaaaaaauuauauuucuuuauauauguaucuacaaacauguauauauccuuauacuuugaaaaugacaacgugcaaaagggcaccaacaaagaaccgaauaaacauuaguauuguggcucuuuaaauaucagcaaaauaaccaaaaugcucacauuuaguaucaacaguagcauuaauguuuuucacauuuuaaauaauuuaagauguacaccacuuccuuuuugguagagaccuaggaguccccaguagacaggaaaaaaauaauuccuccucucuacugccuggaagagacugacaauggaaaucuguuuaguaugaaaaggaagcuggcaaacgucucuacaaucacuaauauaaggaaccaauccuaaaauauucauauuaguucgcauuuaccuggacuucuuuucacuaccaaacauauuugggacacaucugcuuugaauuucagauauggauaaacucuauaaaaacgcuaaauugagccgggagccguggcucaugcccguaaucccaacacuuugggggcccagguggguggaucaccugaggucaggaguucgagaccagccugaccaacauggugaaaccccaacucuacuaaauacaaaaaauuagccgaucaugguggugcauuccuguaaucccagcuacuugggaggcuaaggcaggagaaucgaugaacccgcgaggggaagguugcaaugagccaagauugcaucauugcacuccagccugggcaacgagaacaaaacuccaucucaaaaaaaaaaaaaaauuaaauugccaaaaacccugucuuaagguuauaacugcuuauccuucaaaccuuuaaaacugaggcugggucaugaauuuuuggggaaauuggguuuugggguuguuacccccuuuuucaaaaugagaagaauuaacauauugcuuugagagagaagacaggaaagugaauacagugcuuugucaaauuguggaaucugcucagcaaagaaacccuguacugaacauuuuacaaugaaaaucccuauccccaucauuuauuuccuucauucauuaacaaauuauagaaaugcauaacauccaacaugguucuuccugcuucccacuucaauccaaacuacagauuccuuuuacacuaaucuucccugaacaccauuuagucaacaaguguugagggccaaucauuaacuccccaauucaaccuucagucauuuccuaucacuuaauccaacuguugccuuacugcugcccagguguuuuucuuauuuccccccauuuuuauuaauauucucccaccugacacauuuuccuucacccuaaaacuugugaaaagucacuucaaguaacacugcuuuucugaccuaccaaaggucaaaucuacaccaucugugaacuuugcuuaugucauuuugaaaacccaaguuccagguacagucuaagaaacaauuuguaaaacugucucggcgaauucacuuaaccaaaacuuguuccuucauagguugaaugagaucaagauuuccaacucuuaaguuucugauuauuuuauuuaauauuucauguugcuuaaaacuauuacuuagcccuuauauugccaaauaacugccacaugcauacauaucuucuuauaauauuauacacuccuuggggacaagaaccauauuugauuauaccuaagcauugguuuuuuuggcucacaaacacagcaaaaaguaaaucaguuaauucucucuuaaaggagaaaauaguguuaucacaugaucauaaagaacuuuaucuuucuguuuuuaaaaauagaaguucuccuugguuuuucuuaugacaauauuaauaguauauuuucuugauuaagcagauuucuuaugacaauauuaacaguauauuuucuugauuaagcagauuuuaucuaauaggcauugaaauaggcuuugaauauaugcagcacaucaaacauccccauuccuauucaagaagcuuaaaaucaucagauaaucaugaaaacaaaaucuaauuacgaacuguaauaagcauuauaaaagaaaagaacaaggugcuauuaaacaguuauuaacaaacaaccuaaguuuagauugguacgucagaggcagccucucaaaaagugaguuuagcuuuaaaguggaaugaaagugagauggcauaggggauauucaggcuaaaauaacagcaugugcaaaggccuagaagaagaauggaugaaaacugaaaaacuuucugaaaggucaaguacaacuggaaugaagaaaguugggagaaagaagcaugaugaagccaucaguaagcaaagacagaaagaaauuaccuuaaaauaaauggaaaggcuuaaaagggguucuggccaaguaaguuaccugaacagauuuccauuuuaagaauaugauucugacuguaagauacaauauuagaaaaagacaagacauaugcaggaggcucugugaggaagcuacuacaugcagugcauuaaaugagagcugauguuauguuagagcaauggcaauaaggauggaaaaaaaagaugaagauauauuuuaaaguaaugaucaagauguagagagcaaggaaaagaaacuaucaagaaugacucucagguuucuaaagugaagaacugcauuaagaaauuauauuuaucaaaauaaagacaacuaaagaaggaaauuugaggggcuagguaaucaagaguuacauuuaugaccuguugagacugauaagccuaugagaaugcaagcggaaauguuaugaaagcagaugacuuuacccgucuaaggcuaagaagagaagucuggacuagugauaggcuuucagaagccaauagcauacaaacugucuuuacagccaugggaaccaaugauuaccuagggaaaagguaguaaguauaaagaagacucagaaaaccuaggaaacagagucugacagaagagagaaaccugaaagacagacugaaaaggaauggccagaagagugggaagaaaauggaagauuaucacaaaacgcaaaauagaguguuucaaggagggcaaacaaaggucaacuaggccuaaucgugcugaaaggucaagauuuccuggucaaauugacugguaaagaagaaauggagugguggagggcagcuuuugaauauaugugagacuaggaaaaaaguuaaccuagaaucuaaaaaguuguuauaauuuuuuaaaaaucaguauaaagauacuuuaaaauuuuucaaccuuguguaguuucucuuaaugagccaauaaagcauguucuuaccaugacauuuucaaccuuaacaaaagugagacggcaaaaaccaaccaccaaaguucuaauacugcagcaucagaacaggucaugcuuaacagcuucauauuuuuaaauuaaacuuucucuuuuaucgaauuuuuuaaaucgagauggggacuauguugccuagguuggucuugaacuccugagcucaagugauccuccuaucuuggccucccaaagugaugcgauuacaggugugaaauuaaacuuucuaaacaagaaauaaaauuuacauguuuuguauuucugaagcuaaugcugcaaaagcugaucuaaauuauuaaaaaauuaaaaugguuuuccuaaaauuuccacauaaguuucaaaagaaaaaauaaauaaauaaaacauguccaccuuaacauuuaacauuugaaugucuaaugcauuccaggcacaccacugugaugacuuuacccacuuuuuucucaccaaggacuugcagggaaauguuauguucuauggcaauuccaucaguuauacgaauacacaaagcaaugaagccugccuauuuuuuagguuuucagacacucuuaaaaauuccuuaugggcacuggccuuaccucuuauuagcuuuauaagaaguaaaaacggcacuagauuucgaauuggaaaaacagccuugaauccuagcucugcuuuacugcuauguauguaaccuuagacaacuugcccucucuaaauacucagcaaguuucaguuuauucaccaauaaaauagaaaaaaacuuaauucacaagauuacugagugguuaaauaugguagacauuaacugaaucuaauacuaacauuuuucaucacuucuaugaacugaaauucugaauuacauacuauucuuauuucuaacaaauauaaacuaaguaauuccacucuuaaaauuuauguauucauuagagaacuaacuuggagcuaugacuuaauuaaaauuagcaucauucauuacauuuaauaguacaguauucuaccauugaaauagauguguaaugauacuaaacacacacaucuauuuuuucacuccuucccuaaaaccccacuaaaaugacagaaaagcaauuuguuaagauacaaagacauaagcccacaaaaacugaggcagaugaaaagacaauagcaaaaaaauuugaaagcuggaaagcagacaguugagugacaaaugacuuagcaaacacuagaaaaucaaagcuuuagcaaacaauggagaaugccaaaaacaaacccaauuuaaacugcaaaauccccaaaagacucaggaauuggcaguaccacaucuauauaagugggauguggggggagaaggugcuaaaauuaaaaagauuguuuagaagucaguuuaagaagcaaccaguccuacagauucccaacugucccucccuaaucccaagaaaaaaaaaggaauauugucugaagaagguaaaacauaggaucacaggacuaaggaaaucaggcacagcaaaaugcagaacauacugaaaacaggguugagugaagaaacguaucuggggaucccccaaaaccuuucauuccacaucccccucacugcccaccccacagaaugcuuguagaaaggccuucaauuccaagcaagaaaucagaagagccuucuuauagggaucuaaccagcuaggaggauauacaagaagaaaccgacacuagaaguccuccaaccaaacaccacagccagguuaccauacaggaaagcuaacaauugacaagccacgcucagaauuucuaauuagcauuuuaauuccuuacucuuacacaugacuaccaacuaucugaggaaaggcuauaagaugaaagauaaagaccaaagcaaauaaaaaguaagaaaauaaaaccuagaggaaacaccacauagaaagaaaaaaaaaacuuuuuaaaaaagcuaacauuuuauauauucagauagcuaagaaaaaauacuaucauuauuaaaauagaauaguauacuauuaaaaaggagcaaaaaaaaaguucuuggaauuuaaauaugugauaagggaaauggaaacucaauagagcaaaaagaaaaacagaugaaaaguaguugagaaaacacaagaaaauuagaagaccagucaagaagguccguuauccaaauaagaggaguuuaagagagaaaaaauagaaagacauaaucaacaaccugacucaagaaaaagucccagaaugaaaagauguuuccaaacugaaaggguucaccaaguacucagcacagugaaugaaaacagacccacacaaaaauccaucauggcaaaacuucagaacacuggaaacauaaaaucuuauaaagguuuuagagguuuuaaaaaugagaggaagaaaaggaagaaggaaaaggaagggaaggaaaaacaaaauacacaggucacauacaauauauaagauaucagaauggcuucagauuucucaaaagcaauauggauguuagaaggcaauggcacaaaauauaagagaacauaacuuccccaccugguauucuuuaccuaagaaagugucagaguaaacuaaagccauuuuaaaacaagcaaacuaagaauaaagacacuagucucuggaaaauaaagauccaacacaagacaaagugaaaggaaucccagaauaauaguuguguaccaagccaagaaggcaaccagucaagaauggaggucagugggauauaacacuuccugagaaagauaaaauuguuaacaauaucugauauuggaacauccuaagaggcaucugaugaaaaguggauuuagugauaaauauagagaaaacuaggcaaagagguaaaaaaagacaaugaacuccagccagauuacucugcgguaaaguuaacagucaacaagccacacggaaaaagaauuuuuaaaaauaauuauauauauauaguagagacaggaucuugcuauauugcccaaauuaaucucaaacuccuggccucaagcaauccucucaccuuggccucccaaagugcuggaauuauaggcgugagccaccauggccagccccacacugcaaaucucuaaucagcucuuuaauccuuuaacacuuauuugcaagcagacaaucaagacuuaccagacaucuaaggaaagguucuacaggaaagguagagcccaaaacauacaaaaaugggaagaggguggggaaaggaggggcaacuuggagaaaacagacagcgcugacagaugaaaaccugggaguggaggaaaacccauuucuauaauagacagguggggauggagcagggaagcagccacaaaacacuguacaggauaggaaaaguaauauuugacaagaauacugaauaaucaauauugauaacuacugggaggaaggguacugggaaaaaaggagaccagguagguauaugguaacaacaaaauuaaaucuucauuuucuauccaggaaguuaauacagacaaaaagaaaugaaagguguauuuuauuuaacaaauaccuacauagggcaugugaguuagacaaaguucuagggaauuuccaaauucauuuaauucuuauaucaacccaaugagguaacuacuauugucaucauuuuuuuaaugagaagauugaaccauaaagaggauaaauagcccgauguuacauaaaacuaguaaaugacaagaaagaucaaaucuaggcaaucuaacuccacaguccaugcuccuaacgagcaggcuauauuacauaucuagugguaagacaagcaaguuauuuagagacugggagguaaauaccacaauaaucaucuaaaagaggugaaagugauuguuucuaggaaaggaaaacuggaaaguaagggugcaggaagcucuuccauuuauuucuuggaaaaccauuuaaacuaucuuuaaacugugcauguacaucuugaaaaaaaaacuuuaaaaauuauaauuucguauuuuaguuaacaaaguauuuuaacugauacuacugcuauccugagaagcaggcaaaaugaguauuacuccuauuuuauagguaacacacaugcgucuuaaauauuugaggaccuacuauaaaacaggcaauguacuuugcagacauacaucaauucaccuaaaaauguugaugagagauacaaaaaagcaagucuuuuuauucaguucuuuuccauuuguugcauaaauuauaugauccugcaucucucacaauugugcuuaagaugagggacaauauaaacuuuaaaucaugacaaaaaaaaaaucaggagaaaugccugcuaauuaauucaaaaaaauaauucaucccugcccuugaggaacaucuagucuugugggaaagauugguaaacauaauuauaauugaauguguacagugcuuaaauagaggaauauuaaaaagugcuaaggaaacaauguccccugagugaaaagaaugcuuuaaagagaacaucugagcugagucuugaaggaugaauagaaguuugacccauuucacguuaagaggcugugcuaauaacaaucacaaaacauaaaagaugcaauaccuguauuuucccauucuuguaaaggugaauucacaguucauguuacagucuaagacauuaagacuuuuuuuuuuuuuuuuuuuagagacaggguccuggucugccacccaggcuggagugcaguggcaugaucccagcucacugcagccuugaccuccagggcucaggggauccuaccaccucagccuuccagguagcuggaacuacaggcaugcgccaccaugccuggcuaauuuuuguauuuuuuuguagagacaggguuuugccauguugcccaggcuggucucaaauuucugggcucaagcaaucugcccaccucagccucccaaagugcugggauuacaggugugagccaccgcacacggccugacauuaagaccuuuuaaauaagaaugauuuuuuuuaaaacaagauacauaaucuuagcauccugauccauguuuauagucucucccagugaucaacugaaggcacuuuccacaugucuaaacauuuuauaaucuaaaguguuaagaguauuauuucaaaagaugauuaaaagauaaccauccucaucuguccuacugcccaaauuauauuguuaacacauuuccugauucauaauauugaaauuauauauguauucccucucuccugagacuaauggugaccaagcccagaagaugcaagugacaacagaagcuaccaugggaagaaagguuuuaaaaguuuguuuuuuaaucauaucacuguuuucucuuguaguuauucuuaaauuaucuuccaagggcaaauuuaaaugaaaauuaacuuuuuuccaaacuguagugauaaauaaucuucaguaaaacacaauaaagaauauaauauauaucuuuucugaucuuacaagguguuuuagggcuacauuccgauuucacagaauuuaagauaccgcuaaaacaaaaauuuucugguuuuuaaucacgaaacuuugauguuaacuaaccaaggcccaaauagguaguaaauucaaaacagucccugcucuugaggaacuccuggucuugugggagagacugcuaaacauaauuauaauugaauguguacagugucugaagacaacuuguauuagagcuauauuuccuuauuucucaguaugucuuuuugucccuuucuagaauuccauaauuuccaccuuauuauuccuuuucucaauuauuaucuggaaaaauuaauuuuauauuaauaucuuaaacugggacccuauuccuauaguuaaaacucuaguugaaaguagcaucaucugacuuuaauugccuggaagggcaagcuguggaaaauccuaucauguccuaccaauaggaggaaaaagaggugaaagucaagccaggagaccacaaauggcaauuacaaaaucauggcaaguuugaauucaaaaugaguguuuuuguuuguguauuuuacccgucuuuuguuucucuaaacuuagcauccacauaauauagcuguuuuuauagaggcuucacucaaaucauaaccuuuugacuuaaaaaacauuaauauuugugguaauucuuuuaaaauuaguugaguauuagcaugauaaaauuaaagguuuaacaauaauaauggaacaauuaaggaaacuaccuccuaaaaguuuaucuuuuagaguacaguuuuguacaaauaauacagaauacauuugguuagguaacaagguuuuaauuaccugacuauuagaaaaauaauaaaaaucuugaaagauaagauuuuaucaauuuaaccaugucuuuaucuuaccuuuuaaacaacuaaauaacacaaaccucacugaaacauuugaccuguuuucuuuuucuaaaauuacaacuauuuugcaauaugcucaauuuuuccaaagcaaaacccacaaacauacauauagaauauaaaugcuuaaauucgcuugaugaaaguucaaucacaaaacccuccaacuaauacuaaaauaauuaaauaucuugcacgcuuacuccaaauuccaccgugaaaaugaugucuuuucauaacuccuauaauagcauuuuaaucaagguuaguaacagacuggaaaauuugugaaaagaacauuacuuuaaaaaucaacaugaaagauuucacaacuuuuuuagccagucagcuucaaagacacaauuugauucaauaagcguuacuggcauauuauuuccaaucuacgugaaaaaacgcuugguuuaauaauguacuuuaggcuuucuguaucuuuuugguaaggaaagaaaggaacagguggaguagauuagccagagaccaaggucuuauuuucacgccucuauaaauucaauccuccaagacuuacuuucucuguucuuuaaaauggcuaccaccuugaucuaccaugcaaaagaaaaaauguucagcauacuaucaagauaagucugguuauuuugauaguuuauguccuccuuucccacaaaauaagauucccauuccuuuacuguucagauaaaaugaccauuaaauaaguacgcaaaaguuggucaguuggaguaugagggcaaccuauauaacccagauuaagucaucuuuccuaccauaucugacuaggaaaaguaggcaacaauaucuuucacagacuaagaucaaacacaguagaaaugaaaaagggaugucuaguaaaggagaacaaacgugggaaccacaaccccccaagagauuauuuuagcagcucaaaauagauuaacuauuauguggguuagcaaaaauuaagcuuuccauaauauuucuaaaaagcauuuuagagauaauaaaaccacuuggcgcccccaaaccuguuuuuaaugugaacacaugcucaacaacuauucugaaaauauuguuuacauauuacuauuauuuccuacucccucugaaaccauuccauaacucuugcucuauaaaacuucccauaaaaaugcauuuuucacauacaaaacacaauauacaauguuuuagagucauuuugugcauacauauagcuacuaaauagauuaacuucaaaucuguugaaugucuccagaaauaugacaugaucuuaccucucauccucgccauccaccaggggugucgucagcgguagcaccuucaacgggaaaagagaagcagaggcugcuaggcugcugcuacucccaucugaaacugcugacauucccccacugucaccacugauagucugagguaagccaacuaaggagggcuccgcugcacgccuggcaucuucaauuuggcuuccaauugccugagcuaaugauugugcggagaacuggguagaacuuagugguaucuguugugccaaaggcaaauuuguauuaguugcuaucaagggagguugacuaacacuuugaaccaaauuaccauuuuggguagcagggguuugugcuauauuuugugguggaaccaaguuuguuggggcagaaggcauuccagaaggaccaguugaacuaaccugacuuguaacagaaauacuacuagcagagggcaaagaacuaacugcaggcaacugcugugaaacaauuccuugagcuacugguucuacuccuuguggcuggggaggcacaguuaacaaggaacuuugggaugcaauaaccaauuguugaggaaggcuuggagcacuaguuugaacucccugaugaauaaucccaguuugagcagguggaaccacuugcgaagauggaggagcacccugcugaauaacugaagguggaaccuggguagagggcugcugcacugcaguagguauguuugcuugcugaccaauauuugcaaucugacugccaguagguacagcagacacugcugccggagccuggccaacaggcuggacagaugccccugcagguugugcugggacugcugugggcugcacuggcagcuggauacccuguggcugagccacaggaaucacuguuguuccugcuccuacuccugcagaacugggcuguccggaggacauugcuguuugaagaauuggcugcuguuguacauacucugaagcaggauuuugagucacugauuugacauggccuggggccaucuguguagaaaccauugguugcuguuguccauacuguaacuguuggggugguggugccccuggaaggggaguuugcacuggaggagccgccugagaauaugguagcugggguugagccaaacuggaaauggaaggcugcugaccuaaagcugaaguuacaccaaccacauuuacaggcgauggcuggauaccaguugcagcacucauaguggcuugcagagguacuggcugaagaccuugcuuuugcugauagcucaguucuugagacuguaauuguacuugugagaucugugacugagaaauacucugugguauacuaacugcuggaauacucuguggaccagugcuaccaaaauccaucuguuggagggucacaccuuggagagcugguuguugcuguuguuguuguuguugcugcugcugcugcugcaccaccacaguaggggcucccaucucuccacuucccacacucucuguauagugacucagugugcugacacuacugcucacugaacucccacuagugcucucccuuucagaagucacuucuaucggauuuugcuuuacagucuccaccacuuuauuuaucagcacaccuucuguagcagguacagcauuuucuuuuucauagaacucagugcaaguccaucuaccuuuuuuaaagggcucagaacuagaaucuaacuucacaacucugaaccucgaaguguuaacuguugguuguugcugcugacuugaaaccgaucccccagucaucccugcagcugcauuaggaacacugcuaacagcagcagaggaagaaauaguaccauugcccaugccacucaagauauucacauuaacaccacugguaacuccaggcccaacacucacaccagcagcacuaggaauauugcuuguacuuauauuaacauuaccaagcaugcugcuugucacauuaggauuaaaacuacccacagcaguaauguuaacauuauuuacuguacuagugccaguaacagaauuuauaccuauuccaccuguaguacuuggagcacgcauauuagucauuacagaugcaggugaaccacuggaugauacagcagaaguuggugcaacuggugugauacugucagagcuuccaguuguagagaguuuucuagauacugggcuugaggguggcccaccaguaauggaugcacuggccacagcaacaugagauggaugguggugaccauguuggagguggugcccaugaugaaucugaugguggugauggaggugguguggaugagcauucccauugaucacaacauucuguuguggaaggugaggcaaaugaggcugaggaagguggggcugguugggagagacugccccaggugucucggcuuccuggaaguuauuuagggucucuucugaggagcugcguucgggcuccccuaagucaguagcccuggaaagugacacaucaaggaucuccgaagaagagagaucuuccgugugagauucauccagaucaucauagcucucaguguccucugcuauacuguuguuagagcugauacuagcggagaucugagcaggaguaacgcuaguuaucuggaagccacuuuucuuuuucauuugaguuccgccuggcgcaagaggcugugccugcagcugagccugcgaaaggagguucaggcuuuguggaggcggaggcuguggucccgacguagaagaugcugcagggggcggcggcugaagcagcgacggaggcggaaaauccucggaagauguggcauuacuaccgacgccgguaccugcugcauugagagcagaggcgcugccacuaccgcugccccuucgagggaacauugccgggugcgccaucuuccuagcgcuaaugucugcagcggcggcggccgcggcgguggacucaggcggcuggugcauuguguuggguaccgggggcgcggaggagacgagugcaauuuccuucugcaccguaaucuuuguauuggagacgccggagaggaaaacgggaccugacgcuccgccuggcgcgauuccuccuucuccuccuccucagccaaaggcgccggucgcuccugccuucgagagcgagcuucggaaaggaggaugaacgagggugaacagggcggccggggacccgaaggggggaucccuucaguccuucgccauucacuuuccccucuagc

SEQ ID NO: 21523 - RNA, 16947 nt, Homo sapiens
ucgcggggcagguacgugcgcucgcgguucucucgcggaggucggcgguggcgggagcgggcuccggagagccugagagcacgguggggcggggcgggagaaaguggccgcccggaggacguuggcguuuacguguggaagagcggaagaguuuugcuuuucgugcgcgccuucgaaaacugccugccgcugucugaggaguccacccgaaaccuccccuccuccgccggcagccccgcgcugagcucgccgacccaagccagcgugggcgaggugggaagugcgcccgacccgcgccuggagcugcgcccccgagugcccauggcuacaagggugcugagcaugagcgcccgccugggacccgugccccagccgccggcgccgcaggacgagccgguguucgcgcagcucaagccggugcugggcgccgcgaauccggcccgcgacgcggcgcucuuccccggcgaggagcugaagcacgcgcaccaccgcccgcaggcgcagcccgcgcccgcgcaggccccgcagccggcccagccgcccgccaccggcccgcggcugccuccagaggaccugguccagguaggaagagccgcuccccucccaccgcagcacucccgggcucgggcgugucccguugcugcgacucgcgggcgacaggggccgcuccaggcuggggcgugcgucggggcgcaccggagccggugcugggugggcagccccgcccugcacgccuggccggggccccgcguuucgcugagaguaaaugggggggggggccgggggugggaaggauggaggggaaucugccccggcgggucggccugggagagguaagagggagggaacugggugcucacgcgcaccuuaguuguuuuucuuacacuugagggacgaaaccuuguaccuuacgcucaguuuuacuuaaauuacgccuucgccuguaccgcucuccaaugccaaggcauuggagcccucccccccauccccaucgucucggguuaaguagaaacgcaaauuggggugcuggggagagguuccccaagguuucauacccgguggcucaaccugcuuuagaagcgauugcgggccgcguuuggaaaaugagaguuaggaaagcuaagguugugucggagcgcuuauuuuuccuuaaaaaaaaaaaaaaaaaaaaaagaccggggguguuguuuucuucgugugcacguaaauuuccucccggagccgcguugaaagcuggcaguuggcuuuuacacuugcccagcagccgaauuagagcaaccgccuguuucuuucgcccacgcagggagucauauagcccagaaaaaacuucccgggacuuuuagccugucccaaggaaaaaaaaauuggaaacauacccacaugcaaacagcuggaagagcuaaaaucagaaaccacuaaccgccgcgggagcgcagugcacgaaaggguuuaguucaguuuauuucaagacacuucauuuaguagcucuuuggcgugucguauauuugcuacccagcgccuacuccguggggucugccagggucuugcugugagagggcaguggcguuugucagagaugugacucacaugaugagagcguuaauuuuuauuuuuaaaucaugucuauccgggaaaccccguccgcauccacaccaagguccgagaugaaacgcauuugaaaugaaguaguagcagaaaaugacugucuuauuuaccuguuaaggugccacagcuaauauaugcgccauuccaucuaguugguuuucuuaucuuucgaaauuuccuuuucaguguuaaaaaauguaggcuuaaguuauacuaggagagaagauagcuggaaaaggcuugaggcgacuuguuacaagcugguuuauagccuagaaaagagaucaccguuugaaaaguauuugguuauuucaguuugucaauuuucugcucuggaggcacuaagaagauaagggaugacugagcuuuuuacagaguaggggggaauguagcauuggcccacugagaaggacaugauaaauguuuugcugaugacugugcuagggauacagcagccuccccacccacgggcuccuuagcagcacucuaccaagggagugauuuuccccuagguaauuaaagaucuguuuuagauagggauaugaauaggaacauuucauuaucauauuaaccaauuacaggaucugcugaugaaaaucaacauuuagaucaaauauugaaugugaaauuguuuuguuucaguggauacaagguuuugcuuagaacguuguguuuaauuucucauugaacuguaaacaagaaaagacacugaaauagccaaauaauauuuuuauauuacuuuugaaguaucuagucaagaaaagaaaccugugcaauauuuuaaagguuugcaucguuuuuucuauuaaaaaaaaccacgcuuuuuaauguuugugacuuaaacagaauugagguaguuuggcaacauuucaauacuguacucuaauugcaaacuuaacuguguaauggggcagggaauccugcuuguacaggggugaugguaccuuguuauugcaucagaauggaauguuuuaaguuugcuuucuuuuuuauucuugauuugcgucuuucacuuuugggggugauugggggagcaguuuuaccaguuacacagaguuucauaagguuuuggucaaccaguuauuacacaaucgacaaaauaagccugauauguuuauaagcaacacugaggaguuugcccuaguaccuuacacagggauugggggaauuuuuaguaggcgccgauuguucguucuucccgagauggugaaucagguggauuaugcauuuuauaucucuucuuuuuuagacaagaugugaaauggagaaguaucugacaccucagcuuccuccaguuccuauaauuccagagcauaaaaaguauagacgagacagugccucagucguagaccaguucuucacugacacugaaggguuaccuuacaguaucaacaugaacgucuuccucccugacaucacucaccugagaacuggccucuacaaaucccagagaccgugcguaacacacaucaagacagaaccuguugccauuuucagccaccagagugaaacgacugccccuccuccggccccgacccaggcccucccugaguucaccaguauauucagcucacaccagaccgcagcuccagaggugaacaauauuuucaucaaacaagaacuuccuacaccagaucuucaucuuucugucccuacccagcagggccaccuguaccagcuacugaauacaccggaucuagauaugcccaguucuacaaaucagacagcagcaauggacacucuuaauguuucuaugucagcugccauggcaggccuuaacacacacaccucugcuguuccgcagacugcagugaaacaauuccagggcaugcccccuugcacauacacaaugccaagucaguuucuuccacaacaggccacuuacuuucccccgucaccaccaagcucagagccuggaaguccagauagacaagcagagaugcuccagaauuuaaccccaccuccauccuaugcugcuacaauugcuucuaaacuggcaauucacaauccaaauuuacccaccacccugccaguuaacucacaaaacauccaaccugucagauacaauagaaggaguaaccccgauuuggagaaacgacgcauccacuacugcgauuacccugguaugugcucuuaccugguugaagcaucaauagauguagugugugugugugugugucugugugcgcgcgcgugugcgugugugcacgcgcgugcccuuuucaaccucauggcuuuaaauaggaaaguuguacuugacaguaaaaaaaaaaaaaauuaccuuuuuuuuuuucucuauccuaucucugugcuuuaacuuugguauguaaaccaguuaguugucuguugcuuauguuaugcaucaaaaacuuggcuagaauauucuggaaaaaguucccuuggauuuuuuuuucuuuaauauuaaaacagauuugaauuucuaauacauauuauuucgaguuaggccagaguuacuuuaaaauggcaauugaauaaauugcaguuuuuaauucuaaauuaagugccccagaaagagauuaaaguagggugggggaaaauaagguuugguggugaaguggagguugcaggcagcuagcuugauguuagguacaagacugucuacaagacagauuuaagaaugguuuugauggcacgugagcauaugcucaguuuugaaugacauacauggcccaaaguauaaguugaagacaauacauggaauauauuuacaaguuacugggaaagcuaguuuaugauuaauacauggcaaaauuuauugacucugauacaugauauggcaugacgugcuaaaugaaaaaagaagaaaugugggaguacagaaaauuacagucaucuuggauaauggcuuaguacugucagcucuagagccauuaaaauuuuuaaaaaaacauauagcagcucuuaauacggaaguacagcaccuacuggaauauaaacacaaauuuuccauuuguaguuuggcuugauuaucuguauucuuuccuguuaaagugauacauaaaacaaaucacuucaugccuuuaauaagguaaugggggagggcucuuuaaaacuuuuaaaacugaagcuucaaauaaucucaucuagcaugagagauuucuucuuuaaagccagauuuuaaacacugaaucaucaaauguaaagauuucaaaaggaucuccaaaaugacaugcuguucuccuuuauuuuagguugcacaaaaguuuauaccaagucuucucauuuaaaagcucaccugaggacucacacugguauguaauuuucuuguuaauucugugaguuguguaaauaguguaagugguauucauccuuuuaaaagcuaacacguguuugaucucuucuccugucaacuuuguuuuuuuuuuuuuuuuuaaauagccuaccuuuucagcacaggcuugguucagaauucaguuccaugagaaaucugguuccaggaaggccggugauguucccucacuaaggccuucuugcccugucaccgcucagaguugauuacccaaaaauguaaacagcgauguuuacuaauggauuuuaaaacuuauacuggcaguguuuugaaggaaaaaaaacaaaacaaaacucauuuucuuccauagcaaauaauuuugcucugagaaagccauuuuaaacucuuaaaaacuuucccauuuggaguguacugcauaauuggugaaaacguuaguuucaccucuagguuaaaauaucuguguuuaguauguuuucugugcuugaugaaagguagugcugaaauugcaguguuaaaaucagguggucagaaauggguuacaagccccagccuaaacuugguaugugugagagacuugaucuuuauucuagcuuacauucauucuuguuuacauaugcuuuuaaguuuagcuccucuacuuuuguauuugcuuuguucaaucuauagcagucacuuuuuuugagauggagucuugcucuguugccaggcuguagugcaguggugugaucucaguucacugcaaccucugccucccagguucaagcgauucuccugcuucagccucccgaguagcugggauuacaggcccccaccaccaugcccaguugauuuuuguaucucuaguagagaugggguuucaccauguuggccaggcuggucuccaacuccugacaucuuuauccaccugccucggccucccaaagugcugggauuacaggcgugagccaccgcgcccgaccagcacuuuuaagagcuuuuaaacuuuaaaauuauaucagaagccauuuuaagaugaaaccagguggcauacuuuaaaggccccccaaauacuccaaauauugucaaauauauagaugguuacuauuugcgauuuucuuaaaagagcagcccuaaagaaaagaacuuauauaaagugauuguguuuuuuucccucaauaaauacagccuuaccuaaaguucagagaauaaguuugcuaauaaaagcaaugaccuagcaaaauguauuauuccaucauugcuauggaaaccaaaguauucaacaguuccuuugaauggguuguuggauuagugugaggacuugaaucucccgaggcuagauguuacuauggaaauugaguuuugauaaaugaaguaguuaucucuaacugcugcauuaaaaaguaaaagccuuugaacaaaggucagugcugagguagagcccuaagaggaauaugguugcagacauuuuguaugcauguuaggaagcauugcuugauaucccagugauaaacacuacuuacuaaaauccgaugacaauguuguagauuccagggcuuuuugagaaacugcuuuuaaggagaaggcaucuuauguauuuaucuaugaaaugagcgggcuguuuuggccugagguuuuugcauggagacaaacugauuacauaagaggaaggauccuucauaggcagcccaagguagaaauuuuuauaguuaaacacaaaugaauuaagcauguuauaaaaacuccaacuuaaaguuuucaaaauacaaaugacaagugccaggaaaauauuccauguagaaauaccaaaauguccuuuuacagaauauaaauggaaauauaaagacauuugaacuauuguuuuuuucacuuuuggaaguccuugagagauaggagggaacacauuuuccuggguuuaaagucuccuaauaaaagagcacaauugcauauaacgauguaaucaacuacuuauugcagggauguagucaaacccauaucugaauagccuuucaccccgucaggguuuagugcccugaaugcuuauaccugcgauucaggaacuugaccugccggcaaauacauuuaaucguggguugucuuaacaaugcuuguacuaauaaaaacagacugaaaagaagaccgagaccugguuugggucccuugcaucagcuuuuucaccugaccauaaacauuguggccuucaacaucuaaugaaugagaacauguaauccaguuuaauaaaguuuuguuugauagucuuucaaaugccuuggggaggguuuguagcagacuuguucaucuggcuaaaccuguucuuggguaaucauagagcauugagguuguuuucuccucauuucucauuucuagacaaugccuuuuaaaauuaccuguucucucauugcauccuccccacccugcccgccuguuguuuuuaaaugaauguaucugaagccagcaaagguguuuuuuuuuuuucuuucccuuuaaggcccagguagaacaguuaggacaguuuuucuaaauuacuucucuuauguaauagcuuuuuuugguuuucuuucuguccuccuccucccucucggaccguugaucagaggacuuuaaaaaccacacaacaguugaugacauaaaauacucuuuaaaugauugucguuuuacaggcagaaugugaagcacccuagcauuucuuuggaaaauaauuguaauugcuuuaaaaugucaaguuaccuuauguuuuaaaaauaauuuaggcaaugaaaacagccuacaucugaguuuaauuacuucuucuggauuuuuagauuggaagugcuucuuuaacuuggguugcaaauugaaccuaagcaaauaauagucuuaacaaaauagaacuuuuuaaguaaucugagaugacagaguagaugauauaucaguuucuuaaaccagaaguauagcauucaagucuucuaaguucauauacuuugauuucuuuaucaggaaaucgcauauaaauaauacaaaguucugucuucuuugugugauuagacaauacuggaaacauuugcuucuauucuagggaauaauuauauuuuauuuauaucuguacauacauaguauagcauaaggccuguagaagcaccccuuauagauguggauguucgcauguauuauuuguaguauguguguguauacauuuaucaugccuuuggugagaaauaauuauggcugcuucuagguaacaaugucaaugagugguguauuuccaauucaaaauauuuguacuuuuaacagcauuuaaaugaacauuguacugaaauuuguaugccucaugaugucuacaaggggcggaacacauugcuauuacucuaaaguugcucccaaguauacuguuuugucuuuauaaaucaacaugacugauaaacugucuauugcaaccaguauuauaugcucacauaccuuacuuuuuucuuuaauauaaugaacauuuaaaauaaugucuaaguuugcaaagguuugaggcaaguugaaaucaguaggaaaauauauugacuguaucuucaaacaaaaauuuguagaaauuuaaaaaguucuuaccagagaaaaaguucugaaaaaguaaaccaugaacucaacacagauguuugaaguccuagcgguucccuucaugugcguggauauacacuuaaccuuagagaauauggaaaagcuguugggaaaucaggguacgguaacguuucuagauuuuuucuuucuuuuuuuucccccguuucagcuaucuggaacagggcaagaaauuagcauuuguacaaagaaagucuuugaacaacacacacuuggcucaaguauuccucagacccagacuccaugcauuggacucuguguguacuaagugaucccagaguggcuuacuggagauugacaauggaaaaggacaauuugaaacacgcccguaggagaaaauggaaacauuguacaaauaacauaggaacacaaaauucacucuucuuuuuuuuuuuuuuuugagaugaagucucgcuuucguccccaggcuggagugcaauggugcgaucucggcucacugcaaccuccaccucccagguucaagcgauucuccugccucagccucucaaguagcugggauuacaggcgccugccaccacgcccggcuaauuuuuguauuuuuaguggagacgggguuucaccauguuggccaggcuggucucgaacuccugaccucagaugauccacccgccccagccucccaaagugcugggauuacaggcgugagccaccacgccagacucacaaaauggacucuuaaagcacuguguucaagauucccuguuuaggaaagauuuccacauuaaguccuggaaagauuuuuaguggaagccuaguuuguaaagggguuacauucccauuuucugccuuacugucuuuugcagaagacuuuauugccuacugacauguguaguaagauguuauuaguuauacuucguauaaucuguacuugagauuugcugcugaauauauugacuuucaguuuggguacuaaaagauccuuagauaugaauuucuuuucuagggccuggcacaguggcccacaccuguaauucuggcacuugggaggccgaagcagguggaucaccugaguuuagggguucgagaccagccuggccaacaaggcaaaaccccaucuccacuaaaaauacaaaaauuagucaggcgugguggcacaugccuguagucccaguuacucaggaggcugaggcaagagacucguuugaacccacgaggcggagguugcagugagcugagaucgugccacugcacuccagccugggcaacagagugagacuccaucucaaaaaaaaaaaaaaaaaaaaaaauuccuuucuaggucuuugcuccaaagucauuuuucauggaauauauuaaacauagcuuuugguuuuaaaaucucgauaauauuuggcugggcgcgguggcggcucacgccuguaaucccagcucuuugggaggcggaggcagguggaucaccugaguucagggguucgagaccagccuggccaacauagugaaacccugucucuacuaaaaauacaaaaauuagcugggcaugguggcacaugccuauagucccagcuacuugggagccugaugcaggagaauugcuugaaccugggaggcagagguuguggugagccaagaucaugccaccacacuccagcccggacaacagagcaagacuccaucugaaaaaauaauaauaauaaaaaauaaaaaaucgauaauauugacaauaaagauauuuucauugcagguacuuacuaaaagcaacauucaguguucugaacauaaguuacucuucuuuuuguggaacugugggaaaaggguaaaaggcuuuuuaggaaaacuguauacaaagguuuucacucugggccuuaauggauggagaucuuacaaugugaaucgagaaauaauagugguuaaauguguaaccuguuuuauugguagagauaacacaggcaaaaucuuuuuugcaggaagagauuuaggacucagugguuuuuugagucucuauuugaaaacuauugcagaggaaguaucacauuuauuagccuuuaguauuagauuuuauuaaacauucuuuucauucuuuuccauuuuuuuuucauuugcagcuuugaaauuuauuuuguguauugauaauuucaaacaauuuuuuuuuaaaguaguagcuuaagagacuugcugguucagaccccaggaaagguauuuaugagcaugaaagcuuagaagcaauuucuuuuuaaugacucacugggaagauuaaacuuugcuucuaggacuuguucuuucuucugagaaacauuuacauaggaaauugauuaaacauuguuuagagaugauaaagcuuaucaaaaguuaaguauaauuugauucagcaaauauuuuuuacugguuuuguggagaauccaaagaugaauaaucucuucuugcccuuuuguucauagacuaaauagaauugcuggaguggagauagaaauaauuagucuugaaaguagagaguaauguuuuuaaaaaauaauaauacagucacccaagaauuuggcagauauuuuugguucuauagaauguaguagcuguuuacuugauggccuacaucguuucuagugaaagauuagaaauaauguccuacuuuaguaaaaguaucuccguagcagcauuccuagucuguuagccaguauuauuuauauucaaggaucucaaacaacaacucuuauuaaggauaaguuacaguuuuagaagugcacaguagguaacuuuuaccuaaaaauaucuauauagaagaauaaauuuauuuuuggcuacuuuaugaaaagguaaaccuuuacgaguugggaggagaccuacuggucagggucaccaugugaagugcaaauuaaagggaagguuaucuaguacucauuccauacugggaaaaaaugaaaauagaggauuuuucuguuuugcuuacaaaaagaaaaggugaaauuccucauugacacuuuaacgucagugcgaacucccauuauaagaaagugaauccgaguguugucucguuaucaggagacggaagaauugguauuugauuucauuaacucuauuaaugacaggggauagucuucauaauguuuacugggaacccagaggagaaguagcaguaguuuaggagcccagagauuccaaaucucugcuaggauguagacuguaaguguaaccccugacaucgugaucccacccauucccucucuggguuuggcagaucagugcuuucuggcccugggagaaguccccucgcugccuuugaccagugcuaggggcucuaguaugucuuggcuuuccugaaguccaguccaguucuaccuaagacaauuuguuuaaacagaguuuaucccuguauaacuucagaauggacaauaacucauucgauuauuuucucuggaaguggcucaaaacaugguucucaccuaaaugcguauuaccagauuacucucagugguccugggcagggcaaagccaggcaaaagcccugcugcaggaggguccacagaagaauaaaaagcugacagccucacaagaaccuuuuaugccuucccuccuuuucuuuaaucagaauaacugaguuguuuucaagaugcauuagggaaaguguggcauuacagcaggaauagaagauagucucugcccuugaggaacuuuaaaagcuaguuaaggaggcaaaauacaacuauuugaagccuuccuaaagcaguauaugugcaagugcaaauugauagcucaacagaaauuucagugauggggauacagagaagugaaaugaucucuccuggucuguucagaggcuuucuagaaggagugagguaucggauuuuaaagaaagugauaaauauaaauugaggagagaaaggaauuucucuuuuguugcuuuuguuuuuguuuuuggcaaucagcuuccuuagguugaaugggcacaauauugaugguguuaucugguaaauaauuagaugcauuuacaaaugcuaauaauacuaaucuuugauauggaccuucuguuccaaguauaggaaaugugugacaaugaguuuuaauagaaagguuuuugauggaaaauuacuggcauagacguaaaaauaugaauuagugagcuaaaaucauccuccuacuuuaucucuuuucuuagauaucuaaaucauuuuccuaugaauuucuuuaauaaguguuuccuauuuuucucccuuuugauuuuuagaagcaaaucuaauaugagccuauuucagagacuaaauuucguaagucucaaaugaugggaaaaaucuaauuauuauugaauugcaugaaaauauuuuccucuugaaauaagagcccauuuugagcuucaaggacucuuaaguucuaagaguuuagauuagguugaaauaauuuauucuacuuuaaaaguuuggauuguuuagguucgcagaacaagauacaagauuuuaaguucuuugaggccagaaaccaagucuuauuugaguuuugcaaggcauuuaguacagguuacaccuucacuaauaaacagugacuuuaauucucaugauauuuuagcuuuaucagauauugauugaguugucuuuuagucaccaggaaggaaaccgauguguaaauuugcugcaauaaacuuuuaaaacauuaucuaaaauaacuauuuuaagauaaauauuuuaucagugauuuuuauucuuuuguuagaagaaucuauguagaacauuuuagggaaaggccuugguaugucuauugaauguguucagcagagcagagaaacuucccauuccauugugauagguucagaagucauucagaggggggaaaaaaaaggacaauuuucaguuuguugcugaggauuuuuaaaauggcuuacaaacauguuccacuaacccacugaaauucacuuacccugggggaaaggagcuaucguuaggugauaccugggaauuggcaauaccugaacagugcucaggaccccacaggccccacagaggcuggcacugccagguugugcucucuguuucagaucgucugggguucaaggcuugcugugaguccauuaagccauuccuuagcugaccuucgcaaguggcuuuagaaucuggaaaugaauuugaacaauauguauguguuccuuaaaucguucaaagagaguguauuaguguuugcuaauggaagauuuaagugagacauuaaggaaaaguggcagaccaggauucuuaauguggagcucaucguuuugcuucuaacucuacgggguuauugugaggaagcgagauaaugagaaguaccucgcucuggaguaugugcuccauggcugcuggugccugcucccuuuuccuuuuaccgguaauguuucugcuuaacauuuuuguaaaguauguuaaugacuuuaucagcguggauaguaugcauguuuaacuugaacauaguuuucaaagauuagagauucuagcaaaauacuccuguaauuuaaaaacagaaugagaaaacacauacuuugagauaaagugggagcuuguuuucugugcuguacaaacuugucacuuuuuucuuuuugccuuuggaaaguuucacguuaacagcaugagaacuuaaaaauacaguugauguugaaagagcuuaacuaaauauuuuaaauuggugguauuggaaagagauucuguaaaaauccaauuaaacuuuugaaagcucuauccuguugaaauauaacuuaaaggaagucaguuugguuucccagaaguacugugcauaguguuucuggcugaggaagaaaggcccaagucugcuguuuggccagaaauuggguaccaguuuccucuacgauguuuuacuugaacgguguugacacuugaacaaaucccauagaaacugccccaaguggggggauaguuguccuuacuuuuaugguaagacuuggccccaguaacuaacauuccagacacugguaguauucuuggcugaauacucuauagaugugcauaaauugagagcaaaaccccaaauguuuuagaaacuuuaauggcuaccguauuucaagcaaucaguaaaguaaacuuuaaaaaauacuggugcaguuuauugcuucauagccaauaaaaauagugaacaaaaagagucuagugucccuuguuucuuacauaaacucugaaaauucaguucugcuauuuaauuauuaaauucaaaagacuagaaugauuucuuuuaaaauugggagcacuauaggaauuuuuuuccuugucucagacaucagaaauaacuuuuucuuuccauuaaaugacaguaaaguauuuaaccaauauguuuguuucugugguuuauuuuucacagggaacaaaaacuaauaguacugugcaaaaauuuuuuuugugaucaauuuacaucuacaaaugugauagcuauauuuacuacugguguuaaaauauuucuauauaucagacauuuuaugugauuguaagugacagaacgugauuuauacuuuguuuuguaaauggcuugagugucuuagguuaaauuucugguuagaaucuacuaugaggggagaaaaaacuucuagaauugagauguucauuuuuaaaguggauugauaggaaccagaaagggaauuaaaacaaaaacugucugggucagaggcagaggagagaagagaggaaguauggcacagcaauccauaccaugggaaauguaggugaacucucaagggaaaaaaaauugggaccacuuucaugucgucuguuuuggcacuuucuucuuugucugagagucagagugguuaucaugacaacaaaaauauauuaaccacaaauuguagaaaucucaguugaugaggacagggucuuuuaaaguuuagacugacuugguuaauccuacaacuuccugaacaugauacugcuaaauuaggcagaaagguugugcaguuucuguuucgucagaacuaaacaaguguucaaagcaacucugagguuccucccuuucagaaggaaacauuuuuuuaagggaauuuaagaggugaaaaaguaucuauauaaaacucagcaguaagccaguaauacuuuaauauacaaauuuaucucacgaauucuuauaaaaaauucauagaaaauuauaaaaucauaaauguaggaacugcuaguuaaugcucacugaaagaacguuuuggcauuuauuccuacuggaauauaugaucuccaguaggauucuucacaaacagagaauuaagacuacauuaugaauauuuagugguuuugaaaguuaaacagcuggcaagcuuuggggagcauuaggaauaauauacauuacaggaugggagggaggaacauaccaacucaauacucaagggaagagaacugugaaagaauggaauggguagguugaacaauuucagacuuuuagauguauauuacacauguaagcuccaugaggccaacuguuuuuauuuuguuagccauuguaucacaaguauuugggacaguuccuggccuauaauagaugcuuggcgaauuguuuauggaaugaauuuuggguguaacacaugacaaagaaaaacuaaauacaagucaacaaaugucaguuuuuacaguuguuucauggucuuuuuuuuuuaccaaugugaaguuaucaguaccagacuauuuugcuucaaucugcaaaaggaaggugugugaaggugugugugacucucaaagagugaaugcccuaauaguccauuuuggaggccauguuuucaagugaacugauugaugagcugcaagcuucugucuggcuaauuuagaaacaucuaggaccaguuucugguuaagcaguugugguacaugaaauucaauguauaggugauucgugcaacagcuucugaauuuuuuccucccucacccaccuuacagccauuaguccuauaauaauuuaauuuggguuuguugguauagaaacuguauuugcacaauaaugauaaagccacucaggcucaucuagucauuuccuggauuuauguguguaggaguacauaaaaauaagggcacugauucguuuuguacuugucuaaaauuguuauucuucaguuguucaaagguacacaaaaugcuuuuuucuuuaugagguaaaaaauacuuggagguuauaagaaauaacucuuaacuagcuuacuuugaguggcuuugauauguauuuacucauaauggaauucaugagcuuuccuucuuucgcuuggccaagauuuuuuuuuucuuugaaauuccuucuccgguguuaucuaggauguuugcauuacaagcaggccgcuuuaccuccuuuguucguugucacaggugaaaagccauacaaguguaccugggaaggcugcgacuggagguucgcgcgaucggaugagcugacccgccacuaccggaagcacacaggcgccaagcccuuccagugcggggugugcaaccgcagcuucucgcgcucugaccaccuggcccugcauaugaagaggcaccagaacugagcacugcccgugugacccguuccagguccccugggcucccucaaaugacagaccuaacuauuccugu

SEQ ID NO: 21524 - RNA, 118041 nt, Homo sapiens
aaggaggaggacccggggagggaggcgcggcgcgggaggaggaggggcgcagccgcggagccaguggccccgcuuggacgcgcugcucuccagauacccccggagcuccagccgcgcggaucgcgcgcucccgccgcucugccccuaaacuucugccguagcucccuuucaagccagcgaauuuauuccuuaaaaccagaaacugaaccucggcacgggaaaggaguccgcggaggagcaaaaccacagcagagcaagaagagcuucagagagcagccuucccggagcaccaacuccgugucgggagugcagaaaccaacaagugagagggcgccgcguucccggggcgcagcugcgggcggcgggagcaggcgcaggaggaggaagcgagcgcccccgagccccgagcccgaguccccgagccugagccgcaaucgcugcgguacucugcuccggauucgugugcgcgggcugcgccgagcgcugggcaggaggcuucguuuugcccugguugcaagcagcggcugggagcagccggucccuggggaauaugcggcgcgcguggauccugcucaccuugggcuugguggccugcgugucggcggagucggugagugggccaggcggaggaugcgcgcgccguuuaggguguuugaagcuacgagaggagcccgcagggaauaggggagcgccaccuggggaacccccaguccccaaguauacaccggagauccgcugggacaaaugcgcucguccggucacccuuucccccucuucccuuccucagaaaagcgcugcucgcuggcguuaccccgcgguccgcgggaaugggggcaccgagaauugcgguuuggucuagccgcagaggccccugaagucacucccaacuucuucgcccucggcgggucuugcugcguggucugggaaggacggaggggaaaggguggcaggaggggggagccugggucgggcccgcgagggaacggcuccacuccgcgcgcuccucgagaccagggaugaccuggaaacuucggggucccuuccuccgcacaccaucccccccgcgccagcuuuccuguuugacugcaugcaaguucuggggagaugggggccagauuuaagagacccgcgaguguccagagagaaaaguuugcaaaaguucuuuuguuugaugcucccugcggcuagggcgagguaaccgacacuacguggaaucgcaguaggcgaucccucaaggggauacugggggaggcacggaacgcguccgaaaaugcugggacgccggccacuggauucccaguccugcggcgacccccuccucguugagggguggagguugcaccgcggggcgucagggacgggaggacauuuucauaggaguuacacgggagugccgcaagcagggcgaggcgggguacgugugacacggcgcucggcuucgggucgccuggccgcugggggacagaggcuucccucccgccacgcucgcccucucuggcccuggcggggcgcuucuggggccgggaggagucucgucuccggcggagcgccugccggcacccagcuucccucccccgcccuggcggugggaacuugauuucuccuuuuggucgcgcuucgggggcuggagcuuguuuccccacgucgcccaaugagcgcccucuaaagggaacugccuccuuggccuccucucguccgcagcugccuccaccugggcgccaggagcucugucgggccagguggaagcuugagcaccccagauuucgucugcagccucagugcccucuggggucucagggagugcggcuguuucuggcccuucugguuccccacguccucucccuuugccauuuaauaacgugucaauuucuaauuaauugaauggucuuuucaaagacaaauuauaucaucuuaaggucuuuuagguaguuuuaugaguuugagucucccucccccccuuuuuugugcugaggcuaauuuaggacugggaaaccucuuuggcaucgagcggcagauggacauuuuuaaucagugugggagccucugugugugcuagcagauccccauacguucuuugugguuggagagcauguagaauuggaaacuguacagacuacaugaguauuuugggugcucagguuguaaaauagaacucccagccuuaucaguguuucccuuuggcaaaugaugguuuaauccguugguauuaguuaucucccagccaguuaggaugaacuuuggcucuuuguacaccaaaaggcagcaguucucuuguuuauuucagaugagcguuguugcuccucuuguugcaaaacagggcaaagggacuucaucuaauaaauuucaagagccugccuaaaaaacugcacaugguuaaggaggcccuuuuuuuuugcugagucuuauucauggauuugcuaggaaauguuacuguuuugggauucuggagaaagaauguuucugucuucugcuccucuggguuuuugcauaaaucuaccagugcuccuuaaggaaguuuuuuggccgaacuauauaccuguccuccccggugacagcuuuccccugaacuguguaucuuugggguucuaauauuucucaauuugaaccagaacuggaugcuuuccgagugaacugcuucauugugauagacacuguuuucaguaauuggaaaaucauccaaaaagggugauuagauauuuauaaaaugucaacuuagagacuagcagagaaucuuuguuaggcagugagucagucuuucuaaauagaagcuguuucaaggcccagaauggcuaacaguccauuuaaauuacuuuucagucuccguuuguuucauguauagcagcaaaaauauaaaugaagucaaaagacugaauuuaaaaaaaaauuagcaauuacagaauauuauuuccaggacuuugcauuuuaauuugaaaacugcaacuguuuccugggauuuagaaguagugauuuggguuuaaagucucccuuuaaaggaagaaaggaaaacugccuacaguuagugaauucuuaaguuuuauacuuagcucuggggguaaaaaagagguucucaggaacuaaggcucaaaacugccuaugaaaaggaacugguagcuguuccuuuauggauccuggaggcagcugggaaagccuguuccuagugauccauucauacuuuccacuggcagguuaggacuuuggcugcggagcaccaggcaaggggaaaaucugacugaguguggcaguagugauaugcugcugguuuucuguccauuuuguacaugacuguuuaucuuuagaaauaauauauugcagacugcuauaaacacauaauuugaacuggaaauauguuuaagaaaaggaaguguuuugaacuagaggaauuuuauaaacauucuuagaugucuguaaauuaaaagaaacugucaagucauuugggcccaugcauuaucucucgguguauuaugaaaggcaggcucuggaaaguuugcauuagaaggguaacuaaaaucgaaaucauguaacuuugcaguucuuuagaaaauauaguuuggcuguuuuaugagugaaacaaauugcuuuugcuagggaauuuuauaaaaacaagggcucuuucucucuuaguuggguauuagcagaaggaggaugucauuuaagaaggaaagaucuugaaagaucaggcuugcagaaaauggaugucugagaagcaauuugagcaugcccuucagcuucugcuuuuaggaccugauaugucuaguuuugaugguaaccacccuucgagggguagccuacccuguguaauaugaucacuuaaauggcgccuuggauaaucauuaguuuggaaaggauuucaaaaggugaacugguuuguucccuggguggaacuaguuuucaagucuccaaaagcccccagagaccugacuggccagcuagagguggcuuggagucuccuuagguuggcaaggccccugaagcugacccagucacacagagccccaccagcccugucauuaagguuuauagcaaguccagucaagccacugugcuguuggcauaccugcugguggggauccaguuguccugugaggaaugccaucuggguuuagauucucacuagauuguccuucuuccauugccaaaaaucaaacuaaaagauuuugcccauccuuuucuucuucccaaggcagaagggugcauugcagaaucuccaaaccacugaauucuuuucguggacuagaggccaaaauaaagucuuagagaaaagccagaaguaaugaagaagaaucuuugcuaaaaccaaucuacucuuauuuaacuuuuuuagucaacugugacaguacuaucauuuucauucuaaucauuuggauuuaaaucuugaagaagcccuggacucauucaucuuuguugguuuccacguccagucugccucuaaguccagcugugcauucauucugcagauauuuauuucauaccuacuaggugcuugagguaaagcagugagcaaaccaggcagauaucccccugccuucuuggagcuugcauucuagugaucuuuccguucauuuuuucaugccuucaguggccagcguggaacuuccucaggagugccaaccggccccagaaugcccuggcccaugggaaccugcacuuaaagaugcagcaccaacagguguuuacccagcuccugaccugagcucagcacugcaaagaagucgggguuuggaaauguggucccuuccugcagcgcuaaucuuuuuuuuuuuuccucuugagauggagucucacucugucacccaggcuggaguacaauggcacucugcaaccaccaccucacugcagccaccucacugcaaccaccaccucccagguucaagcgauucuccugccucagccucccgaguagcugggacuacaggcacaugccacugcaccuggcuaaauuuuguauuuuuaguagggaugggguuucaacguguuggccaggcuggucuccaacuccugaccucagcugauccaccgccucggccacccaaagugcugggauuauagacgugagccacuaugccuggccauuggucucuuccugcagcacuaaucuugaugggacagaaaauuucaaaugaagagcuuucccucuuuuuuucuuccuugggggcaugccagcuugugcuucuaugucaguagccuuguaguugccauuccuggcccagacacuugcaugcaguuugguuuguccuccaccacuuugaucauguugcccauggucuagacaccuccguguccuuguuaucauggcauauagucuguaugccucugcuggauuuauaagcggccccauaauagccuuccuuucugguuacccccuugaucacuuuccaccacaucucccagcccuggcccauugauaucacuaucaugaacacucccuggacauugcuacuuuuucaguguuucuccuuuuaaaugcuauugauuaaaugcaagcuccaaauaccuuuucauggcugauccagcccuguuguuuuuaauccuucuguaaauagcaaggcauacugaugaucagaaucauugaaaguaugugaaaauacagauuucaggccuccucucagacuuacacaaucagaaaccugaaugggggugggagugugggggaaacuguauuuuuauaaagcgacugagaugauucuaaugaaucagacuaauuugggaaucgcuggucuagaucacagcauuaccccuuaauuaugugcuauucuauguuacuacuagaguuuucagcaguagcugggcuuagaauacaaagggcuugggcuugggagguggacaagucuggguucagaugcugguaccuugccacuuaaugugucagaacuuggacaguauauuaaagcucugagucacuuaaaaaaguguguguguguaaauuggaccuaagaaugccuuuauaacaugacuguugugaagaugaaaugaagggagcauaugaauggugcuugaggcacggaagauaggacauuuuuuuuucuuccuuuccucucuuggccuuuuuuuuuuuggcaaugaaaugaaugaaaugagggagccaugucagauguucuuaccucucugacauucuaaauaggugaauuuucucucccaucaagguuagugcuauaggaagaaaccauguuuccaaaucuccuacuccugugcagugcugagcuggguaaacaucuguugacacugcaugcugaagugcagauacccgugggccuggacauuuugggguugguuggcacuccugaagaaguuucacgcuggccacugaaggcauuaugguucagggucaacugaauacaccagcccccaguggaccugggcuaguuguccaguuuugaugccucugcacucagugucaucagcauugcaggguuggugucaagaauaaagaagacauugauguaacgucuugacacaucagcugugcacagucacaccuccuccucuucccugaggcugugcugagauuccagcacaugggaaggagagaguuagaauuuagucuguaucaugcguugguaugccguuggucauuuagaaugagguggcagggguagugaguauauuuuggggaucugggggcagaaaagggauuauuuuuauuuuuuaaguguggaaauguggccuggcgcgauaucucaugccuguaaucccagcacuuugggaggccgaggugggccaaucaccugaggucaggaauucgagaccagccuggccaacauggugaaaccccgucucuacuaaaaauauaaaaauuagccgggcguggugaugggcaccuauaaucccagcuacuugggaggcugaggcaggagaauugcuugaacacaggagacggagguugcaaugagccgagaucaugccauggcacugcagccugggcgacagagugagacuccaucucaaaaaaaaaaaaaaaaaaaagaguggaaaugcauuaaauuucuucuuuuagccauugggcuuuaggucuuacuauuaaaaaucucaacugcauuuugauaagucuguuucuaggcagcauuagcuuuagcaacaaggauggaggggugaaugccucugaaugggagaggacacuguugaaauagaauugugaaugucuguuuuucucaaguaucucaaagaauugguaggagugggagaagagagaagccuugaaaucuuuggagauuuuccauuugcauuucacaucagcagagugaagccaaugaguaugcagcugguggcgugauagccaaugcauagucuuggaaaaauggaaaaauguuauuaaagacauguuuucacaguuuuuuucucuacuauucagucuauuuugugaaaaaugucacaaagacucaguaaguaugcucucuacaaagcauuuugguguuuuuuuuuaugauuacacagguauauuaaauacaaguaaccgugauguuuaaggagugugugcaauuaauagaauuuagucucaugguauaagaaugacacacgggacaagauacgcaauuauuaaaggaaaauuuuuuuuaagggaaaaguuaaauacguauuucuuuuuuuuuuuuuuuuuuuuuuuuuuuuugagacagagucucacuccgucgcccaggcuggagugcaguggcauaaaugaggcucacugcaaccuccuccccccguucaagugaaucuccugccucaaccucccgaguagcugggauuacagugcacaccaccacgccuggcuauucuuuuuuuguauuuuuaguagagacgggauuucaccauguuggccaggcuggucuugaacucuugaccucaacugauccgccugccucagccucccaaagugcugggauugcagacgugagccacugcaaccagcugaguuaaguauguauuuauguguaauuuguuauuaaauauaaauacaguagacuaaauauacaacauuuuaagucaaggcaaaagcaagguuuuauacacauguaauuaacugucuuaaucccugugagaccucaguuuucucaucucuaaaaugauggaguugaacgagaaaaacucucucuccuuaauauuuacuuuuucugcacuuuagggugugguaggagaaaugugaagauuaacuuaauaaguaauuauuaauccccugucaaauacuucuaauuuuauuauugaaacauggaauuuauucaccuuacagaaaggcaaguaauuucuaauagcucaugguaaccuguuaccuugaacugaguguucauuguuuacuaggagugguauacauuguccugcguauucgugaucuaaugucuauuuguauuagucuguucucacucugcuaauaaagacauacccaagacuagguaauuuauaaaggaaagauguuugauggacucacaguuccacauggcuggggagaccucacaaucaugguggaaggcaaaggagaagcaaaggcacguccuacaugguggcaggcaagagagcuuguacaggggaacucccauuuaugaaaccaccagaucuugugagacuuacuaccacaagaaaaguauaggggaaaccgcccccauguuucaguuaucuccaccuggccccgcccuugaaauauggggauuauuacaguucaaggugagauuugggugaacacacagccaaaccauaucacuaguauuuuuuuauauauuuucugauacaagccaguguaacauaaagaacagcugcgugguaaaaauaacuuucauucuagauagaagacuacaugacuugauauacugggggucuuuuuaaacuauaaaucucauaaaguguuuuagucuccucauaugguuucuggccuggaucuccauuuccagaguggggcuuuuaacuggugccuuccguuuggucccucucuagagcacuugagccuggucugaguacugugcagaccacaagcaagaaucuaaaugagcagacuaugguaguguugccuggguuuggauacacuuauuauguaaccuugggcaaguuuuuuaaccuucugggcucaguuuucucaucuguaaaacugaauauccuaaaauaaguuuuuaggauuaugugagacacaauaaguagggacuuuuuagcauaagggaauguccaugcguugugucacaugcuaguuauaauuccuggcuuucugcuucucugaagaauaagggcuuggcacacacauuaguugggcucaucugauaagcucuagcccagaggguggcucagcauaugcaugcuaaggccuacuuuuucauaacaggggcuuucuucuugucuugggguagacuaguucuacgcugagauauugggaauauguuuguagucagcuuuucucuaaaaguggaugaugugagaaaauaugccauuuauuauuucuggcugaugaaagguuccuuacagggacaggacaaauccguguuaagaugugaaaagcucaucuuucccaguaauuuuaccuccacaaaucuguccaaaggaaaucauuaccagguaaauaguauuuaaugucuuuguugaagucucuuacuuauaauaguuaaaaaaauggaaacaacccaaguguacaauaauagaguaauuguuaaauaagauucuaauuuagacacugaauaucauguggccauuaaagauuuauuugaaggguauuuauaacuuagaaacuauaguacacaaaaaguuagauauaaaccuauguauagugagaccuugguuauauuuuaaaagguguguguguguauaaagauaauguauauauacaaauccauacaugucauagaacuguguagauacacauacacaaacauacacagcaugaauacagguaaaacuaggaaaaucagaauaagauugguagauuguaucaauaucaauaucauuguugugauguuuacuguaguuuuauaaauguuaccauuggcggaaacuaggaaggggcacaagagaucuuuguauuauuucuuacacugugugugagucuauaguuaucucaacaaaaauuucaaucaaaaaauggcaccagagcuagauuguuguuuaaguaaguucugcugauccuucagagaaagauauguuauaaagcucagagaaugauagaaggcuguucuuucucauuuuaggagguuagcaucacucuaugucaaaaccagacaagaagagcagaaaaaacaaaccuauaggccaaugucaucuauauuagaugucaaaauuuuaaauagaguauuauuaaauugaauacagcaguuuauuaaaagaauaaugaugagcccaauugggauuuuuccaaggacaguuucaacaucagaaaagcaaugcagguauuaacaguuuaagggagauaacaauaugaucaucucaacagaugcagaaaaagcaucugaccaaaguacaugugaaaguauuaauauaaagguucccaaauucugguuaacugaaggcauauuauauuuggcuaguacaucugugcuucggacucaauucacuugacauguuuaggaaccaaaaggccucuguuuacaaaguuguuaggcaacagucucuaguugcaugagugacaggugugugacaacccaauaaaggaugggccaugacauauauagauucuaauucauauggaguuguucuagcauugcccagguucacuguguacucucccaaauuaagaaaaugcaagagaugguuuugaauguuuuagaaucagauaaauugggguucaguuucugguauuaccacuuaaaagccaugagaagucucuuaucaucuccaugcuuguuucuucagugugaaacugggauuagaauauuuugcuuuuugguuauuuugaagauuagccucaauaaugacuaaaaucuucuaacacaaagcuugacccauaguaggugauuuaaaccuguugguuucucuuuucuuccaucuuuaaguuuugugauucugcaguauauuauauguuuauguauaaauauauacgcauauguuuuguguuucucacuugcauccugacucuuaacacuaugggacauauauuuucacaaauuuagaacugguuuuuauuuuuauuuuguauuuuuuuugugugugugagcaacaaggcuguuuauuucaccugagugcaggcaggcugaguccgaaaagagagucagcgaagggagauagggguggggccguuuuauaagauuuggguagguaaaggaaaauuacaguuaaaggggggcuguucucuggcagacaggugugggggucacaaggugcucaguaggggagcuuuugagccaggaugagccaggagaaggaauuucacaagauaaugucaucaguuaaagcaggaacaggccauuuucacuucuuuugugguggaaugucaucauaaaacugguuuauuuuuagucacgcaaguuaugaugcuuaauuauauuuuguauuuccccugucacccauauuuccugaauaauacuuagcuaaaacuugcauacaaguuggaaauuuaguuaagacuggaaaaucuuugguaguacuuggauuauaauuaaaauacuuaaagaaggucagcaucggaacccuaauuauuuuuauuauuuuuauuuuuuuuugagacagggucucgcucugucgcccaggcuggagugcaguggugcgaucucggcucacugcagccucugccucccagguucaagccauucuccugccucagccuucugaguagcugggacuacaggugcaccaccacacgcagcuacuuuuuguauuuuuaguagagacaggguuucaccauguuggccaggauggucucaaucuccugaccucgugaucucccugccuuggccucccaaagugcugggauuacaggcauaagccaccgcgcccggccuggaacccuacauuuuaaacacuguuuuauauaaauuuacuaaugaauuaaaaucuuaacuuuauuuaugucccacuucugaacucgcuuaaauaagaaugguguuuugauuugauuauuagauuugauuagguauugugauuaugcugauuaguuauugaauuaaguuuuguacucgauaaaucaguuuaacaauggacacacguuacuauaagccaacaaaggacaaagcucuauguugguccugcaaguuaaaaagaaauuaugacaugguacucaccuucaaguaacuacugucuaccuuaugauuauuuagagaauugaaaaugaguugggccagcacuuaaaauauguguuauauguaaaauaugcaucaguuuauguugaaucuaguucggcauuuguacaaucaaaauugccaaaaaaccacaauggagaauaagaagaaccccuuguagaagagaagucacuggucuccuggaaaagcaaaacuuuccuaaaaccuuccuugaaguggcacaguauguuggagaaaaaggagaauucuguugaugacuuggagacacuugauuuucauauguuucucuuuuucccaaucuucucuucaaagaaagacuuccaagugguaaaauguacaaaagguagaaagaguaagaaauuguuuagaaccugaaugaucuguugauauuucuaucaggggagaaaguaaccuuauauuucaaccagucuugauucuccauauucuauaaucuuuggggucuuaaaagugagagcugggccuuuguauauaucauauguaaucggguaaaaaguauacauuuauaauauauacuuauauauuauacacaucauauauuauauacauuacauauauguauccggugaaaacuuauaagagacggagucucauucuguugcccaggcugcagugcaguggugugauuauggcucacugcaaccucgaucuccugggcucaaggcauuuuacuaccucagccuccugaguagcuaggacuacaggcaccaguccuggcugaguuuuuguuguuguuguucacaugggguuucacuauguggcccaggcuguggaccuuauaguagguguucaguuagaucaaauagccuuagcuggccgggcacgguggcucacgccuguaaucccagcacuuugggaggcugagguagguggaucaugaggucaggagauccagaccauccuggauaacaaaaugaaacugucucuacuaaaaauacaaaaaauuagcugggugugguggcgggcgccuguagucccagcuacucgggaggcugaggugggaguauggcgugaacccgagagguggagauugcggugagccgagaucacgccaccgcacuccagccugggcaacagagcgagacucugucucaggaaaaaaaaaaaaaaaaaaaagauagcuaaguaaucaaagagguauaaaaguguugggauaauucucacuguauucuuuuggauuuugcuuuuuuaguuuuuguaacaacggauuuuagagcuggaauggacuuuuaaaaggaaacacauccagagagguuaagugauuuauccaagauuaccuagguaauuaguggcagaguuguaaauuuagccuacgcuguuuuauuaguguauuuucuuauaaaacauuccuuuucuggcugcuucuacucccucauuccccacauuaaugauuagcaccuaaugcacuuauuucuggcacauguuugacaaauaaaugaaauaccaugaaacauacauuuuacguuauacauuuagcaucagugugguuaguggguuuugugcagaauccuuugguguuuagauacuuuuucuauuuccagcaaaacugugcuccaacuaauuccuuuacuugcuggugaaacuucaggcuaauuaugggaagacaguugagaggacugagauuuggaagacccagagacugaaauagaguugauuuguaagucuuaggaagauuguggagauuuauagauagaaaaggagauaaaagcuuccuggagauaagaaucgggaccagaagcaaaauccucaugaauuaauacugcauuuucugggggaaagaaggcugcuauuguaguuaagagaaaacgaacauuccuuggauuuuuaugcuaaaaauaugucagugccuuccaggagagagucugaugcacuuacagcccagguagaagugcuuuuuuacccaauuccuuuugccaaucuuagauguaggcuccucuuuucucccaagaguuuccucuugaauauuggccggcugugguggcucacgccuguaaucccagcacuuugggaggcagaggcggguggaucacgaggucaggaguucaagaccagccuggccaacauggugaaacccugucucuacuaaaaauacaaaaauaggccaggcgcgguggcucaugccuguaaucccagcacuuugggaggccgaggcggguggaucacgaggccaggagaucaagaccaucuuggcuaacacagugaaacgccaucucuacuaaaaauacaaaaaauuagccgggcaugggggcgggcgccuguggucccagcuacuugggagguugaggcaggagaauggcaugaacccgggaggcggagcuugcagugagcagagaucgcgccacugcacuccagccugggcaacagagugagacuccgucucaaauaauaauaauaauaauaauaauaauaauaauaauaauaauaauaauuagccggguguggucgcgggcaccuguacucccagcuccucaggaggcugaggcggcagaauggcuuuaacacaggaggcggaggucgcagugagcagagauugagccacugcacuccagccugggugacagagcaagacuccaucucaaaaaaaagaaaaaaaaagauuauugguuuauaaauuuuaucauaacacaaauguauuugagucaagcuuuuucagaaaaauaagucugugagauauuuuuaaggaaagaauuuuauuaaaaggcaguaacauuaaaaauuaccauuaccacagccuucuccuacuauagauaggcauuuuccauucauugucuauaacugucucacaacugcuaggcgguauuacuugccaaggcugcauuuuauguggcccagcacaaguuagagccucaguuuuucuagcuuuaaauagucuuucuaugauacuguaaucuuucaagagagcagugaaagugucuaacuguaucaccaacuguuuaauguaguccaauggguacaacccuggaucaugaagugucuaaugguugcagccucaaaucaugaaguaucuaauggaugguugcagccccgaaucaugaagugucagaaucuuccuuuucauugguuggccuaaucuuccaggucacugauauucugauuucuuuaccaacuuuuagcauauugcuuuaauggcuucucucugcaaacuucagucugguaaugggagaacuaagagguagaauuaauggaaccucucuaaaucucagcucugccaauuucuggacuugggcaggugauuuaaccucucuaugcuuccauuuucacaucuguauaaaggagauuagucauaguagccaccucauagagguguugugagggcuaaugccuuaauuaaugggugucaagcaguaauaagagugcgcaggauagagccugcgcuagacucucaguguugaugaugauugaaauggacagcuaauuggauguacugaccaaagaagacagugucaauagucuuuugagguuuugaacaugaggcagagaagacugauggugccacugaccagaucaggaggacagaccgauuuuuuuccucuucuuuuuguggcucuuguguuuuggugaaaggaggaggcauuuugguuucucuagguuuuccaucuggguaguggagggcauauucuccaucacggguuuucagcccuugcugccgauuacauaaacuuggggagcuuuuaaaaacuauucaugccuuggccccacuccagacaauuaaaucaaaaucuaugugguugggguccagcucccugugaaagcuuauucucacuuccagaaggcuugagaaccuugcucuagaggacuucuuagucuccaguuuagagagcagccuagcagguaagauuuuguauucuuaacguaugcuuucuacugcugugauuaagccccauguaaugagguggcuuuccaggacucaucugcugccugucacagucuaagcaguguggaauugggaaauccuugcucccuuccagcuuuuuccuuuucuccagugucuuuucugcuggaucauacuuuuuucuuuugacuauuauuuugguggauuuggaaacauucgagaggucuuuagacagaagacugcauagcuauaaaguaaguuuaucugaggaugucuuuuaaaaaaaugcacacauugcccuuccugaaggaaaacuuuuccuaguggagcaagggacacucguccucuuggucugguuacagaaaagcauguuuggccagcuuauuagauuugccugaguucauacuuugaacagaaaaauugcauguuuuacugauuggaaauacauucugggacuugauugaauauacugaucauguauagguccuacauaggugucuuaauaauggucuucuuaccguaccugcacuuaaguucagcaauuuggaccugguucaagucgcuucaauuccauggagcuguauuguuugcagcugaaauaggaagagagagugcuuuaggcugucuugugagcaagacaucugaguugucuuuaguucaugcuuaagcacaaaagcagcagcccaucaucuaaucuauucauaguuuacuuuguucggguaucuaauuugggagcaugcuugcccucacucacuucuaaaacacacaauuugaauaaaagggucuaucuuuaauugacucagggaacaaaaccuuguugaagaauucuggauuucucaaagcuuuuaaaaauugcucugcaggauaacauuacaaugcugacccuacugccacucaacauguaucuguccuacaauggaguuggaggagggauuauucugagaaggcuauuaaaaugaaccauuuacuaugauucauaggcuuuuaaacccaguaagucuguaauaucuagaguaaaauucaacaucaguuuauuauuuuggugaugaugggguuaaagugucuuuacaaaguauuaagcaugcacagagaaaaugcaaaugugaauucucuucguucuccccguuaggaguguaugccugauagauaaauguuccagagcauucauguaauacaauuaguagauauaagugcuuuuucucaguggaaauugaggucuguuacaaggaguaacagauuaggccagugguucucgaaguagggacuaaucagcagcaucuacagcuccucggaccuuguuagaaauggagauucugggccucucugcagacuaagcaaucagaaacuuugcagguagggcccagcagucuugagcuuuaaaaagcccuucaggggauccuucugcaugcuaacguucgagaaccucugagcuacgguucucaccuugacagcacagacacuauugagagucccugguuguggggcacgggugucaguauuuuuguuucuuaagcugccuuggugauuccaguguucagucaggauuagaggcugcugcucuaggaccuugcuacccaaaaugagggucccagaccagcagugugggcaucaccugggagcucuuuagaaauccaggcuaucaaaccccaccugagacuuacugaaucguauuuaaguuuaacaagauucccagugacucauaagcacauuaaaguuugugaaacacugauuuauagaaauagugaguuuccuuuguagaagccagcccuuagaacgcccuuaauuuaaaaguuuugugaggagguagaacagcuguuuuggcuucugccuggcagugacucagggaagcaaucacugggggcaaggcaaggcuccgaaagcugugaaggacccaggaccauuucaucgagugagugcuggugcaaguaaugaaaaucccaacucagauuggcuuaagcaauggaaacuuuuugguucagauaauggaagaguucaggaguaguucuguuuucagaucuggcugcaucaagaggcuuaugugauuuuuuuuuuuuuuuuuuaaucagccucaaggcuuacguaacucucagcucaaccuuacuuuguuagauucacuuucagguuuuacagaauuagaguaacagcuaagcuguuguuaaaaagagauuccuaaacauaguggcuuaaaguagauuuauuucuguuugacacaacagucccaagacaggucuggugggauagcucugcugugcucacacgcaguucuuaccugcugguccaagguggccaguccauccauacugucucccagccaggagacagagucaagggggagaacauacccauuccuuuuaaugccacagccuggagggguaacaugucacuuacacuuauaucccacuauuugcagcauagucacguggucacacaagguacuaugcgggcugggaaauguagucucuacauggguggccacgugcccaacuaaaaucuggggauguuuuguuacuaaaaagggaagacuuuagguauugaugacaaccaggagcgacuucuccucuggugguggcaagauggagucuggcaacuucaaguuaacagccuguccugucagcaguuucaguagaaagcacuacucuuuccuaguucuuccaguaagaaucccagaauagcuuccuaguuccuuaauuucugggaacuacacaugaagaaguguccccagaaucccguggacugugauagaaaaggauugguucccccaaagagaacuguuuaauagcaggcuuagaacagagagaccuuuaccucacuccuuugugaauuggcauuuagacccagacaagaaaggaaaguggagaacaugggggugcucaagccagaugugggggcauugggggcuauuuacugucgaguuagucaagcauggaauauuugaagauuauuagcacgugacauaaaggguauuuaggaauaaauguguuugcugaguuuaauaaacauaggagacuguaacaguguacuuuugaucuucugaucucuuauuuuagugguugguaaauaagaguaaaagaaaauauaaacuuugacaaaugcuuuuaagaauguuuuaaauuauuuaaucuuuaauugcuaaagauuauguaaauagaagccuuuagugcaucaaacgaugaguguuggagagaugaugaauugaacuuguguuuaccgucuccuucucaagguuuuguuuucuuaguauguuuuuuauacuuuauacuuaguacuuuuuuauacuuuauucauuacacaaaggauuugagguaauuuccaagacuaaggccuuucucgcaagcuuuagaagaaaauucuaaaagcauacuacauccugcuuuuaaaaaaaguugugacagucuuacaugauagaaaaauaauauaucauauucaaaauaacaugguauuuccaagguucucaacugcuuauuguccuuuuaaugaaaauguggauuguaggcacaucugcuauaaaugaauuaaaauuucauuugcccagaacuuuguguauuccauuaauaagauuuacccaaaacacuauuguugguuuaauaaauauuaagagagucuuugggaugugccuccuggcguuuguuguuucucuccuuugagcauuaacuacccuucugagccuucacaggcugcuuuuguuguuuugugccuugagauauaaauagaggcagaaaacccagaagaugcaaacagauuuaauacuauaaacuauuuacagauguguuuaguauucauucaauagaaccuuuuaguuuauugaauauaaaccagcuuuagcauucuacaugugccagggguucuguuuuuucuuuuauuggaaauuuuaaaaacgacaaaaacaucuuuugguaguaucaucaucuaauaagcaugagaaagauguaacgucaugacuugcaccugacccuuugucuucuuggaucuuacauacuuuuggacaaccaagagugaaaaggguggaaacuuccgaucucgacugaguaaaaggaaagccuuucuaagaggcagucaaagauggaacaggcuacuuaagcaggaggcaggacccauaccuggagcuaagcugguguuuguuuggauggcuguuuacugaggaucuuuagaggagauucaagccaucaacuggcuggggagagucgcugaccuuuauagcuuccuucuaaccuuagaagauucuguacgacauuuuaaaggugagugcugagcaacuuaaacuauauuuuauuuccuuuccugauaacuuggucugacugagacuagacaucuuuuguugccuauaguugaaggagucuggcauucuaggaccaacuugcuguuaaacugauggcaagaucucuauuugccaaaguuaggggacuguguauguaaccauugaaaucuaacauuaccucaaacuucaagggacucugacagguacuuuaaccaguuagaauggcacacuugacuaucugguuugagucagagcagugagugccugggagaaaacagcaaacucaagacaccaugaguggacuuuagggagagggaagagagacagagggcccacaggccagcacgaagaauguaaagggaaaguagccacugucccaaccugccagggguuugggaggcacuguuaauuucccaagcauucacuuauccgcacuuugaccaggcaacccuucuucggcuggacagggacacucaugcuggaccuugaucacccaugacccaugugucauagugcagagcuuuccuucugaggcuuaagugaccagugugacaagaacccugaaacaccuaauguacagaaggacucuagguccaugguccccaaccuuucuggcaccagggacugguuucaugggagacaguuuuuccacagguguuaggggggaugguuuugggaugaaacuguuccaucuuggaucaucaggcaucagacuccuuucacaaggagugugcaaacuagauuccucgccuguguaauucacagggguuugcauuccuaggggaaucuaaugcugccacugaucugacaggaggcggagugcaggcgguaaugagauuggauggcuacucaccugcuguggggcuggguuccuaacaggccauggaccaguacuggucuguggccccgggggucggggaaucccugcucuagucaugaaccauuugucucccucuugauuuuuccugugcuagcgcucacuuccauguuuccuucuuuauucuggguaaagcaagagaaugcuggacagguagccagaagacuuggguucuuauaggcuggccuuucucugccaguuaccagcugugaccucuggcaaaucacucaaccucuuuuaccucaguuucccuuuuuguaaaaccagcuagucucugcagucaaaccuucaauaguucuauaauggcuaugcuuuucuuaaggagucgcuuuuucccccuacuuucuacuuacugccuugcaaugaaguuuuuaaaauuccaguccagacuuuaacacuguguucuauucuccucucuucuccuuuggcagccaacuaaauugguuacaguugucauuuagaaugcgguaaucuuucaugacuaaccauuuccucucuuagagaugccacuucaucuagcugcuguagcucggauuucuuccucacagauaagaggauggagguugcucuugauaugggaaauagaaggauggagguugcucuugauaugggaaauagaagucggaguaggagguaaaguuccacuguagagggaaaauguccaccuguuagagacaggaaacaacuggggugcgaagggccagcuguccguguucuguggaugaaaauucccagcagauuuuuucuguauuuuuggcucugaauauuauacacugaacauagagucuuguccuggaaucugauaguuuucuuaaacacuggacaagugaauauacuccaaaaagaucaugaggccacggguauuguauucugaggucccgagaaguugaugaaucuucucucccaaaggcggauauuuuuaccagugugagcuacccagaaaauuuuaaauuugaaaaucucccaaaugcccaugauuuugauggcaagaauuauuagaggcagguggaaaauacugcccaacugugaucaugacacuuucaccaacuuacggcucccuagcccugggacuggccaaagaacccaguguugggcuggaaggggagcccuuccaggcugauggaucucuuugccccaaguacuguugucacacugccgguguucgaaucaccuuggggauugggguuauuuguuaaaaaugcacauucuugcaucccaucucagacccugcauuugaauguagcugaaacauacugaaguuacagaaucauugcuuuuggcugaaaaccuagaaagcuugcaauggcuuucuguggaccccaccucucugcuuaaccuuuuuggguuuuuaguucgggaucuaaggcccuccccucucuaaaaugcaaaaugugacacugagcuaaagaucaaaacauagcaagcguuaucuagaaauuauuccuuuaaaaauaguuuauuuagccaugcaauaggauaacugucaaacaauauuuuaugcuacuuagaguuguacauauagguacauaacauugaauagcuuuguugaaguauaauguaccugccacaaaaauucacccauuuaaagcguaguuuuuaguguauucacacaauugugcaacagugaccacaaucuaacuugagaauauuuuaaucacccccccaccucaaaaaaaaaaaccuguacccauuugcagucacuuuucauuccacucacuucaaggccuaggcaaccacuagucucccuucugucucuguagauuugccuauuguggacauuuuauguaaguggaaucauguaauauauggccuuuugugauuaacuucuuucaguuagcauguuuucaagguucauucauguuguagcacuaguacuucaucucucuuuauugccaaauaaauauuuauugugcauugcauauagucauacccccuuuuccauuuguuaguugguggacauuuggguuguuucaaccuuuuggcuauuaggaguaaugccgccauaagcauuuguguccaaguguacaaguuucauggggcuauauguucauauauuuccauuucuccugaguauauauaccuacgaguggaauuucugggugauaugguaacucuguauaacauuucaagaaacugccacacuguuuugcaagguagcuguaccauuuuacauucccaccagcagugcacaggguuccaguuuuuccacauccucaucaauauuuauuauugucuguccuuuugauuacaaucccuauuggguaugaagugguaucuuauugugguucugguuuucauuuucuuacugacugaugauguugagcaagauguguuuuuguguucuuagccauuuguauuuacucugugaagaaaugucuauucagaugucuauucuguggguugucuuuucauucucuuaauaguguccuuugaagcacacaaguuuuagauguuuaugaagucaaacuuaucaguuuuuuucuuuuguugcuuauguuuuugguaucauauauaagaaacacugccuaacugaaaauuggaaacaucuauuccuauuuucuuccaagaguuuuaugguuuuaguucuuacauuuagaucuaaaaucuauuuugaauuaguuuuugcauauguugugggguugggguacaguuuauuuucuucuuuaugcaugugguauccaguugucccaacacuuucuuagaaagucuuauucuuuccccguugaauucuuggcacacuuguugaaaauauauugaccauaaauguagggguuuauuucugcacucucaauucuguuccuuuuaucuguaugauuuauaugaaguacuauauguacauauuuuuguauguauauaugugugugcauaaauacacacguuugugugugugcauguguguguguguguguguguguguguguguauauauauaugcacacaugaaucuuaaaauuguuuuuccuguggccuuaauuuaggugauuagggaaauggacaagucaauagguaggaauuaaagacguuaacuacaccaggagacuugaccaugaagucccuccugccucagcugagcuaauuuaacagggauacaaagagccgcagaacgauugguuugcuguugguuuuuuucuuuuucucucccucccugaaauggaaugccuuucagaauguuuuggaguggggugcauuuuagauaucucuaguccuuggccuagcccugacagugaggucuuggcuaagauacuuaaugaguucugaaugccccuguccucacccuuaagcagcugauuuuucgaaguuuuguuucgcuucaugguauaaaaagccuagucaugugaucuuuguaauguuucuugguuauuuuaauuuuuaaugguaaaaaaugccugacagaaaaaaaaagaaaaacccaagacuuuccugugacacggugcacuucugccuuguggaccuaguuggagagacugccuuaccuugagagguuuuuuuuuuuuuuuuugagacagagucucucucugucacgcaggcuggagugcaguggcgcgaucucggcccacugcaagcuccgccucccagguucacgucauucuccugccucagccucccaaguagcugggacuacagacgcccgccaccaggcccggcuaauuuuuguauuuuuaguagagacagguuucaccauguuggccagauggucuugauuucuugaccucgugauccgcccgccucggccucccaaaguggugggauuacaggcgugagccaccgugccuggccuaccuugagagcuuuuaacuacagauaaagagcugaaacuucuugugaaaaugucuuaauuuuauucuuggguccgugggaauuuagaacuauaggcuuuuaauuguucacagcuggugcaugaauagagugguaauaauaauuaggaauaauaugguucaccuccuaagcuguuaguuuuaauccguuaaauuuuuuugaacugacgucuggcacagucuucaagugagaccauuuggaggagguccauccuagguuucagucaagaagugugcaugucugucuuguccugcuaauuuguuacagugauuucuaugguuugauuuuaauguuuuucaucuaaaaacacacaugcaaauccagccuacgcucaacaaaauccauccagacacucccacuacagagcccuugcgugacaauuuucuguaucuaaguuagagggagcuugcagccucuccuacaucccucugcggugggaggagccuugcuaggggagagaggggguuugcucuaagucucuuguaaauggaggccgacccagagugcccagagugcagugcuuccuguaauuccccagagagcaguuuggaaaucauaaagcugauuuacaguuauuuauucccugccccuccccccacacuauuuuuuguaaaauccucaaauuucaaaguauuaguacaauugauuagugauguuuacuuuucgucauuucuuaaugcuccacguuacagaaauuuuucaaaauguuucaaaaugacauauuuaguagagaauaaggauuaaagaaggaauguguucuugaagagugaucugguuggagguuguuuucugggaagguuuaacaaaauaguugucuuaggagaacacaucauaauaucacauuauuuaaugaaaccucuuuuaucuuagauaaucuaggggggaaaaauccuaaauuuacacuuaaguggugaaaaaaauuaaaucgcaauuuaauuauuuuuuagaaguaguauaaauuuuuuuuuuucuuuugagacagagucuagcucugucacccaggcuggaguguaguggugcaaucucuccucccggguucaagcgauucuugugccucaaccuccuguagcugggauuacaggcgcgcaccuccacgcauggcucgguuuuuauauuucaguagagacaggguuuguuggccaagcuggucuugaacuccugaccucaagugaucggccugccucagccucccaaagugcugggauuacaggugcgagccaccacgcucggcguuagaaguaguaguauaaaauugaugauaucaacaaguugauagcuucucauaauuuaugcugcccacuaauuuggcuaauuuaguaaauaguuguuaccuggaacuaaaugauuucucauaacaugccuucuuggccuuucucacgggacuuccuggaacaagaugacuuuuguuggguagagcugauauaagaauccagccaaugaaacuguagugacaacuuuuuacuuuuaaaaguauauauuguaaaaagcucucuugaaucuacaaauagaauccauuuuacuaaagcuaggguguuagucacauuauauuuccaagaaaacacaguauaauugucacuuucaagggccaucgaacugaaguagagaaagguggugacuuuaugggaacaccagauuaguauuagaaauuagcgugagaucuauacauuuagcaguuucuaaaggugauuucugcugcuucacucacucuuacuguuucuugaaguauugauugucaaagugauuagaggagcaguaauaauucauuuacagggagucuuacugccuuuuccuuuccagagccucuccucacauucccaagcuguuuauaugugauguucagcuuguggacagggugugugcuuauguuuuaaguauuugcuucuggagagcuagcuagaaaaagcaaaacagagaaacccauuggcguguugagaguugaauccacaagaagauguuguuugcaaugugccgaaaacauaagguccaaacagccggaacaggccuggugccaggcaauuucacugugagagaaagaggaggucugaugcaguucucuaaggauuagcugcaacucagcagcugcugucugaguuugauuaugcacauccugagaccugcauuaacccuugugccccugggggaaccucagggcugucuucuaaacaaaggacuuuuccccuggacacccaggggcaaaagccaaaacaauauggagguuaaaagaaggcggagcucugggagacuggauuugagagaacaaucuaggaaggaaacggauuguagaauuuuggaacugcaagugccuuuuaagacccuuucauuuuauugaucaagaagcagaggcucagagaaguuaggugacuugcccaaggagaaucagucaaaacuuaaguccaggugucuucauucccagcuaagcuguuucaugcagcaccacaucccuaaugggaugauuuucacauucguauaaauaauauguuguguauuuuugaaaacugcgcugagaggaaaccaaaagcauuuuugaauuauguguuaaucacuucuuauagacuguccagggauauucagauuuuucuuucaaauaacauuuuauuaguguguaagucuuaauaagugacagguaaauagaucauuccaguagcuaccauguaugauucauaaaggcagaacaggcguccugggaagguguuaggagggaaagcucggaucuagggagacugcucugaaaacaaggaaggauguuuauggaaugaacucuuuuguucaaccauggcgaugucuggaucagggcagccuuggaggauuuauggccuccagucuggagaagguaggugggcucgcauuaucuguguuguaagaaaagugugugaggucuuugagccuaaggcuguccagguaacaaaagacucugucaaaaaaauaugucuauuuagaguucuuugagaguaauauguugcuauuuauuucacaucugugucggguauugagcauuuuccuugcuuugcgguuguaacaagauccucagcuuucuuccuuuuaaagguuggggagcuaauuucuuguaggaaauaacacauuaaauccaagcguaucacuaaaacaugugugccuucucuuuuugcucaauuaaaagauugagcuguucguguuuuguuugauauggggguacuuauugaacauugucaaccuaaagcauuuugaguaaccaagagaaaaaucaggauggccuaauucacuaaaauuccaaguacauuugggauguauuuuuauacuucuuaauuaugagauuuuaaauugcuuuauuuuuaaagguugagugugagcugagugugugucuuuuucuguaguccuaccauccuuucugcaaaacucaagugaaaauuauuuauuuaggaugcccuauugagauauaguggaaugucuuuguuugcauuuauucuuuuucugggauuuugguuauaucuauagcuguaaauaaaggggaaaggaaggcuuggagugcauguuaggacaagaggucccaaguaggaaaaaaagucuugccuuagagcuaugccuugggaagugcuuuuuauuuaguaaccuaaucaggacaugccugugucuauuuauuguuggaugagcuuuugaaguacauauugccugaaagagaauuuuucaagugguuaccuauuuuuuuuuuuuucuccucuggcuggagaaaaguuagaacagaagggaacgccguguauuauuuuuguuguucuucacuaaagacauagucuuggcuacuucggaaaaagaaggaagguaugaaauggugguuaauccuuuccuccauuuuguccccaauugcuugcagugucucuucacccuaucgagaaacacuuucucaaagcugucucuguacugugcugauaucagaggagucaacuaaaagugauuuucucuguagacaguuauucuaguuuaugggauguauuauaaaacuauuggggaaaaucacugaacuacuaagguaagggaaauagcuuaaggaucuaugauccauauuugaaauagucauuaaguuauauaauuggauuuuuagagaacaagauagagcaguuucaggauguaagguguaaaauaaaucugguccaugaacugcuuccaaauugucacccugaccagaagaaguaacauuccucagguuguggcuuuaucuagaaaggggaaauggcuauuucuggauuagcuuuauacaaaugaguguauuucccaccugcugcuuuugccuaggguuggaauuuuuccuuuucacugcuuguuacuuggcguuuggauggaaacguauccucccuuucagagccagaagauucugugugagucaucaagaaaaauuucuccgaggaguuauuaauucaguuaguugcuccauaguaaaugguucaugcaacagugauaaaccucugaauuugaaaucuuucuuuaaaaucuuuuuuccuucaaaaaaugcauacaguggauugcugagcaucuaaaaucccgcacuguucagcacugucauucuugguaauugcuuuuuagaggauuuggugguguuuugcugcuuaagcuaaaccacgaaguuaaacuuuuguacuguggaaguaguucaugaauccuuuagauuucuuggaagaggaaagaugaguguguggugaauauauaugaauaucgcauauuugaauguguuacuuacuaguuuugguugagcauuaagguugccccuaauggaugggaucucugccagggguaacucuuggaguccuaggugcuauuggggaggaaccuuucauucucggcauucugggggagauuuacaucuguaagccggauaaaaauauguggaaaggugauuaguuuaauuggcccacuauuauaauuauucaguaggagguggcugugggacugcuauuauagcccaaaaugccugguaggaagaggcggagacucauugaaaacagcagcaagguuauaaaacguugguuuaaacgugcauuuaauaacagauuacccuggugcuuuaaagacagaggaaugcuuaaguauuugguacaagaauccauccaaaaaaagacgcggauuuuuuuucaaagauaauugugggaaauucugcuaaugauuucuuuucccuuaaaauaucauacaggggaguaggauuuagguagguguaaaguugcucaacguguugguaacuuuaagauuauuucuucucugguuguugccacagacacucaggguggccacaauggugguguuguuuuaggcuucuuucaaaaaagaaguccaguccaggauaauguuguaaaguggaguauuuuucuuucacaucaaagggcaaggaauguuuuacagacagugagcuaagaaguagggcacagauauuucaguacuugcguugggaaacuauguguggaaugucauaguucauauaccagagaccccgaagugaauccaggugccugcacggugcugacuuuuccuggagugagaugacuguaggcagaaauugcagccagaugaaccuaaaauaaaauugauggcuuuauuggacauucuuuucaugagauuuaacuucuuaacgugcacauacaucacucuggggaugucauuaucauggcugaccuuucguuugggggagcugcugcucgcugucugugcagcuccgaucagcuuggcuuugauuaccacccacaucuguugagcaugugagagagagauuuugaaaaaucucaagcacacugacaacuggcuacaaagauuuaauuaagaccggucagaacuaauuucaguuauauauuccaguuuaggguaucaacuccucugguuucagaagggggaguuaugacuuccuaaaaguuguuguugaaggcagcaugaggaaaucuccuugggcaagcaguggguuucuuuguccuagcucccccacugcuaccugggguuaaugauugcaggguggcuggcguaaugaaccagugccggaaagcuuauuaucaacaugcugaagucauauuuagaaaucauuccuccuccuuuuuucuccuuuccaauacaagucagagcacugcugugguuccaccuaauaaauacugcaggcuucauugggcuguucaaugagaccuaauauaguaucauuugugcacuuuagugggugguuccuauuuauauuuuugugugguuuacugcucaaucuugggaagaugugggguuugaggguuuaucaguugcaguuuuuuguggaaccaguuugagugagacaagacuuuggccauuauuugucggguuacauggaucuccauaugagcuaugaagauacuggaauaauugggucacaauaauguaaaaucguagucuguacuuucagcucauuccagaggaaugauuggaagcccugcucucccucucuucugcaugcaaaccucaggugugauuucggccugugcccaaguguucuugaaauguucaaggcuguccguucccacucugugaugaggcuuccgguugaugugugacaucacuuagggcaggaacuggcacugucuugauccuggcuguccuagagaagcuucugugcuuggccuugggaagccaccccauuuggugcugcuguagucuccuuucugcuccucuuuuaacagcugccucccaccugugcucacuuccaccugcaggccuuguuuuccaguggcacuggagugccaugcugaggucacuggacaaguuccuuaucagagcccccuucccauuagagugaggcugcaccccauccugccugggcuuacuuugugcguugcuugggggcauggagaagguucuugcccuugcugcuuuauaugagguccaauuccuccaguguuugccaucuccuuuagagcucucuggugacaaaaccuucuucagcuugucuacccuccaggcuggugaguugaacucagacuggugcucggaaagguuaaaggacuuguccaagauguuaccuuacuggcaaacugcauucccaagucuuuauugaucuccgagggcaucucuuaauuuguuggaguuuucuuuuccuggaaaaaauacugcuugggucucaguuucuccacauauaaaaucagaauaagaccauaaauucauguaguugaaaggggcgguuucaggaagaaaacuaagauaaugaaagccuccggaaaagggucugggacgacauuauuuacagaguacuuuccacacauugucaggguggggccgcacaggaaccuugugggguaggcaucauugaccuguuucaaaaaugaacaaagucagucccagagaccuugaauggaggcuuaucaaagcuaagcauacggcuucaaguuuaaccgucaaaugguagaguuagucauggcuuuuggaugugcgggccaggcauggugcagggccagguauguuuuagccuugugguucuuuuccugauauuucgguccugugggccuccccaaaguggcuuugcaccuauguuuguuaugggcauaaggaaguuagaauucuaugaauauguacugauuuuuugugauucugaauuuaaauaggccucuauaaagcuaauacuugaaguuuuguuguaaugaagcaucacaaauacuuuuacauaggaaaaaggaccaagcugaucuccuuaaagcgguugcaaaaaccacccaguuguuauacgauuguuuguuucauguuucuuguuauguggcauauuuccaguaaguggagggaccaaauauuuuauaguuacagaaacuucuucucucccuccuugaaguuuaaaaaaguggaucaaaugucugccuauuuucaaggaggcagggagacagaagaucuuuuccagauugcaggaaggccaacgcagguugcacccagagaacuauggaaaccacuguugaggaggaaggaauugggugaaaauuaaagaaucaagcuaguaaaagugaaaagaggccuuugguuuuuuuuuuuggacaguuuuuaagggccuucauaaauacuugguguacuccucaaagaccaagcguugaaggguuaagucagggaacuaaaacuuggauuguguguugaccccuguguagcuguggccagggcuccugauuuuccccugacgauccauugguagaacaaggccagugguacuguuuucuggugcaggggaggcucggaccugcaggggaguuacggaggcuggccacugguuuggagcagacagguaaguagccucuagggaggugguagcucuguacaacagucuguucccaaugucugggugacucuuguucccaauacuuggcucucuuuuuggaugucagagucauauucuucauucuccaugucuccugcuaauuuuuggcauugacccauccaggauuuauuucagcagcuagcauggugccugaccuauccauaguaggugcuuaguaaauacugcacuccacagggggaagagggcaggcacguucugccuauugacguggugggaagagagaccgugcuuagggacagguuugggagcuucauuauuucugccuugggacuguuugaaugcacccuauuuugcuauaggggaaacacugcaauaacauaaaucccacuugaaucauucuuuguucuaucaccccugcccuuaucacugcucuuguaagacagacaucauaggagacuccuaauccucucccugccucuggugggugcaugacacugaucuagcuuccacuugcacaguucucucucucucugccccuaaaacagaaauaugaucauguuauucuccuacuuacaugcccgucaguggcuccccagugccguacugcuguggcacacagaacccuacgugaucugguccugcgugcucuguaaguggcaagucccagggccucuucgugcaggcuguucaagggggucucauaaccuaccaguccgaguuagacuuguugagucuuaaaaccaagcugcuuugaguugggucuucagaugaacugggaaucaacauauuugggauggaucuguagggugcauuuaaaaggcacugaauguuuggaauggagugcaagaauuaauguuaaguuaccagagaaaauugagguauuaagggaucugcgcauauaguuuucaaaaaucaauuaaacaaaaagccuguuuuuuaacugauucuauaguucauuuggaagacuauguauauuacauuauaucauauaucuacaugugugauauauuuauaauagaaaaaugaagcagaaacuucuacuaccaaauauuaaaacacauuauaaagugcugauaaaagaugaugaugugggcauaaaaacaugcaaauaauccaacaaaauagcacuuuucaaaacuuuuuuuagcguauggaauaacuuaauuauaagucguuggggaaggaacagauuauuugaugaaggggguugugaaauuggguauuuuaaaaaaucuauuuauaucuuugcuuuggugacacaccaaaauaucuuucauacggauuggauuuaaguauauauauuuaaagcucuaagcgagaaaaaaaauguggagaaaauuugaucucugagaaagaggauuuuuuuuaagccuaaaagccaaaaacucuaagugauugcucaacuuaaguacauaacaguauucauuuuacugaagaauuacaaauaacuaauaaugaucacuagaacagaaaaaugucaaaagaaaaaacacacgguauucauuguccucucauaaaauuaagaaagauuuagaaaaugcaaauacucagugcucauaacaauaugguuagauuuucaacacuuucuaaaaggaaaaauguuaaaauaaauuccaaagaaaaaauuuuuuaaaugguuugguuuuuacauauacuggggaaacuuacuauuuaaagacuagaguuaauuauuucaaaauaaaaauagucuuucuaauuuuaguuucauaauguuguuuuuuaaucuuuguuugauuuuaaacaaccuuuuagucuuugggcuguccaaaauuauaaauuauaugucuguaauuuacuauuguuaaucauacaguucuccauauaaaaaauggcagagagaaaaacuggaaaaauaugcccugugaaggggauuuaugauccuuaauaucccagaagaagaccauaaugaggcaucuuauguaacagagaagucauauagggcuucaguuucuaaagugcucaaauuuuaauucauagugugacuuugaacaggcuacuuuaccucucuuggucucagugucuucaucugugaaaugggaggguuggguuagaucaguuucccagcugagaugccccggcacagcugugccaaaauucugaugccccucggcccuaaagacagcuggacagagcugggguggaggcccuaggucaguuacuuccacccaagggcagccauuuguuuuucccaaggaaaauaguaccacaaaucacucucaaugcacucuuagauaaugaguugucuuacuuuuaaauucaagaggugagagcuacauggaagaggagauaauuuuggacaucacagugaaccauucguccuucccagucaauauucaauagguauguuaaaaaaugaauggaagaaaacacaucaaaauguuauuaguaauuaucucuggugauugacuuacagguaauuuuuauuugcuuauuuauaauauuccgccucauucaaauuuacuguuaagaauuuguuaaauuuaaauaagaaaaguuauuuaaaacaaaucccaaccuguacccauuuuuacauuuaaaaacuccaugaguacgagugacggcuauggcugucagaguuaagaaucuaacaaaaauaaaacggcaaacauggacccauuucacauuauggaaauauccugggauauuuucauuccaagguuucuugcucagugcuuacuuucaaggcugguuucaggugugaggaagaagcuuugagcagaaggccuguuuguagagugagugaguagccuucuuacuuggggcagcugaccccaaaggucuuccucuccaucucccuccuucagugcuuucuucccuuauuuuuccccuucccugugaccccugaauugcugauaauuccuuuccuucuuuguucuucucaaucccugguguguauaugguuagaaguuccggugcccacuuagcugagccacagagauuccauuuuuaacuggucccucauaugccagcccaucuaguuccucaggcauuaccgccuucccucucccagcuuuauucugcuuauuuacaucuuucugggaaugaugugcuucaaacuuuccaaccuauuaguuuaaaccagauuuaguggcaggggcggggggaaguagacuuucucugcccuuugguuuugcuuuacuuugagauaaacacuauauacauuaaaggugcuuaaaugauguuuucucugacuuccuaaagggguuacuuuucauugacuccuaacauuuuaauucucugauugugauuguuuugucuaaaucaugggguggagugcauguggggaauuagaaaacuaauugucauuauaaccuuucagcagaauuuuggaaugauuaauagcuauguuaauaugccauaacauaauuacuuauaaaaaucagaauauaccaccaccuuguuaguauuaaaauggugcuaggcugggcgcgguggcucacgccuguaaucccagcacuuugggaggcccaggcaggugcaucaccugagaucaggaguucgagaucagccuggccaacauggugaaaccccgucucuacuaaaaauauaaaaauuagcuggacguguuagcgggugccuguaaucccagcuacuugggaggcugaggcaggagaauuucuggaacccaggaggcagagguugcagugagcugugaucguaccauugcacucuggccugggagacagaguaaaacucugucuaaaacaaaacaaaacgaaacaaaaaaaccugcuaaaauauaaguuacuuucuuuauauaacauuuuaggaccuuacaguguaccuuaacuuucugagcauagauaacaaaugaagauaauaagaaauauuguuuuauauuguuuauaaagcacugugcccuacauugcaguuuauagaaccacauaacaguuggccaugggcaguaucucaggaagccuuaaaaucucgggaagacugacagaauggcggagcuaagauggaccucagggucaucuaauccaguguuucccaaccauuuucacaucauggcacacauugaaaaggugcacagcacacccuggggaaauaaaugacugcucuuggcuggagguaguggaucugaggacuccagccuaggcuguguccagcuccccugagggcugaugggcaucagaaccuuggcgcagcuguccuggggcauuccaguugggaacugugaucuaacccaacccugccauuuuacagaugagacacaucugcauuuacauaucgagacccagagagguaaaguagauuguucaagguuacacagugaauuagugacauuaugauaaauagaauuugagcauuucagaaacuggaguuuaauauaacuucucuuuuacauugcaugccucauuauguuguucuuacaguacauuagaacuuuuauagggcacguuuuuccaaaagguuuaccucugccauauuguauauggagaaguaugauuaauauuaguaaauuauagauauaucucuuuuggacaaccuaaagaauaaaaggcucuuuuaaaccccaaauucaaguuaaaaauuaagauuacgaugcuaaaaauagucuaacauauguaaaaaugauuuaaaaaauuuuauuuacacaaagaauguacucaggcuaugaaacuuguaugcuggcaguugccucacuuuaaaaaauaaaagagagaaaaguaagauggaaaagaaaauuaaaauuguaaacauuuuaaugacucaccacuaccuccauccuuagauuucuuugccaucaacuauuuaaacccuuuaagaauauuaggaaaccgugguuacuuggcgugguuuuauaaaucuguucugguaaucucuaaauucuccuucaaccccaugaugauucacugauucuaguguaaugagggcuugguucagccuuacauauauuuaugugugugucaaccaagauguacaugggaacauggcaucucaucuucaguucuuugucugaaccacaaaauuuaugugccaauucaggacaguuuauggcgcuagguuuguaacaucagagugacuuguuccaccaugaccucaagaugguagcuguagacuagcgacaccuuccauuaacagcugguugaccuuggagaaguucuauaaucucuuuuuuugccucuguuuuuucaucugugaagugaaggacaggcugccuaccugcuaggauuguuauauggauuaaaugcauuaguuagugcaaagucuugaacaacacccagugcacacagaaauaaauaugauaaauaaguacagugaaugugggccguuuucaucaccauuauuaguaauagcugccaugaguugucauugaacagggagcaguaagggggccuccagguauaaacaagacccacccugcuuugucagucucagguuuuauaaaaauagucgcugccuaacugaguucuuggggcacuaaggaauaggauuauuauuaccagaugccccugagucucucugcuuauugaggcguuuuuuuuuuuuuuuuuuuuuuugguagggcuuuguuugggaaaaaaaagaaagaaaaucuaccuccagggacauggguaaaauauuuuuucccuuaguuaacguuaaauuccagucauucuuuugcagaaguguuguggaacagaagggagggguaaagauuccaacuuuagacauuagacuaagaaugcauguaaugaguacccagacagcaugacacuuuuucaguuaucacugccacccccauccccccaaaaaaacacacugugagggaaagagcaagagcugugaacucagacaggcugagugcagccccuagcccgcacuuaauggcugaguacauccgggcuaugcauucaccuucucugaugggucuucuagguuggagucaucuucuagaggugcuguaagcugguguaagagacuagcaaagugccagcagcauaggcccugugcccuaaaugggcccacauuuuucugaguucaucuuugcuaaagggauuuuuuuucuuaaguacauacuguauccagaauugguggguucuuggucucaccaacuucaagaaugaagccgcagacccuugcggugaauguuguaguucuuaaaggcagcguguccagaguuuguuccuucugauguuuagauguguuuggaguuuuuuccuucuggugggugcuuggucucgcuggcuucaggagugaagcugcagaccuucguggugaguguuacagcucauaaaggugguguggacccaaagagugagcaguagcaagauuuacugcaaagagcaaaagaacaaagcuuccacaguguggaagggggacccgagcagguucccacugcuggcuugggcagcuugcuuuuauucucuuaucuggccccacccacauccuguugauugguccauuuuacagaaagcugauuggucuguuuuauagagagcugauuggucuguuuugacagggugcugauuggugcguuuacaaucccugagcuagacacaaaaauucucuauguccucacuagauuagcuagacacagagcacugauuggugcauuugcaaaccuugagcuagacacagggugcugauugguguauuuacaaucucuuagcuagacguaaagguucuccaaguccccaccagauuagcuagacacagagugcugauuggugcauucacagacucugagcuagacacagagugcugauuggggcauuuacaaaccuugagcuagacacagagugcugauuggggcauuuacaaaccuugagcuagacacagagugcugauugguguaucugcaaucccuuagcuagacauaaagguucuccaaguccccacuagacucaggagcccagcuggcuucacccaauggauccugcacuggggccacagguggagcugccugccaguccugcucggugugcccgcacuccucagcccuugggcaguagaugggaccaggugccauggagcagggggcggcgcucguuggggaggcuugggcauggcgggcugcagguccugagcccugccccgcggggaggcagcugagguccggugagaauucgagugcagugccggcgggccagcacugcugggggacccagugcacccuccgcugcugcuggcccggguguuaagccccucacugcccggggccggcggugcccacuggccgcucagagugcggggccugccgagcccacgcccaccuggaacucacucugaccugcaagcgccgugcgcagccccgguuccugccuguguuucucccuccacaccucccugcaagcugagggagcuggccccagccucggcuagcccagaagggggcccccacagugcaguggugggcugaagggcccaccucucgaacguggccagagcggacgcugaggcugaggaggugcugagagcaagugagggaugcgagggcugccagcacgcugucaccucucaauacuuuaggcaauuucuugugguggcacauuugagacuguuucaugccaguggcuuuuccauuuuccuuucuuuuuuugagacucuugcucuguugccuaggcuggaguacagugaugcgaugauaacucacuguaacuucaaacuccagggcucaagcgauccucccaccucagccuccugaguagccaagacuauaggcgcauaccaccauaccuggcuauuuuuuuuuuauuuuuuguagagacgagggcucgucauguugcccaggcugaucucaaacuccuggacucagccagucuuccuaccucggccuccaagagugcugggauuccaggcaugagccacugugccuggcuggccuuuucacuuucuauuaaugguucucggggucaucucccgcugcccuucucccccaggaauauuuuagcagcauucuaaguuauuucagcuccuucaguuuuguugcucauaucuuugcuacccuugcucaccauuacaauucaaagccucacuguucuugcuuucucacugauggguuaaccuuuuuuucuucuaucacaaauaggguugcuagauaaaauauugggcacccaguuaagauggaauuucagauaaaugccaaacaauuuuuuuuuuuuuucgagucagagucucccucucuagcccaggcuggagugcaauggugcgaucuuggcucacugcaaccuccgccucccaggucccaguucaagcaauucuccugcgucagccuccgaguagcugggauuacaggcaugugccaccacgcccagcuaauuuuuguauuuuuaguagagaugggguuucaccauguuggccaggcuggucuuagacuucugacaucaugauucgcccgccuuggccucccaaagugccgggauuacaggugugagccacugugcccggccccaaauaauuuuuuagccuaaguguggcccauccacuauuugggacauacuuaaacuaaaaauuauuuguuuaucuggaauucagauuuaacagagcauccuguauuuuuaagucuggccacucuacaaauaucuguaccaauucucccauuacaacuuuuuacccacacggcagcauguuuuggccaagaggaauaaaagaggcuucucagauauuuccuaaggcccuguuuugacgaacuuaaagagaaaaugccgacagguuaauaggagauucugacaacgaagaggaauuccugugauuuuagggguagagauauauaucgacuucgauuugggagaucacuugguaaaugugaggugucuguauuuugggcugaaugucaacucuggaaguagguaaaaguuaaguuuuauauccacaugcuauuccaccuccguucaaaacuuagaaaaauauugucuuccauaccuaauucacaguccuaaugaucagguauuagcugaacagaacaaagaagccugccuuagaggauguugugaauggguuuuggggauggagacuugagacacaauauaaaaagauggucagaccaguuaaguaugacaugaggcaguuuuaugaaacguaaaaauggcuuuuucaugcagcucagaggcauggauauagaaagggaaaaaccaaaaagaaaugauuuguguaugucagcccacuaacauuuuuggaaaugugccugaggacuaccgaaguaaucagaugacauggacuugccccuugaggaauuuaauuuaugggugagaaauuugaaaagaaaguggcuuauccuagcuuuucuuuuuuuuuuuuuccuuuuguuucuuccaaaaauuuucucccaagggacagaagugggucugccacagcuauggauaggaauaaccaagugaagggaggcagugacguggguacuuccacauagaggcugcacucugaugauucaggaauauuucuugaguacccuuuuauuuuauuuuauuuuauuuuauuauuuugagacagggucuugcucuguugcccaggcuggacugcaguagugcgaccuuugcucacuguagccucaaccucuauggcccaagggauccucccaccucagccucaacaaguagcugagacuacaggugugugccaccaugccuggcuaauuuuucuaauuuuuguagauacgggguuucaccauguugccuaggccaaucuccaacuccuggacucaagcagucccccucccuuggccucccaaagugcugggauuacaggcaugagccacugaguugaguaccuuuuagguggauugucaucauauuugagugccuagcaugguguuaggugcuggggauguagcaacagucagcaagggcagagucucagucagcucuguagagcuugugugcugucaucauagguacuuugagaaaugcaaagguagaccagguaggauagggaauucuggccucuaggagcuuccuuaggguugauuaccuaugcuuuuccuucuguggcaauuggagacucagucugcuguuggccagaauacuggauaacuggcagguaacucugcauuguuaggaaggcugaucagacuucaggucccccauugaggaguuuuacaucugaaucuucagcagcuggucuaaacugacaauggcaggcuucaguaaaaucagccauucaauuuaucuauauuauaaaaugaugaaggcaugcuccaucugguaucagauagaguaccuucuaauauuggugcauuaucaguaccuuuguguguagggggucugcuguaaugaaaaacaguagagcucgauucauccuaauuacauuuugagcaauuuuagggggcugaaaagauuguacugugacaauaagguuuuuccuucuuaccaaaagaauuuauaaaugguacagaaaaugaaagauggcuagugguuuuagcaguucuaauguuuuuucuuuuuuuagauaaggaaaaaaaccccacucugauucuaaaacccgcuggaauuugaacuguugccuguguucugaaagugucuugaauugcuugggaucccaagccugaaguuuacagcaucucaugguguccagguauccaagaggagucauaaaguucuccgaaaauugugaaaaccauauacuuaagggaccacacgcaugcaguggaguauucuucgauggcagcauuuucuuuugcgggaaauagcaaaucaggcaguaaugagguguaaggucagaaaaacugcauagaaaucaaugacuagguguucagagaaguuaaaagaaauuaauaauuuuucuucuguaugauuuuugcuuugggauauuuugguuauuuuuuacugguuucggaugcuauuuuaaugaguauuuuguuuauauuuuguaggcccaugaauaugaaggauaacuuagauuuuaaaaguucuuucuucuauuccccaagggcugauggacuuaaaaauaccugucaguugagccuucaaaaucuuuuuauugacaagugacuccugacuucaggccuaauugguuccugaauguuuagucuuggggcauggucauaacacaaacucuuacuuccugcaggcuguguuaucuguaaagcuuauguuuuguuuuuuguuuguuuguuuguuuguuuguuuuugagacggagucucgcucugucgccaggcuggagugcaguagugcaaucucggcucacugcaaccuccacaucccagguucaagcuauucuccugccucagccuccugaguagcugggauuacaggcgcacaccaccacgcccggcuaauuuuuuauuuuuaguagagacgggguuucaccauguuggucaggcuggucuugaacuccugaccuugugauccacccuccuuagccucccaaaguucugggauuacagacgugagccacugcgcccagccaaagcuuguguuauauauugggcuuccauuccugaaagcugguuuuauacuauacaaauaacaaagucaauaugaaaaugugucaaaaauaugaauguaccucuuaaauacacauauuaacuauuucaaacaaaaguacuaaagauaaaaaaaaguuauacuguaaauguuacuuucagggaauuuuuuucugcugagguugaguugacugaagcuuuuaaaguccaauguuaagucuuucuaaagcauauagagguauuuuuuuuuccaguguuucaaggucuuuuaaauuguguuaaaaaacagaguuaucugcuuccaauucuauugcauaugaaaaguguagaaaugcugggaaguuuguuaauugcuaaaaguugaaggagggacaguuuccauggcaacuucuucaguaacccaugcucugauauuucagaaggauauucuuugcugagcugugaaugcaguauuaagaauucaaucaaaucuucagaaugugaagagcaauugcuaaagaaaaucauuagcccugugcacaguuagaccaaacagcuggcugggucugggcugucccguauugagucagccuuaccuguccacuaaucaaggcguugccuucuggacguaguccuuggugagucugcuagccgucugguuuuggucaucccuaugaaagucuuaggaaaggcaguaacagguugagcugucuuugauugaguuagauucaugacugaauaucauuaggguguauuccuuuaaucuguauguguugggaaaugauuugugugucugaagaaaguaagcaacauauaaauuuugucuaaaaggccgcauuuaugcuguaauaauuuucucguuuuucuuuuaaauaaggggacaaaccagggccugacauuaucuuguaauaacgaguacugagcauagaauuuuauguguccaugucugugccuucaugaauugucagauucuacagacaugaccugaaagggagaucuuuuaucucccauguuuucaaagaugaaacccaucuacaugugaaugagaugauauaaaauuauuuucuucaaacauuuuuggguacuuacauuuucuuacugaucuucucgacuagauuuugugcuuuguaggguugugcacguauaaaguacugaaguauuuauggauuuuauaauauguugacucauuuucugguugaauuuauauuuucaaaaauuauuaaauuauauuaaaggaagagaaacaaucaucuugcauuauugcuaauagucaaguaaacaucaaucucuaaaugagcguguuaaguauaguacauauuugcuugccuagcacuaugccauagggaucaaaaggaaauguaggaaaugaugccugcaucguuuaaguugcccagucugauuuuauaaccucuuauucauaguugaaaagcaauaugacgugaauuuaauuagguuuucauuuaacaaggcagucuacuccguuuuuuucauucauucuguuuucucguguuagauggcauuucugauauuuauagucuuuggucauuccccuacccagguuuuccaauuuuauaaggugucauuucuggagcaagguauaauuuaacccuuaccuacccuuaggacaccauaugauauaaauuaacuuauccugacuuccauaaccacagaagggaaccugcuuggaggcagggucucacugucacccaggcuaguucugaccaguuaacuugguugggaaaauggggacauauugacggaagaaauccuuuuaaaaccagucaagccuccaguaaguuucaagaaauaggaagaaaaauguaguguucauuacaugaauaugaaaaucaucuaugauuaugccuuucugaugucuguucagaaucucaaggaggggagaagaaagaaaaaaaaaagcccccccgccccgccagcuacagccuugacaacuaucagaauugcacaggaggccaggcguguaaucccaguacuuugggaggccgagguggguggauugcuugagcuuggguguucaagaccagcuugggcaacauagcaaaacccugucucuacuauauauauguguauauauauauauauaaaaauuagucggguguggcaguguuugccuguggucccaacuauucagaaggcugagaugggaggaucgcuugagccugggagguggagguugcagugagccaagauccgagcuacugcacuccaaccugggugacagugagaccccgccuccaaaaaaaaaaaaaaucuguaugguaacuucaguugggccugccucugcucacccgcccaucuuuaggaagccagucuuagaaagacaguggcuggccagaggccucccuccccaacacuccuuucccccaacacuccuuuuucaaacuucugugguuauggaagucaggauuugaaaagagauuuagcaauguuuuucucauucuguagugguuuucuuuuuccgguugaagaggcuauccucuuggccuucaugaaguagguuuuaccacagcguugaaagugaaguauuaaaauauaagcugauaagagcaaggaaguuuaccagaaaaauuucaguucacauagggccaaguagguuauugagucgugcauucuuuuugagugguaggaaauagaagagagccuuggagaagcauuuucuuaccugacuuuaguucaucucuguuuaucuaagaaauuucaaauauuccagucuaagagauuugaaauucugucaaauuuaaggagacugucuuucagucucugaaguauaguuauuuaauugauuaaaagguauuauagauaaacaaaaauauuuuuuauggauauguguauacauacaguggaauauuauucagccuuaaagaaggaaauuguagacugggcacgguggcucacaccuauaaucccagcacuuugggaggcugaggcaggcagaucacgaggucaagagauugagaccauccuggccaacauggugaaaccccaucucuaccuaaauaugaaaauuagcugggugugguggugugcgucuguagucccagcuacucaggaggcuguaccccgucucuccuaaaaauacaaaaauuagcuggacauggcggugugcaccuguguucccagcuacucaggaggcugaggcaggagaaucccuugaacccgggaggcggagguugcagugagccgagaucgcaccacaauacuccagcccggugacagagcaagcccaucucaaaaaaaaaaaaaaaaaaaagaaggaaauaaugcuacaacacggaugaacuuugaggacguuauacuaagugaaagaagccagccagaaacagaaagacaaauauuucaugauuccauuuauaugagguaccuagaguagucaaauucauagaggcagaaaguacaauggcggcugccaggggcugagggagggggcaauagggaguuaguguuuaauggacacagauuuuuaguuuuuugagaugaaaagaguucuggagaugaauguggugaugauugcagaacaaugaguauauuuaaugcaauugaacuauaggcuuaaaaaugguuaagagggcaaauuuuauuuuguguguauuuuaccacaguuuuuaaaaauguuuauugagcaccuguucuuugguuccaguugagcuccaaugacugaaacaaaggcccucagccuugagggagcugacaggugaguuagaggugagcaugugaugcugcuggaauagggaacacaaggucauugucauggauuaggaugcucugguccucagugcaggugaacuugaaccuagccaugaaaaagcaccagaaauggcucucuuuguaauuuucacuucuccccagcuuccccucccaauauguagugcugccccacugcugcaucccaaagccaaugccguggaucauuuuaaccggcugcugcuuuaacugguuugucuucugcucuuuuccuaaauccagcucugcuccuccuccuuggucugcacuuguaaggccuuuauuugaugugcauguaucucccauuuuauagcccacaucauuuuucaucuuggacuauaaauucagagaagaugugggcuaugcacuuugaccuucacagcacccagcacaguaaaccauaaugaauguuuuggaugaggaugaggcucugaaguuggaagcugacauggcuaaugccuauuuaauugaagguuauuaaugccucuuuagcagugaaggcuagauagucuucuguuuacagcagagaaggaacaagcccucaagcuuuuuccaguggucucaaagaauucucugucagguguugccccaguacacacugaccugaacuuagcaucccggagaaugaaagggacaguuggggcaguggggcagcuuccccccgagaagacaagcgucuucuccucuggguucaugguucccaggugggaauucagggcggggguaagucagaauauuuauguucuaguucagcuuauuaaauaugagauuuuccaucucuuagugaauagaguuugccuucuguccagcaugauaguucuaaguagggcgaccauaugucccaguuuuaauaccuauuugccuggauuaauuauuaauagcucccccuuuaagagugcccugguuuggaugauaaauauuauugcuauccuuguuacaagggggaacauauagagaggauaguuauacaggggaagguggggagaaagagggaggggaacuuaggcaggcugcuggagauucagaagauaaggaaugugagaaauagcuguguagucaaacauuuagauguuuuuuggauggaaaaaauuauuuggcuuuuaaaugauaagcuagucuaauaaguuaggauuugaaagucuugaucaaagggagauuuuauuuuaucagucauaguauaggaucuuuuagugcagguuaacagguuaauguguauacucagagcuucagguauuuuauggcuaaagacaaaagacuuuaauguacaaauauguguauauaucucacauuuguuucuuuaacuaugaaaaugaacuuagucuguuuaaaauccuguuuuuauuugcauauguauuuaacuuagauaaugguguaauggauauucaauauugauuaaccuuagguaugaggaaaagccacauugguaaugaaggaaauuagguaggaccauauuaauuccuucauauuuguuaagggaacaucauguaaucugaacaaaauaaguguuuuauaaucagguguuauuuuggaauuuuuauauucaaaguuuuuguuuaaaucaguuugagcugguuuucggugaaggaguuguaucaauaucacuuuaaaucaauggaaagucuaaacauagggugcucuaggguugcuccaucaagcagcccggcagucuuagccgcauccugugucuuuccauuucucuuuggcgucccuggugugugcuucagccugagccaaaugcucaccuugcucuggggaagccaucauauuugaguuuuuaaaaaucauaacaguauguguauaugaguguguauuauaagugcguguuccuuguguacuuacaaauaaauuuauaauuuuucaaaguuaucuggcgguauugcuuuacauuuugaaagagcauuacaguuuuagaaaugacuauuuaugucauuggaucagcaaacaauuuuacaggaugcagaaauuaucgauuguauucuguauguuagugacuuacucgagaugcuagagcugucagaaugaacuuagacuaaaacccaggucuucugacucuauguccaucacccuacccaugauauugacuuguagaugucuugcccaguaaguauauuucagaaagaauuuuucuuuuacaauugcuuuucuguuuugguuuaauuugauguuguccuacaguauuccuuguuaggaaaaaaaaauaaccucggugccuuugggcuaauuggauguguacuuaccuaucugcaaaguguacuuacugaugcaaaauuaucaccauccuaccgguauaccuugaugguggucucaguucaaacauccuuuugacaacucugccucaguugccgucucaguacauuuguaccauaggagcuuuucugucuguauucuuuaccucuuguccuuccugcuugcugacugucuuuucuauucuaaccuccacuuaaaagacuuaugcucauccuucaagaacuaccugaaaugcugccgccucaaugauguuuucucuguucguucuagcgaucgcucuuuucucucuugaguuccuguagugccuugaauuucucuucuggcccuuaucauacccugcuuuacaccacagccauuugucuuuauuauauuccucccuacaagauuguggugagcuucucaagggcacuggccauuucucauucaucuugguguccccacagcacuuugcacagugccacaucccuuggaaacucugcaguucauuuuguuuuaaauaaaugaauggguuuagacaugguuacacccacucauaagauaugaggugauuguagauuuuuacagcauauggagauuacagagaaccuuauauugguauaauuaucaccugguuugugcauaauuaaaaauguaauuguauauuuuuaugcaauagguuaucauguacuguuuuaaguguguacaguuuuuuaugggccuaccauuuaguuaaauugcauagaugcuuuuuagaaugcuacugugaagaagugcagaguugaggucguuuuuagaagcucagugaguuggccccuuuugcucucuguauuauccuuuuaggcuaagcugcagcacagcugucccaccugacuagcuuuccuccuguggcucuuauugucauugcauuagcugagagaacagguuuuaagauuuuuaacucuucucugccuagccuagguuucagaaauauuuuagaggguuuuuagaaagucgaaauucaguggauaagacuuuugauaguuuucagguucucuuuguuuuauguaaccuucgguuuuuaaaaauguuuacauuucacuccauuuucuucuaauccuguagauaugggacuggccuaggaucuggcguuuuaaauaaucuuuucacuuccccuucccccaacaagguaauucugaugucagggagacagggaaaaauucaccucgagaaacaccaugacaggucaguauuggggaaugaggacuugagauuugccuuucaaaaugaguaagguuuaaguggauggagaggagaugauuuccuuguggagguaagaaauggagcaaagucuaaggugagaaugagcacguaauauuaggagagaaggagggcaaggaggaugcuaaccagcuuucaguggaagauuauuuuagagcaauguucucaaacuguggguacauuagaaguguaccaugggcuuguuaaauagccacauuccugccuuccaccccgacccugaaauugcuuguuugggcauucugugggcuuagggugguggccugggcgucggcauuucuaacagacauccagcugaacuuggugugauggaaucccugcuuuauggaauaaaagagggucugcugacaaggcagcagggacugcauuuuggcaguccuuacuguguuagaugagguuucggaguuaagauggggacacuagaacucuagcugggaaaucaggugcagggaugcugcauaauccccugaggugaugcgugcagcgaggcaacagcagucaggcucuacaggguagaauuuauucucagaagaagguauagaccgcugacaaaggaguucacuccucuguaaacuguuaaggaauugcaaagaaauuuuccauuuguaaucugcugacauauuuuagaaagguagccuccuuaauccaccccucuaaagaccugaugguggucccucacagguauccaaaguagccuuaaaucagagacuggucuaguuggaggaugugacuuggaaucuaugaacccuggauguacuugagggcaacucacuugaaacuuuggaauuucauguggaugcauguuuucuggagagagguccuagagucuugaccauauucucagacaugcccuuacuuggauuuaggauaagaugauuuaguacuuggcucauuggguggcuggcuuucucucuccucucuuuuuuaaaaacccagaacaaauuccuauuagugaaaaagaaacaauagcuugaagaacaaagaaggccccagaccauaagauagaaugauagaagagcccuagauuuuccaacagaugacccucccuuuauuuuugcuugggugggugugccauuauuaauaauaagccaggggaauaggggauugagaagcucuucguagaauguguaaugaauuuuucuguuccuuguggagcaguuucagugguuucagcugaaguacacagagagggcuauguuaacaguaaggaggugaauuacuaguuauugcuaucaaguuuggagcuggggagaaagcggguguaugaaacaggaccaugugugaauggauuucucaaguguuucauuaaagauccgucagaacgguuagcacucuaaccaugcuucagucucuggcuucugauuccuuuguggaauuaaaaaugcuuuugggaagaggggcuaaacaagccuuuugucugaauuuccauguauugauuaauggacccagcagagcauccugcugugaauucugucugcugaugguaacucuuacaaugagcaaagcuuuucugaacuggcauuuuccacucagccuguaggcugcuguauugggugugacaauuuuuuaaaagccaucaugcuagaaugaaaaugagccauuucuaaauggccuauugauuugcaaaaccuuuuuguguuggauugaaugguuucauaucucagcugagggaaaaagaugcaggcuauuuuuaauuuauuguuauuuuaucuuaaagauuugaguugacaacguuuuggucaugauguuuaccuacuguugaaaggucuacuugcaugucaugacuugauaauaaauguaaaacucugguucauuagcuuacacuauaaaagaguucuacagcuccacuuacagugugagccacagucaguaaauauggauccagaaguccuaauuaugacucaagcucacccauaaacuuggggaccaccuucgcaccaacgcuguccacugggcuauuuauggaagaagccacuaggaacuguuaggcggcuccaugugucuggcuaacagggucuuuauucauucaccucaucacgguauucagucuugaugcuagugugcacgcuuccuaagaauuacagaugggaauaaaaggugucuggguauaccuggggaguauauguuuuugccugcugauauaggauacuaggguagcuuguaugcaaaagcaugagcgucuagguuuaaaggauucuuuuuguuaauaucugaguugacuugguauggauccuuguuugauuuuuuuuuuuuuaaauuuuuauguauguauguauuugcuuuugagacagggucuugcucuguugcccaggcuggcaugcaguggcaugaucacaguucacugcagccucgaccuccugcugcucaagugauccucccaccugagccucccaaguagcuggaacuacaggcgcacaccaccacaccuggcuaauuuuguuuaauuuuuuguagagaugguuuugcuauguugcccaggcuggucucaaacuccugggcucaggccauccugccugccucagcuuuccaaagugcugggauuacaggcgugagccaccacgccaaguccuugauugauuuucuuaaccccuugauggcagcuuuuguagauguuucuuacuuccaacaauaauaauaaugauaaauaauaaacauaguugaaauaucuacuauuugcuagguggagcaauuucaguggucucaacugaaguagcugauuuuuguaaaaugcagaaauuaaaaucaaaaugaaaaacaggaugguuuucccagccucucuguacaauuuugauuaggguacaguuacagguugggcaucccaaacccaaaaaucugaaaugcuccaaaauucaaaacuucuugagcacugacauaaugcacaaaggaaaugcucacgggagcauuuuggaucucagauuuucagauuugggauucucaacugguaagaauaaugcauacauuucaaaauguuuccccagacaugaagggucaaagagaaaguucauucuaagagucacagaugcuuuuugcugcagauagaugauaugauucaucuugacagagggauucuucucuaaucugcagacaggagugagcaaagugccaccuuuucacuuguuuuaaaccuguacuuuacuccaacacuucaguaucuccuuuuucucuucuugaaguggcaugaaucuuagggaaaggugaggagcuccuagaaguagcugucaccagaaacgggccaaugaacuuccugguccaagucuucuguuuaaacucccaguuuuaacauugagcgucugcuuugcaaugaacaugaaacaaggaauuugcagcauugagggucguacgcuucacugacuugaggucaguguugcugguaaguaggccuauggcagugaaaaagcuuugaccccaauuccgugggggacagaacuuccuagagcauucuagaaaacaggguacacguggaguagaugccauauucagugcgauuuugcagcauaauguuguguuguggaaacuucccucuuaccacugugccccaguaaauugaacucgaaggugccucuguaccuuuugucucuuguauaggaaauuauaucugucagaaacauuucuuagguaaucugaguauaggaaucuaaaaacugaguacucuuguacuaaaaugagacaccaguuucucaggaaaacuuaaggaaagcauguuauuuaaaaacaauuuugaauauuucuaaacuuucuccuuugcauuuuuuucuccaaccagaggccuuggcuuagauaaaauaaacuaauaaaaucuuuuuuucuuuucuuguuuccuguuguugaaugacaaccucccugagcagccugguggcuuggaggcucugaugugaaguauagaauagguggagggcgaauaacaaaagccuuaucauguagauagcccugaaaugggaccacagucuuuaucuuugagaacuguccagugacugcugcaaacugggcagcucuuuuggaaaugagcagucucugauacagcugguagguagaaccaauuuggccccuaauaggcuaacuggagccaguaguuuaagggggugauuauuaauuugccuuguguuugucuucauuuagaguaaguucaucaggcuauguuuucaugguaccuugcaucaaggaaaaugugguucuguaagucuucauaucaguuucucuucgagaguaggaguaauaaugcauauauguuugcauauuuccaaaugccuuuguuuagggacucaauaaguauuuacuauuaaauuugauuuuuuaguugaauaaacauguuuuaaacaaaaauuauuuccuaauuuugacucagagccuagaaacuguuauaauguguggcauauacacuucuuuuuuggcuaagaguagaguuagaaucuacuuucuaauucauccauuuugaacguugaaccugaaauccagcucaucuuuaagauuguuguaucugcuagguuuggaauuuuaaacuuggaauuuuggggucuccuuggugguguauaguacuuccagauauagacagcauagaugggucucuuagcucaucugaaaaugggagcucaaaauuuuuucaaagaucucauauuuacaaaugaauaaguauaauguaaaaugcaaaaaugaaaaucaaaaugaaaacagggugguuuuccuagccucucacuaggauuuugauuaaaauacaguuacagguugggguuccaaaaauccaaaaaucugaaaugcuccagaauucaaaacuuuuugagcacugacgugacacacaaagaaaugcucacgggagcauuuugggucuuggauuuucagauuugagauucucagcuggugaggauaaugcaaauauuggaaaaugugaaaaaauaugaaauccaacacacuucuuguccaaagcauuuuggauaagggacacucaacccguuuaauccaagcacuugguggagaauguugacagucacuuucagagguagacaaauuccacuggcaaguuuaaugacugaugguauuauuauuguuaacucacacuugugucaaaggugcuugugacauagggaguuuugcucucuccagcauguccauugacuugagcugguucccgcucaacacacagaccucagggcccuggggaaauaacuuaggcagcccaaacaagaccccugaccucugcuguauaggcagauuucauuagcaaaucagaaauguucuauuuaaaguauauuacagugauucauuguagauuaacucacaaaucaagacagaccagugcccuuuugugauuauuuuucaucagccucaggagccucuagaagccuccuguggaggucucacgcauggggugacaggagucaaagugcuuccugcugauggguguccugauuuuuuucuaggucuaauaguaucagcuguggguuccuuccuguagucuuugugaucaucugacuggcaaggucuccagguauccacagcucacaaguuacuauuggcgagggcuuggaacuugccuccugcccagccagugauagcauguucaugcaaguccccacuggccagcagggcugcuggaauaguagauggcucucccuggggaguucugccugguucaagcaucauuaccguggggaggauuucuuugacccacaccuagucuaggcagguggugcaagugcagagacaccugucacagccuugcuguggguugcaucacauuccuccuaaaagcuccaagaaguucacuucucacucacuaagugggauugagagaaaaccugccuguaguuacaauuuuccuaaucgaaacucaccucuuuucaguaggacaguacaaaacaggcuacuuucucaguaaauaauuacuaauaacuaacacugauauacugccuguuuacuaugugccaaguaccuauuccaagcauucuguguauuuuaagucauugaauccucccagcaaucucaugagacagguauacuauuauuagcccuaguuuacaggcgaagaaaccggagacagagcaguucaguaacuuguccaaggucuccaguccaguggaaccuggaauaacucauccagcuccaaggcccaccuccucaccugucaugccucucaucaccaaaugcaagcuaguuucagggugguuaauuuuggagcugaugagcuuuacaggugauugaauuuaaucauuuaugagaguaggcagguaggauaugccaagaaagagaucuuacucaguaaguuuggcaggccuccauauuuugggccuuucuuugcuucccccugugaucccaaugaacuuggguaccaagucuucuuguucccauuacccuuuucuuggaauagauuuucucagauaaucuccaucuuucucccaaucuccucuuccuucuuccuuuuucuuaaacaggaugagccuguuuacugcugggggcaggguauguauccccaugagucaggggcuugauugguaggggaggugaguguucaugcugcgucccuagacaucuugaaugucccccaauuugagcaaguaacacaucacuuaguucugcaacagaaccagccacacauugguguguguuuggcuugccucugauuugauguugcucuuuucucacgaggcuuggacaaaacuccugcuuuacucaaaucuuguuugaguuaauaucucagccuccaggugaaaugaggaaugaaauacagauuuuaguaucuaauauaaaaccauaacuuguuuuuacucugagcuccaucuugggacuauauucuauccagaggcccugaggaacuucucucccuccuuuguuuugauuuauuaaaguucuugaauuauaucccauguuauugaucucagcaaauguggguuucaaaauugagagagaaguaaaucgugcuguguuguuacugugcguuuggcugaauucuguucaaccucuaaaggaaaggaaauauaucaugcugcagucuuuuaacauaaaaucaguuuacacuuugccauucuaaaaaauugaucaguucaauacauuugauaagugccgcaaguaaggauuuacucugauucaguaucauugucaaguccuaaauuuuacuuaaauuuuuuuaacuuacaagcugucuuccucuaaauuuaggauggaaggggacaaagaaguuuuuagauuuuugucacugauuuauagcauguaauuaaggucauuuuguacuauuuugaagcuccauuuuguuucuugguuauguuguucuuagaaggaauacuuuaaaauuguugaguguauuuaguuaauguuucauauaaaaugguaucuacuuccccucccccagguuaggagacucugaaugaugaaauuccucugaauuaucuugaaguaucuucuuagaaaguaauguuucuccaauucauuaagcuacuaagaguuuucugguauugaaugaaaaagaauuguagguauuucaggaauuccugaauagcuguuuuauaaccagacugaugaaaagaaagccauuuuagaugugggguuguauguaauaaaaguuucaaauuuuaaaaauaacacagaaaucugacauuuauuuuagaaagugccuuuuuuacauugagggagaaauuaccgaaaggcauaaaauaaguuuuaucugauaaauauuuaaaauagaaaugugucugugagguauaacuuuuuaaaagacucaacccccacaaaccaguauuucuguugauauuaauuuuagaaaagauuaauuacaaguauucaauuuugaugcugaucuauaaaauauauauucuaauuaugcaggcucuaugugaaaaugcauucuuauuggauuuuaauauuguuuuauuuugauuuuaaaaauaauuuugaagauaccuacagcauauuguaaguauaaauggcucagaaguuaauacauuuuaagauacauuuucagaaaauuacagguuuuuuuuuuuuuucuuuuaaguccacaacuaaguuugauugcuuuaauaucuuccucuuaggaagagauaaggguaaugggaaguuguagagauaagcuaaacuuauaccaacacuaguuugagagccauucgauuuuuuuuuucuugcuauuuuuuggcaacaagaaccgcacacaccaguagcagaguagauaauacaaccauuuaucaaccuuaaagaaccacaaguguuauucuuuaugcuuuauuacuuugcuucagaauauugccuuuagacugugaaauuguaccccuguuuauuuacgauuuuuauuuaaagauuuuuuuuuuuguuuuggagacaggaucucacuccaguugcccaggcuggaguacacuggcacaaucucggcucacugcagccuuuaccuccugggcucaggugauucucccaccucagccucccaaguaacugggacuuuaggcaugccaugcccaaccaguuuuuuuguuguuugcuuuuuguuuugguauuuuuaguagagacgggguuucaccauguugcccaggcuagucuugaacuccuggaaucaaacaaucugccuugcuucagccucccaaaguguugggguuacaggugugagcuacuguacccggccuaauuuuauauaaagauucuuaaucugucugucugguuuggacuuaagcucucuguauaauaaaguaauugauaagaugauaugcaguucuggauuuaugccagauacauguuuuauaagaaauuuuacaugguaauuacuuaaaauauaagauucugguguauugaaauacguauuugaguagccugccauuuuaaaguuauaaugcaaguuaacuucuaaauuuuaauaaaauuuugaguuuugugaauaccguuuucuucagcaaagcucaaguauuaggcuauucguguaaaacuauuauaucuuugggcacauguuucuuaauaugauuuuaaaaggaaaaaaaguagguuuuaagcaggucaugguuuauguuccagcauuuaguuaaaaaaaaaagaccucuaaucuuauaaugcuguuaauuugcugaacacuuuaucuuugcagaucaauuucacauacuuuuaucugguucauuuuucacagccuugcuccgagugagguguucuuaucaucaguugacaaugaugggacagagauggcucaaggauguugggcacccaggggugguugaacuggcaguuacgacuugauccagguuaucugauuugggauccagucugcuuucuccuaggucacagaagccuuuugauuuuguuuuucuucuuuuuuaauguuaagacagguaacugacuagggcugcaggucuggcggcugcuuguuuuggguuggucuucaaacccuguuguucccugacauccugccuucagcacagguugcuguacagcuuuuccugugggcccagcuccucccuccaggggccuuucuuugcagaagcugcucuuucugccuggaacucuguucccuuuccuuguuucucuuccuuuccuucuucgaauuuaagccuaauuacccuccacgucagcgcuuccucccaccuuccccacuguauacucuccaaacuccauccacuucccucugcuuggaacucuuuuucugcaguguauuuuuguggcacuugaguggcuuuguccuuagacuaaguucugggaggaugggaucuuuugccaguuuuuuacccauuguauucucagccuuagcaggaugccucauacuuaagagguacccacauauuuagguggauggauggauggaugaaagaaugaauaaugccgauucuuucauuauauggacuuuguuuccuuucuuagaccauuggaaucagcugaucgucuagcacuuggcuagauuugaacaaauuaggaauccuauguucuguuuaguuccaacuccaaucaauuaaccaauauuuauugagugagaggcagaaugugaagcgcuguaucucuguugucuucucuguuucucucucuuagcauuuuuucauguuuacagagcaucaagcaugauucaaguaguugcuggaagccgccaggucaaagugugcagagaacaaauaccaguaugaggggagcuacauaaacauaugcacacauauuaaacauaagcuaugucaucuguagaauuuaauaaacuaggcuagauuuaaaaucuuucccuuugauguguaauacgucaugguuuugaacauuuucagaaaauggggccacuucucaguuacuccagauaaaacuuacucuucaaauaugacagcauuuucuucaccaauguauuuucuucacucauuuuucaaaaucccuuuauugacccugggugccagaugagugcaaguuggggcacccauacaaacccacauuuuaaacuucuuuguuuguuucagggaagguuugaaauaguguaaauuuucucuuaguccaagaauaggcuauuuccagccugagcuauaguaccuuguuaaacucagugaaagcuacaccuuucaacuucguaagcuugguugccaaaauguaguucguuuggaaugaauuauuagaauaucacacacacacacacacacacauacacacacacacacacacauucaaaugugauuaucuacuggaaagucaguagauaaaucaguugacuagaaaguuuaugguuuggauuauuuuuguaauguuauuucauauuucccacccuuauauuccccucuuugggaaugauaauuugagaaguuagcuauguauuagccuuaguaagaaacuguauuauguuuaucagagaaugaaacgaaacaaauuauuccuccucuuuuagcuacuccccucccccgccccacacacuuuuaaccaguuuuaggauuuuauuaauuaaauacuuugccacaugucuggucaguuggugucuuuguauaagaaugguaccacuuccugguaccaaaacagagauauagaucaauggaacagaacagagcccucagaaauaacgccgcauaucuacaacuaucugaucuuugacaaaccugacaaaaacaagaaauggggaaaggauucccuauuuaauaaauggugcugggaaaacuggcuagccauauguagaaagcugaaacuggaucccuuccuuacaccuuauacaaaaaucaauucaagauggauuaaagacuuaaacguuagaccuaaaaccauaaaaacccuagaagaaaaccuaggcaguaccauugaggacauaggcaugggcaaggacuucaugucuaaaacaccaaaagcaauggcaacaaaagccaaaauugacaaaugggaucuaauuaaacuaaagagcuucugcacagcaaaagaaacuaccaucagagugaacaggcaaccuacaaaaugagagaaaauuuuugcaaccuacucaucugacaaagggcuaauauccagaaucuacaaugaacucaaacaaauuuacaagaaaaaaacaaacaaccccaucaaaaagugggcgaaggacaugaacagacacuucucaaaagaagauauuuaugcagccaaaaaacacaugaaaaaaugcucaucaucacuggccaucagagaaaugcaaaucaaaaccacaaugagauaccaucucacaccaguuagaauggcaaucauuaaaaaggcaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauaugcccaaaggacuauaaaucaugcugcuauaaagacacaugcacacguauguuuauugcggcauuauucacaauagcaaagacuuggaaccaacccaaauguccaacaaugauagacuggauuaagaaaauguggcacauauacaccauggaauacuaugcagccuuaaaaaaugaugaguucauguccuuuguagggacauggaugaaauuggaaaucaucauucucaguaaacuaucgcaagaacaaaaaaccaaacaccgcauauucucacucauaggugggaacugaacaaugagaucacauggucacaggaaggggaauaucacacucuggggacuguggugggguggggggaguggggaggguuagcacugggagauauaccuaaugguagaugacgaguuagugggugcagcgcaccagcauggcacauguauacauauguaacuaaccugcacaauaugcacauggacccuaaaacuuaaaguauaauaauaaaaaaaaaagaaugguaccacuucuugcugaacaguauuuuuaucucuuugaugacuuucccuugaaccaagaacacacuguuuuguagcaggaagauccuauaacucuaugcugaguauuuuuguuuuuuaaaagaagauacauaaguacuggaggaacacagugcguuaaacuuauccugaggauagauguuagggugugucuaacccaugucuacauuuaggguacuuuguaaauaaagcccauaauugguacacaugaguaguuagagcaguucuaauugcaugaaaccugucugagagaaggauucauucuguucuuggugguugagaagauuauaaguguaggguagagcugugugucauuuagaaauguuuugcuaggguucagacaugcugcuuuucuggugaguggauauagggugagaggaaaggagcuggauuugcccugauucuugggaaaggagaggggguuggggauucuggcucagggucggggguucuggcucagaguuugggcauugggagcaaugauuaagcagaggaguuggcuuaugguguuuuguggcgugcagcugauaggccuucauggauagguauguuuccuguguagaugguggucuucaguuacagccuugccauggaggaaaucuuuuuaagguaaacauacaacacagaauuucugaauuucaccgucugagauagucuuaagguucucauaacuaaaugucuauaccuaguaagugcuuagaaauauuuguugaauaaaugaauggaugugauuuuuaaaugaaaugucucuauaaauugauaucuguuucugaagcaucuuaaugaaucaaagcuuuggagcaccaauucuuuccauuguaaucccaacacuuugggaggcugaggugggcagaucaugaggucagccccaaagaggggaauauaagggugggaaauauuaaauaacauuacaaaaauaauccaaaccauaaacuuucuagucaacugacuuaucuacugacuuuccaguagauaaucacauuugaauaugugugugugugugugucuaauaauucauuccaaacaaacucacagaucaugaauguaauaguaaacuaagugaugcacgguaguaaagaaccucaaugaaaaaucuuaaugcaaauauuauuuuaaaagucacauuuaauuuccagauuauuucauggauugccaguggaggagcuggcuuauuuuuagacuguuuuuacaugacuuaauguaauuggugaguaauuuucugcacaguaauuuaaugaguaagucaucuacuuuaugcucagucugggcugggugcuugcucucugggaucucccuaaggaguacugguggaaaugagguugccauauuugacacaagggccgaugguggcuguguggggugugaugacaugagacaagagugucaaggcuugaauguccaaggagguaaaacuugaggugaggcuugaaagauuucagauuuuaacagugagaggagaaaggaaggaauugcuagauaaucuucacuaacuuggagauugaauagugaagagggugaccgaccuuguuggagguugucuguuguuaaaagguggaaaugacaugauguuguggggccaggcagaggaauugggauuuacuaaaguaaguaguaauaggaaaucacugcagauuucugaagagaagagugaaacugcaguuuaaagaagcuugacuugcuauguucaugaguacuucucaugacacugguauaauuugcugcuuauauagccauauaccagauacugccuccaguagguuuugcuuccuucccuuuuuaguggauuaccagugacgauuuagugauucaaccuuuguaaauaucaaguuuuguuuugaguuuuauaccucugugaguuauagagugcaaguaggucuuguagucuccauucucuaagaagggaaaugaaacucaagaauucuucagcagaauucuaaccaaguguggaauccauccaggaauaguaagccagcuuuucucuuccacuuacuacugaacuuccuaaugugaaaugaauugucuguuuuggaacaaaacaccuaggcuaaauuuacauuuuugaguuuguauucuugauaauuugaucuuaaaaugacaaaauaucaauaauucauuugccuccuuaauugucaacugauuuuuuaauagcuguaaaauguaauuuacauaccauucauccauuuaaaaaguguccaauucaaugguuuuuagcauauuuagaguuguggaaccaucacuacaaucaauuuuagaacuuuuucaucaccucccugaaaaaccuguguccauuagcagucaccccuaccccuacccugucauucucaacccuuuccaguccuaggcuaucacuaaucuaauuuuugucucuauaguucaauugguaucuuucuaaacuaguauuuuacaaaauguuacucuggauuuuguuaucagaagaugguuucagccucagcuugcuaguacuaugaccuugagaaaauuucuuaacuuugugaaauuuauccccauaucuguagaacaugaauagucauaucuucacagauuauuuugacgauuaaaggauauuuaugugaaaguguauuaagugcuauaugaguuaacuguucuaccaaagauauguaacugaauuauuuuauuaaauggucucauuuuaaucuuuuaaaauaguugguggaacauaauaaaacacauaauaaauguuuggauaggaaaggauggaguuuuauguuuuuaaggcgaugguuuuauuauguaugugauuuuaugguuugacuuuuaagauggaaggaguuuuucugaauuucccuggagaacuuaauauaguuguacuuauauuauuuuuggaucauuaaacccuuugagaaucuaaggaaagcuauguacauauacuugauuuuccaaaaaaaaaaaaucaagagguucauggaucuuuaaaacuauuuacacagucccuaauaccagguuaagagccccuuuaucuaaaaagagagauaugccgggcgugauggcucacgcuuguaaucccaacacuuugggaggcugagguggacgggucacuugaggucaggaguucgagaccagccuggccaacauggugaaaccccaucucuacuaaaaauacaaaaauuagcugggcauaguggcacgccuguaaucccagcugcucaggaggcugaggcaugagaaucacuugaacccaggaggcggagguugcaaugagccgagauggcaccacugcacuccagccugggcaacaaagcaagaugcugucucaaaauaauaauaauaaucauaauaauaauuaaaagagagacaaaauaauucuucaaagccgggccaagugauuccacacauugggaggaagacacagccaaucagcccaagguauguuuauuuacuguccaauuuucaguauguucuguuguucauauaaaaguauacucaguauaugcuugcucaagcaagggggauuuucuucuagcuaugagauuguaaauacacuauacauagagaagacaugaagacagcucuugaagacaaagcugaggggaggaagaacaggcagccagagugccuuucauacuguagcaauacucuuugggcugcacauuuuagagcgcuuguauaaacaagcauuggauucccaaaggcccuaggggaaugcuguacagguuguguggggcggccugauugaguuuauucuccagauggcuauuacucacaggccacuuaauaaccacuguuguuuauuucauuguuguuagauggcccaacaguacagcaucccucaguccauguaacaaaaauguucuuaccaugucuaaaaagcaaauuucuuccuuaccaagucuauucccaguugcuucccuuaauuugagauguauuauuguggaagaauuuggauaccaguagugaaagaauccagcugagaacaaaacucagaggugcuggaaaggggagaaaagaaaugccaguuaauggaauggcuggaugguccuaucagguaagagggcagaccacuugccacacaaccuuuggauaacaguccuuugucaggcaugggguuuuuguuuguuuguuuuguuuuuccaaauauuuuuuccuagucugugacuugucuucucauccucuugacagugucuuucccagagaaguuuuuaauuauaaugcagucuagcuuaucaauuauuucuccuguggaucauguguuugguguugcauuucaaaagucaucgccauacucaaggucauuuugauuucccccccauugaucuucuaggcauuuuguaguuugccuguuacauguaggucugugauccauuuugaguuaauuuuugugaagaguuuuuaagaucuaugucuagauucauuuuguuuuugcauguggaugucccauuguuccagcucuauuuguugaaaagacaguccuuucuccauuguauugccuuugcuccuuugucaaagaucaguuuccuguauuuaugugggucuuuucagguccacagccuuucagugacuuaaugcugaaaagagguggcaucuuucccuggggcugccuccccugcuugcccauggcaggauuucugaaggccacagucagccugggaaguuaggaugccagggaguuggcauggagucccugugggacuugguagcucuggggggcuucugaggaagagacucauuguuacuggagugaacgucagaagcucugcauugguggauuagugaguccuuuccucauuuucuccucuugugcaggcuucuuguuccuaaugcacucauucuaacugaugagauaauuacagcaaaauuuuguauagcuacuagaaccaggaauuccgucgacacaauuagaauugguaauccuuaccuucaaaucuucauucuagugaaaccuaaaauaaaauuagcauugcuuucaagcagagcuuuugugcuuaaauugccccauuucuguuccauaucuuaaggcugaccuccauuccagauuucccauuuggggacuuggaugguucuccuguggagccaaggugaauuuagugacagguuagugacucuggugggggacauguuugcaguagagcuccacucuuuuuuuuuuccuuuccugacaauauuuccuaacuuuucgccuucagacuaucauuuugacgcacaucaccccuaauuuguuuucguggcucuguacuccuuucucuccaauuacuguuccauuguuacagcuaccugaaagacauuuucccuugacacacgcuguccguaucucagacaccucagcgaggugacuguguugccaagucuugucaaagguuccaauuuugaaaccuuauaaaucucucccuugccuguauucagccuugcugggaucagcugucuugacagccuuccaucuggcuuuccuagcccuuccuagcccaccauucuaacggccuuacuuccugccuccaaaauuuucaagagcucccaauuuucagggagagugcgggcuuccuaggcuagcacucagugucuugaauuuccuggcuuuuacauaacugucaucuuuaauucuagcacauccucucaugcucuuugcuaccuaacuaagcugagugcucucccuuccuuccauuuccuauaaauaucuuguacuuuuccacuuuuaugucuuuguucucagacuucuaagccagugguccucaaacuuaggaauguaucagacuccacauggaggccuuguuauagcagggaacacggggcccaacucccagaguuucugauucauuaggucugggguggggccugagaauuugagaugcugccggccccagggacugcaccuugagaaccacucuucuaaacaguucucuaauucuaauacguuuugguuaaaagaaacaucgaauucauuggaggccauugguuauucagaucugugcauuggauuuuacauccaacagugcuaaaauuguguuuugaacauaaaugcauuuugagcuccugcuuggugccagcugacaggcccuuuguccauaaaacuacugaugaauugaagguuauacuucuguuuccucucugcauguugggugaggacacuuacauauuuagcugugagccacuggcggcuacacucugucauuacagaccaacaggcccuacagccagucagcugccaauuaacaaacuacaggcuuguauucugcaggcaguuuagccaagggaugccagcaucucuguuguuccugccguuaccaggccuaggcauugucuugcagcuugguaacuccaccuuucuaaagacucagguguccccaguuguacugguaaaagguuuugcauuuuaguguuaugguuaaauuugggaauuaaaaaaauguaggaaucauuccuuugucucauucacaguguaauugucaaccaccuguaucauuaguguuggcggggaaaggaggggugaggagucacuguggccauggauacaugucaucuguccaggccuauagccuauuaaaggcacuugauuugaguacuuucaacuuugcagggggaugggauguccaagggugaaugugauuugaguagggcaucuggaacuuuuuagaagauaaucaguaccuaauagauuuuuuaccgcauagauuuuucacuucucauugcacuugcauuuugcugguguagaaugcaggccuugaccguagaguuguguggguugcacguggauuagccucacacagagagguaaagggucucuaauuuaauggaccuuugugaaggauucuaaaguaaaaguguacagagugcuuucugauuggcgaauguaccuaugauacguuuuauuugggcguauuuucuuguuuuccuuacacaccuguagacuucugauaucugacaugaaauaaaacuuuccaagaaaauaccucaagauuccagguuuuuuccuacaguucagcuuacacguguuaucacaucccauagguaagugaugaagucugccgugccagugcuuugggaaagcacccugcccaccguuuugggaguugaacuuugugauuguuuagaauaccagcuuuuaauuguuuguuguuaaauuuuagucaaucucuguacauucuucacuuugcuucauaaacuuugauaaguuagcaaugggauaucccuuucugccuagguauauuuauucuuuaaaaaauguacauugaggaagggaaaguaauuuuuaggaaaauuacagugugguaagcauacugaucacugagaccauccuaaauuugauuuuuuuuuuuuuuuguugagauggggaguguugcucugucgccaggcuggagugcaguguacgaucucggcucacugcaaccuccgccucccggguucaagcaauuccccugccucagccucccgaguagcugggacuacaggcgugcgccaccacacccagcuaauuuuguuuguauuuuaguagagacaggguuucaccauguuggccgggauggucucgaucuccugaccucgugaucugcccgccucagccucccaaagugcugagauuacaggcgugagccaccgcacccaaccccuaaaucugauuuaaucuuugauucagaagauaucucagagucuuacaggauccauguacaucuucauuuuuuuuccuccauguugaaaugaauuuaguuugaguuuuaacuuaauaggguuuuggauagaauaaaucuauauguauauguauuaggauagagacauaauaggaagugugguguugggagacagagaauugaaaaucugggacccuagcaacaguugcuucaauaacuauaguacugaauguguggccuuuauaucugugucucaguuuuccccgacuccagucauaccugcauuacacauaguuugggaaagacugccuucccucugcaaaguccaucugauuggaaaggcuggguagauaacugcaauaaagagauugaauguaacggcguuccuccuggggaugggaggugaaggauucagggauaggcaguagagugaucaaagaccuggaaguuguagaauucagaguucugcagccaguugacauagcugccuuguuaccccacagaagauucauauuguuagugaaaaauaugccaccgagaagaccugggcuugagucuugcuucuuuccugcccuguacaccacguaccagcugugugaucuuggggaggaccuuagaugaaguccuuuucccaucuguaaaauguuggugaugaccaccaucuggucuuccucacaugggcacagugagcacucacuggaauaguguucuuccugucauagauguaaagcagcaaacugaaaguucuggugguuuaucaugauuauuauacuuguuggcugacuuucucaugggcuucuuagauguuucucuuaaaggcagaauuuuaauuuaaaaaugcauauuauguaagaauauuguaguugacuuugagaauucaugaacugaaacacuuaaacucucucaggaccucuaaauauuucuugacuauuucagagcauuugauuuguccuaaugcuauggaguuauaaaaccauuaaugguaugauagcucuggaaacaaacauuaauucauuugaauucauuagaaugauaaagcauauugugcagggguuuucaggcauucaguucauaacuaucgaaauguggaucauaacaaauuuuguuuggguguguuuucaugucuaaagaggaucuuaucauaacucucauacuuauuaguuuuaugugaaauacaacuagcaagcauauauacauaacaaaggaaauugcagauuguaguuucucugagauugaucuauuuuauuaaauuauuuuuauuaaauaauuuuuuauuuuauuuuuauauuuauuuuauuauuauuaauuuuuuguuauaauuaagucauucugaccuuauaauuugagaagcaugugcccuguuuucaugcuuuaguuuuauuguaagcaucuauauuuagggaggggggugugguuauguguuuguauauguauguucaaguauaucuuuauuuuuauuuuauuuuugagacagagucacacucuguugcccaggcuggagugcauuggcaugaucucggcucguugcaaccuuugccucucaaguucaagcgauucucuuuccucagccucccagguagcugggauuacaggcagcaaucaccacgcccggcuaauuuuuguauuuuuaguagagaugggguuucgccauguuggccaggcuggccuggaacuccucaccucaagugauccaccugccucggcuucccaaaguguugggauuacaggcgugagccacugcgucuggccuauaucuuuauuuuuuaaaguuuacaaggugauaguuuauuaguaagcguucaugccaauaacaguuucuguucaaauguaguuaaagccugacuugaagaauucugguagcgaaaggggaagauuucauaccucuuaauugcaauuugaacagaaaguggcaucuuauagaagucuuaauuuuggcauguuuugccauuaaaaauuuuuugaauuucaauagcuuuagggauacaugguuuuugguuauaugaauuaaucgugugugacgaagucuaggauuuuagugcauuugucaccugaauaguguccauuguacccaauagguaguuuuucaucccucacccucuucucuuccccacucugagucuccaguguccaccuuaccauucaguaugccuuugcacacccguagcuuagcucccacuuaagaguaagaacaugugguauuugguuuuugauuucugaguuacuucauuagaauaguggcccccaguuccauccaaguugcugcaaaagacauuauuuugcucuuguucugccauuuuuaaucugauuaagaaucauaagaauaauuucguugucauagauauuuuuuugcuaaacuuauuuuuaucauaaacaccuaauuauucacccauagucugagagguggaguggaguaacaccuccguugagcaccuccguugagcacagugccaggcacucuuagacaaugugcaggcaguuauuauaacuccuguagaaugcaauggcuuuauccucacuuuuuggaagaggaaacuccuucaaaguguugcugucauuugaacccaggucugcugcacacuagaagguccguauuuucucccaugcuuuuguauagaggcauaauuacuggcucuuuacccuaguguauggcaguaaaacaaauucuugcguuuuagcaucaguaaacuuaaaggagaauugccucaauuuucuuugccuucuguuacaaaguuauaggaggguuaagcuaaguacacccucuuucuccagcaaagccugcggguuuuccucucuuccucagaaguucuuaauuacuguuggcacaucuuguggugaaagaauauaccuuguggggguggaaaaugaaauguuaucuguaaugaguaagauuguuggccaacccaaagaguugguuuaaacaaaaguggggaacagcuugaaugaaucugcuuuucauagguacuuuuaacacauaaccauaaccugucagacauaccaaucgacugucaguugcuuacaugauuguuuuagugucuggugguggagccccaaagcucugucuguauuugccagacaggcaugguaguuggagcgauguauguggucaaagagguccaaaaacuugccuaagugaaaaccuggaaauggagcucuugguuggaguucuugauuuauagguagaaauaaauaccacagaaacagugccacccuuucuuguaucugcagguuuggagauugugaacugauuaaauaacuguaaauugagcaugggugugcugaacccagagcugguuagugcagcccugucuaggacauaauucaggccaccauuuuagaaguaugggucuuuaguccuaagagaaacuaggggaaaagugaauucauucaauaaacauguauugcuucaugguagggaaacagguaaauggggaacuguucaucuauuugggauaggcagauguaacccagagugcaaugcaggugagcagugugaagaguaaggaaaagucacugggugucagggaagggaaauuacacauggcugcugcuuggauaagaaugguagauaagauagaauguagaaugcucacugcuuccuccuccuuguuuuuguguuuguuuuugaaacaaggucuugcuguuuuccccaggcuagaguacaguggcacaauuauggcucacugcagccuugaacuccuaggcucaagugauccuccucucagccucccgaguagcuaggacugcaggugcacaccaacacguccggauaauuuuuaaaauguuuuguagagacagggucucacuacguugcucaggcugguguugaacucccggccucgagccauccuuccaccuuggccuuccaaaguguugggauuacaggcaugagccaccacucucagccucuuccuuuuucuuauacucucagccuagauauccuuuccuccaugaaaugccuucccugacuuucaccccaguucuagguuagguucucuuacugggccaguguagaguacaguacaccacacuuagcagaguaucuaccuccuggauuaccacagcucuuaucucucuccuaccugacucuaagcuccuguaagagcaagagccuuauagagacaguccccaguacauaguagguacuuaaauauuugcuaaaugaacuaaaaugaagcuguaaaaguuggaguccaauuguggagagccuuguaauaauacuagaugauauuuauugagugcuuacuauguuuuaggcacuguaaagguacguggcauauauuaacucauuuaauuuuucaguaaccuauaaaguagguaccauuguuaauccauuuucuaguugaagaaccugaggcaugggaaguugggugucuucucaaaggucguucacuuugcucccugcuucuggcuccuccuguacugcugggaaauuuagaguggcuccuggaggcgguggggacuguuagugcuauaaggggcccggaggugugagcacaugugcucucugggaaaggaguccugacauuguauguagauggacuacaggaaggggagucgcuugaagcaguccagagucaccucugaaauggcaaugcaaaauauauucgugugauuuguugaucuaacacgcaggaugcuaagugcuaggcauuguugaaagugccuuaaauguuaacugauuuaaugcuuuuggcagcugcuugagguaggcacuaucacuauccucuccauuuuauagaugaugagccugaggugcagagagaucccgcagcugguaaguggcagagccaggcaagucuggugccaggguuucagcgacuaucccaagcucugcuuagucuuccuguacaaagggaacgauaacuaguagucuccagugauguuuuuguuccagauaguacaggaucaaagugauauuuuggagacagauccuuccauuuucaaaagcaucugccuuaaagacauuugucuagaaauauuuauaugauuguaucacacuuaauaugugcuuggcuuagagcaggcaaaaacaaaaaacaaaaaacccaaagacacagguccugcccuuggggaacucauacucugcuaaggggagauagagaaguauguagacuuacaaagaaaaaaauaauuucggcugagaaaggcaaaugaagaaaauaaaacaagccaaugaaagagaccugugcauuccacugugauagccacgaggugcauguguccauugaguacuugaaacauggucagucaaaauugagaaaugcucuaagggugaaguacacacuggaauucaaacuuaguaugaaaaaaauauauaaaauaucucaauaauuuuuacauugauuauauuuuaaguguucauacguuggguuaaauagagcauguuauuaaaaugaaugcuaagugaaauaagcuaggcauaaaaggacacuuuuauugcacuuaugagguaacuggaauagucaaguucauggaggcagaaauuagaacagugguuaccgggggaagggagaauagggaguuacuguuuaauggguagaguuucaguuugggaugaugaaaggucuagagauggaugugguaaugguugcacaacggugugacgauacugaaugccgcugaacuauacacuugaaacuaguucaaauggcaaauuuuagguauauuuuacuacaacuuuaaaaagccaaaaaauaugugucacacuuuuaaaaaaugugacuacuagaaaauuuuaaauugcacacguggcuugcgucauacuucuguuggagugugcuggguagagaguaauggguaagauggucaggaaaggccucuuuggagagggucacauuuguguccuaugaaaugagagggaacugaccacacaaaaggcuugagggaagcauuucaggcagaggcagagcggcugcaaaggcccuggaguggggaaaguguguaugcuuagggaggugggaugaaguuaggauggaaaggggcagguccccgaucaccggggucuuaugggcuugaauaccacugcucugcauaaaacuugaaaauagaaacaaagcaauaaaaaacucaaauuuccauacagauuaaaccaugcgaaauugcugguauucugaccuauuuauaugauucagccuaaucuuguguuugugguucugggguuugauucuuucccuagugauguacuuguuuggcuagcagagaaggcacugccuugcuuucuaauuauuugcuaauugguggguacccuaaagacagcacccccucuugcuggcuuacauaccacuuugccugacaacaaauuuguguugaaacggaaggaaacccagcugcucacaaacuaaaacugucacaaguaauaaaaaauccugaagacaguaccuugaacauuuucuauuucauaaacuuugucuuugucagcuugguggcuuuuggaacccagagggagcaauaauaguaucauuagcgccuuuggauccuggcgcugugaagucacugggagcauuuauuauuauugcacagguagacuuuucuuucuggaaaggucuuggcucaggacaaguaaauugaaggguuggcuuucucaguagggaaggguuguuaggaagguaaauugggguuuguuuauccuucuguuaaaggccaucagugcuggcucaagcagucucguggaggcugcugccacccuguuuuuuuucccaaguccaccuugguggccucauuguguguuacuacugcuuuuccuggagcagggggucugggacaaugagaggcaacccuacaggaggugcugcagaaugaauuguuuucuuagugguuuuugacuccagaaccccugguggaaaauguuuguucauauuaaaggagaagaugguuaauaccuaaaaucuuucaucuuauggaaaguuuuuuugggcuuugaaacaucucuggccaccugcugaggaccagugagucuggcaagugguaaugcccacugccugugcacuggucuuuuguggaggaguucugugccacauuugaacuccccagucaaaugguucuaguggugucucaggugguaugaagcagagaggugccugcauucgguucuccaggcuggcccaaguuuaaaaguugacuggguacuuugugcucccuugggauggcuagauauuuccucauaaccuaggugcuguguaagcuaauuuguuaaaaaaaacaacaaaggccccauguuauguaauuauugauaucugaaccacaaaccagaaaucugugcccagaaaccaucccacaauuucuagauuuccaccccugcacauaucgugguccauuucuauaggaucacuguuggugucaucuuuguuuauuuacuguccaauuuucaacugcuauaagucauuaacuacauuaguugaauacuuucuuaccccaaggaauuccuuauugcaguagguuuauaugaaggugggguuagcuuuagacuuagcugcagagucuucauuuauuuuucaguccuaaucagcuuuauuuguuuauuuuguuuuguucaugucaggauuggucagauuguugugaccaccagcuuaguuaugacacggaccaggaaaacugugugaccuccccagagcuggcuugagcuacaggaauaagcacuuucuuaauguggggccuugccugccugaaagaucagaugcaucugcauaaauauaaauaauuacuuguauucuuguuuuuuguuuuguuguuuacaguuuacaugaacuauuucacguuuuuucucuuuaaucuucaugugaaauuugggagaugggcacaauuauugucucauuuuauagacagaaaaacucaaccucaaaguuuuaguccaggugucugacuucaggauggaugcucuucgcagaccucccaacaacaauguugccugaccuucuggcaaguuuccaagagugccaggaccccaaauuagaaaccugggugcugugcuuacacuucaugugugggugaugaaggggaaaccaugggauugcuaaggcucagguuccaccguugcaaaauggggcuaauaccugcggcguuggaugcugggaggauuuugaggucuuauccauguaaagugauaacagcaccugacacacaauugcucuacgaggacagcagcgacuauugucauuuaaagaaauaaaucaucauauccucucacuuacccuucauucaauaaguuggcaagaccuguagauuuuacuuacuuuaauaccauugacucugcccuggcuuucuaauccuucugguuuggcacuucuuacacaauucccgccauaauuggauggaucacacugccuccagucaagccccucuaaucugucaucugcacuacauccagccugaucuuuccaaacacaguuuugaccuucuccuugaacaucccucauuugcuuacagaagaaauauaaaucuccuaguuuuucaccaaagauucuuuauaaucugacccucuucuuagucuuauuucaccuaucccgaacacacacccuacccuuuaucacacagaacuaaaacuccucucuuuucucauccugucuuggugcccuaaaugcccgcauuccgugugccucauuugacccuauucucccccugcccucugcacccccuccccuccacacccccuccccucugcauagcuagcaccaacucaccuucagcuuugggaucuuagcaccgugcacacacccugcacggugcucagugaauaaaugaauuaacucuugguguaaguggauacaguagccagcaucuuuagccuagggggucucgcaagucucuagccuuucuaagggguuggcaaggcuggacacagacuagaucuucauggggaaacccugggauggcagcagagccaccugaagaccuggagugugcaccugggaucugaggggaagagaaagaagugagaucacagucaccaaaacaucugcuuuaucagcagcaaaaaagccuaccugugguugaucugaauucaaauauaugccagcagcagcugucucaucagaaacuuaucuagagcugucauuuggcuauuuagaauuuaaaccacaauugcuuccuaaauauucucugcagaaguaacugcccuuccccaccaagcaacaaccaggcaagaucaguuaucugugguuaccagguacaaaaucuccauuagcugaaauaacagccaggccugcuaucuguguggucugcaggaccuuguucucugugguaggaauuacaccuguucacagucauuugacugcuuucuacugaagguguuaaagugcuaggcuugucuuacuguuguucugugaaaaagacauuuaaugccuccuaucuuuauuuuauguuuuaugucuuuggaaaaauggaagaacuauggaaaauguauugcguuaccuguagguucuagaccagugguccccaaccugcuuggcacuagggacuggcuuugugaaagacaguuuuuccacugaccgagggcaggggugggggaugguuucgggaugauucaagcgcaguacauuuaucauuagauucucacaaggagcgugcaaccuagaucccucacaugugcaguucacaauaggguucgugcuccuaugagaaucuaaugccgccacugaucugacaggaggcggagcucaggugguaaugcucacuggcggcucaccucugcugugcagccugguuccuaacaggccacggaucgguauuggucuguggccuggggguugggaaccccuguucuagacaaccagaaaucuaagccuuucuccuucaugaaaacuguagagaugcagagccuucuaaauauguuuccugagugagcacuggcaucucuuugacuucagugcucagauacacagguaacgaaugaaaaaaccugaaagaauugugagauccaccugguaggugucuuguaaauaccuguaauugcaaaccugcggggugguggggguagggugggguaggguggggugguggcggggagaguuucugagauucagguuacucucuuuauguuuguuuuagucaacuuuucacugaaguauaacacaaucagaaaaguacacagaucauaaguguacaguuugaauuuucaagucauccuuuuaauauauuaauauacaauacaugaauaauuuauguauucaugccacgaacaauuucuuucuuuaauuaaauuaagggguuggugaggauggcaguaggagccaaguucugaguucuguucuguugacauaacuguugaaucacuuccccccacucacuuguucaaggaggcaagguuuuguuuccuggggguaauaucuaagccauucacagccugaaauguuuaccucuaauuuuguuucuuuagcuaucugaauacgugaauuccauuaaaaccacacacauagaaaaaugauuucuguucugcaugucagauuuuuuguuuucccaaugaaagugcaccaaagaguuugcaaguagcucugauaaggaaguuccuuacugugacuggauuuguuuucugcccuuauaaagaugccucucuuaccugcuuuucugucuucccccuuaccguugucaaagaaaccuuuucccuuuagggcccuagcuuaucugucaaguucauagcugucuuuucuccuagaauauuaugugguuaccacccuccccgauccccacacacaaauacaucaugcagucuuuugugggcccaauuuauuuaagucagcuaacuacaggcuaguauaauuuuuagcagauuucaccucauucuuguaccugguaugaaggcgguacuuucuggucccauuagugauuaauaccagcucuggugucaccugaaguuuuuucagcuggaguuacccuacugccuuccaacuuuuaaauuaugaauuugcagauacacagagaacuugaaagcauaggacaauauucuccacauaaguucaauaauugguaguuuguuuuuguuuuguuuuguuuuuuuuuaccagauuugcuuuauuauucucuuuuuuuuuuuuuuuuuuuuugagacggagucucgcucugucgcccaggcuggagugcaguggcgggaccucggcucacugcaagcuccgccucccggauucaugccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaaguguugggauuacaggcgugagccaccgcgcccggccuauucucuuuauauacagcuuuuuuuuguuguuugguuguaccauugacaguaaauuucagugaucaggauacuugaccccugaggauucagcauuuauccccugggaaaaaggagaaaacacaaucucaccuaagaaaguuaauggugaauacauuucuaauauucaacccauauuuacauuucucaguugucccaagaauguauugagauguaguagacuuuuaauccucugcaguuuauuaauacaucagagaaaucccagugauugugcuggcuagguggauggaacgguggugcaacucauuauuuaauacuuguacacaaaugagcuauuuuccuagagaagacugaacuuuccauaucuguugcuggcaucuugcuuucuugcuugauggaacaguguaggcaagaaugaaugaaugagaaugaauguauaauacccauuacaacuguaaaugggcuacuuauaacuuccagaaguccaggaaugugucguuuauuugcugaagcuaauugagucugauaccagagagaugaggcagcuagguacauacaucauuaacaaacaagaaccaucucuugugugauucaucuaaaaccugguuucacuguagaagggaugguuggucagggcagaauauauggacaggccucaggaguucuccagguauuugucuuuuugaucaugaauagacuauuuuuucgguagagucuuagauuuaucaaauaauugagcagauagaacauuguguuccauauaccccccaugcauucccccauuucaccucuuacuguauacuaacauaucuuguauuaguguggcacauuuauugggauuaaugaaccaacauugauacauuauuacuagcuguaguccauaguuuacauuaagguuuacaccuuguauuauacacuuacaugaguuuugacaaaugcauaaugucguguaucuacuauuauauuaucauacagaauaauuucacugcccuaaaaauacccugugcuccaccuauuugcccacccccucuuccccugaaccccuggcaacugcucaucuuuguauugucucuguaguuaugccuuuccaacauguuguguauuuggaaucauacaguauggagccucuucagauuggcuccuuucacuuagcgaugugccuuuuaaguuccuucaugucuuuuugauggcuugauagcucauaucuuuuuaucgccaauaauauuccauuguguggcuguacucuaguuugucuauccaugcaugaagcuuacuguuuuacacaaaugauaggacauuucagcacauagcaguuguuugauaaauagucauuaaaugaccuaguuagauggacugcuuaauuuuucugccagauauguagugccaagggagaguugugauggaaaaggcaauuauguuguuaggcacugacuucuguuaauguacaguuaauguuuaaguggcuuagcccagcaaagguagguggcuuugauguguccaggcuuccaacagcaguuucuuaaauucucuuuagagcugcacuguccaguaugguagccacuagaaaagucuggaaaaauagccacaugugucuauuugaacuuaaauugauugaaaaguaaauaagaugaaaaauucaguaccuugguuguacuagccacauaucagcgacucaauagccauauguggcuauuugcuguuauuucggacagugcagauguagaacauuuccaucaucacagauuuuauuagacagcccuaaugcaaauaaaagcauucagagagaaggaugggauugaaauuaguugaccaggcugauucugguuucucuuuaaugcuuagcucuuuugugccacaauuuuacaauggaagagaugaagcucagaggucuguuugcugaagaacaguugcuuaagaugacuuuggggauaaaaaggcugccaggccagugaagcugugaaaugcccccugugugacagccccaggcggcauggcuugacaaugguuuaggcccuugaucagcuaguguuaaggaguuuuacagaacucucagcucuugcuuauuuaguuugguguugaaaaaauaaagaaagaaagaaaagaaaaagcaggggccuucucuaauuugaggggaugaugggguggguguggaaagggaauuaaacuucccaacuaauaaauuuggaaauuguacacccauuuccucaguaaacuccugcgguuguuggauaccaggaaugugaaaccugaaugcguaucagacacuugccacaggaauuguagcucagucccuuguaacugcaauugcucuuauuugggagcaaagcaaauagcaguuaaguuuuuuuguguuuuguuucuuugccagcacuucggauuugaucagaucuaauuucauucacgugguaggugccacgcugacaauaaagcauuaugggcugucagucuacuuagauuucaauucuguauucguuuuauguauggcauuuuaauaaagucuuaauuuuuuuucuucuaaacagauaacagacuagauuauguugugcuuuccuuuaaugucuaaucuggaaauuggcuguugaugcuagugaggguuuuuaauauaaguuuuaaaugaaaaugccaaauugcuuugucugugcauuguagcuuuuuaaauauugacuuugugccuuuugaaaugcuugaguuucuaagaggccuagcgugaaaaggcaaacuugacagaauaauauaucuaccauaauuccugugaaaagacuuaaaauauucugguauuuggaaguucagucaggaugugaccacuuggaaccaugacugucuauaaacacaggcuuagaauugauacuuuucucuaagaauaggcacagagaaaauaguauauuaucuugcaaauuaaaaauuggaaaugccagaucucaaaugaagacagaguuuuccucaaucuuuaagcuauugucaucugcuaaagaacucuuauaagaguugcagaguuuuaaucaguauuuaacaauuauugaauuuguucaacuggcauuuguuuuaaacaaacauguugucucuuacaugaaaggcaggauaacguauggcuuucuuuuaucugcuacaauuuuucuguaauuuuugaauauaacauuuuaauuuagauacuguuucauguuagcaaagucuagaaaaauugauuauaguuucuuagcaugggauuguuuucuuaaaagccgugaaagggaaaagaaucaauauuagggcuuuccgaauggcagcuuuuuacagagcccccccagcacgauugauuauagcugcuuuuguaaaggauuuaaaaagaacaaucuguauuaaaaacaucauucuuugguaugagcuuuaacagcucuaaauggguuaccaugggggcugcgcugcaaugugaccacuugaacggauuguggucaucaccggugggccagggcagcgaggcaggggaaaggcucuuaggugaggcauugcuggcaugcaugccaaagagguuaccguggcagcugcaaucauucagccgcauucuuuagccuccaaagcaggaggggcaagaagcgugucauuuuucuacaggcagaguguaagguuaagcagcaggaagggagagucagaggaugucuuuguuccagagcauuugccaaagccagguauguccagucaaagggauaaugcaaccgauagcucccaagccuccauauccucagcuguugcuuguugccacugagggguggacauguuuucauuuggcaucuuacaugugagcaucaugacuacagacucaucuuauaccaauuaaauaauaaacuccacucugugggcagagguucugucuggaggugagugugccugaagcaguuaaaucuauuaaauauuagaaacauuggucccauccucacagggcaugggacagggcccaagcaagagaccauuaauguggacugggcuuccagaguuuaacucaguaagacucugugggcucuagaaaauucaaauguaacagguaguccaggugcuuucauucuaaaagagggagcggggugcucauugccauuggcuacuuuacagaaggcauuuauuugcaggaaugggguacccuauuaauuugggaagaauugaauauccuagagaguauggggauuuuuauaaaauaguguugaauuuagcaucacuuuucauuuagcaccccugggugccaaaucccacaggggccucuguaguauggcuugccucagaacuaguagaaucagcuuuuuuuauuccuggacuaacuuggagaaaaaaaauuccugagaugaucuauuuuuaauuccuaacuguuuugcuuuucuucgucuuccauauuuuuagaaaaugaaauguuauaucucuuaugaaaugguacuuacacauguguguuccaacugagacuuuuaauugucacuaguaaauuacuauaaaucagccucauucgggggcaaaaaauaauaauauguguucuuguuuuaaacguauucucaaaagugcuucuuaaguaguauuuuuuaauuaagcauguaauuuuaucauuuugcaaauucgcuuuuaccuuucauccugugcgacccugauaucauaagaauaagaguacuauaugagggcugggcaugguggcucacgccuguaaucccagcacuuugagaggcugaggcgggcagaucacuugaggguuaggaguucgagaccaaccuggccaacauggugaaaccccgucucuacuaaaaauacaaaaauuagcugggcauagaguugcacaugccuguaaucccagcuacuugagaggcugagacaggagaaucucuugaaccugggaggcagagguugcagugagccgagauugcaccacugcacuccagccugggcgacagagcgagacucugucucuuaaaaaaaaaaaaagguaaaagaguacuauaugauucugucagcaggaugcuggaaugucuucauauauagauucugauggagguagauuagaaagacagaaggcagcacgggaguggauuagguuaccuuuuggauuuuugagggcuuuggccacgugucaguuuguacagcugaugaaguauuugucauuggugaaaaaaaaauuacuguccacagguuuccuuucccucuuauugggcaagaaccugaaugucuucuucagagaaaguacucauauacagcacuucagcacaccaacaggaguccuuucuaaaaugcguuugcuuugagauggcacaggucacgugaucaucaguauacucugcgugaagcaugucaguuugaccgggagcuaaugcuucugccccaacugccauggugcagcucggggaaggcuucauuuccuggggaauuucaugcauuuucugugauggauuucauaaugggcucuaauaccuuuaaauauuuuccugguucuucugucaagcaaaccauuucuuuaaaaguugcuugguuggccauuaucauuuauuuuacuugguuaaaaauuuuggccaggaacaguuccuuuauauacaaaaauaaauacagaacccagggcuaugagucuugggcagaaucaggcuguuuucccaguagauaucaggaauaugaauaaucucuuugacacacagugcagccacccuggugacuuggugcuagguauuaaaaacccuaccguucagaacaguuucuuuuaacuucagcuuugaaauugguggucucgucagcuuuagauuuauuccuucuuuuuuagcuuucuugcuuuuguuuagauuuuuaaauuuuuaagagagucuuugaaagugcugacacauuuucaggcucccaguauaaggaaccaacugcaagugucauuuucuucauuuaaaaaguccuccuagaucaggucacuguguccacuuauaggcuuuccuguaaucagcagaaggagaggcugccauuacaaacaggugaguuagguguaauagauuggacgcagaaaaccaggagcaguauggaacaucugcccagcucacuggcaugucagcccugcaggugugucggaggcacagggcucaagugcaggcaucucccuccucugguuggggcuaagcuggaagggagcuuguaugcugggaaacggagcaagcucaccuugacauggaguggcuuccuccacuugaaauaacccaggagcaaggaggcgcuaacaagacggguuauuagacccaggaauuuuuaaaaccugaaaucuugcaacugaauauccauuuuauuagaccuuuugccuuugugaccacaggugaaauggaucaggaguggcccaagcacuguucugugaguuggcauuuuucugaagugugauuuuuuuuuuuuuuuuuuuuuuaguacuuacauacuuccauaauauuugcuucuuuucuuaaaaaaaucuuuuguagagaugagaucuuacuauguugcccuggcugaucuugaacuccugagcucaagcaguucuccagccuuggccucccaaagugcugggauuacaagcaugagucacugcacccagcucaugacacuugcuuuagauuuauauauaauauauauauguaauauacaauauauaugauauauguaauauauauauuauauaucacauauaaaauauauauuauauauauuauauaucauauauaaaauauauaugacauaugugugugugugugugugugucuuguguuuggauguauucgcuguuaauuaauuuucaaaaguuuauuugcacaguugaugucugaaagcugguuccaagucauuugugucuaugacuuaucggucuugugcuuucugugcuuucagcaacauuauagugccaaaaauguagcuguaauaucaauuaggaaaaaaauuacacauaaauccaccacccuaaccaguuaucuuucuucuucauuuucuauucccuuucagugcuuggccaaauauauauauguauuugaaauauauguguguguguguguguguguguguguguguguauauauauauaugagaaauugcaauauaguuguaauauuagaaaaaaauuaauguaugcuuuuuaaauuuaauaugucguuacaaacacuuuuacuuauuacuaugugguauaugauuuuuaauggcuauguugagaaaacuaauauaucaugcauaauuauuuaccagacauaguacaccccuguagugggcauugagauugucucccugauuugucuuuaaugcaguaguaaacacccuaacuuuuauuucauuaggauaauuccugggagaagaaacaucuggucaaauaguauaaaagauuucauagcuucuuaaaacacauugccaaugugauuuccaaagggucugugccaauuucuguuaguuggcaucuuuuaaauagucaaggcuucuuuuuacaggccagcagcagaguguuccauauuccuauugacauucagacucaguucuagcucagaccucugaaacacuuggaaauucuauccauugacuguggcaagucucagaacucagauucuuucuccagccugagcugaagccuggaaagguguggucugcccuuuggccccaaggucuuucccauuuuucuguccuguaagcuuucuguggcauucugucagcccuuguauagggaggagaauauaugugguuaugccuuggggccuagaauuguagcaguugaaaaacccuuaaagugaauuauuaaaucuaaaccagagccuguuggcuuccugugcuugacuuggacucuguuccauuaugguaguuuuuacaaacacuucugaauacgaaauaaauuccaaauauuuuucccccuuucuccugccaaacuccgccaggaaacagaaucucauuacuucaguuagaauuuauuaaugcugacccucuccagcacuuggagcuuuucagguuaggcucacacagcuucuguuuuuacucuagucuaaacuguggucauauggauagcaaaauaaauacuagaauauucuaguuugggaaggggagaggcagcgaugccuguaauaacauggcugcaaaccucucgcuucucucuguuugauauuccaaaaaaggaagaaagcucaaugcggagcacaucuguaagucaugaacauuuuccuuuugugugucaugcauauucaacauaaucccacucaaagucccaggcguugcuuuaguauacauugccucauacaucccuacuguuguugccagaaaauuuaauucaagacaaagguugcuucccuucugucucuggaucaggaaucugaacccauuaccacaaacagaaguaagaauugucaguguguucugcuuugcuuuuauuuuguuuuuuucccccaguugccuuuuauccuuguggcugaggaggaagauuucuuguucguuuauuuguuuuuaguguaagcaauacaccaguuucaugaaguguauuuuuaaaaaacguauugaugggauuuuguaaugcaaguguuuugaaauucaaaagcaacaaaagggcauaaugugaacauucucuccaggugggauauuuggcuuuuaauuaguugucucuguaauuauuuugauuaaaaauguacgaaaugugucaagaguuugggugaaaagguuuaguuuccuuuuagcugguuuuauucaguuaagaguucaucaugagaugauggcuuggaacaccugaggguucggaugacaugaguuuguagaaugauaugccagugauacgaugacugggaggugagcauagacucagugaguguguguacccagggcugcucauuguugccaagcuuuagauugaagagaaaugagaaggaugggggcgggugcauccuguuuuauguguugugaugcuuggggacaggggaaggggacaucauucaguuaaauaagcauaugagaucuuucuggaucaucauaucugagaugcuguuuuaaauuuacccaacaaaccacuuacugcacuagguacuguucuguagaaugaauaagcaaacacuguaggaagaaaaauuguuuuacaccaccagaugccccaacguacauacagcaaggacccuuucugaaaaugauauugauuauauugaaucaugacuacaaguuuagaugugccaaguaauccucuggcaagagguuuuuuuuuuuuuuuuuuuuuuuuugguuggugggggucgcaguuaauguacugauuauugcgcugagcauuuuaugaaacagauuuuacuuggagcuuuguuggcuuaggaaaucuaacugcucugaagcaaguuuaguucuuuuuucaaacaaaagaggagaauuucugcaguuaaguacccuaacuugguguuacuuuuuaacacacuccucagccauuuaaauguuuuccaaagaccagagccaugccuggcucauuggaggccuucuucaugagcccaagguuucuuccaaggucacauuuaccuuuucuggcaguuccccucagaauaaggccgaauuccagcuuuuuaaaaaagagaccauguaagagaacauugaucuguuuuucucaguugugggguaaccagguaguuucuuuaaagggcuugguuauuuccuuucaccaaauggcguaaagcuuggauucagccccuuagaaaaaaggguuucuucuacuuucuguggagccuuuaccauauauugguuccuagaacacaacggcggucaagggagaggacgcagaaagaucaggcucaggccugggucuugggcaucuucaaggaacucgcuuucucagugguauaagaagagccccacucuauaagaggcauccaacaggaacagccaacaucaguggcaccuuccaaguaagugguucagacuucaaggacugugaauaauuacaguaggaauucugucaucucccagaccuugggucauuucagaagcuucauggaacuagaggaauuucuccaaaguugccuauuaccugacaucuuuaugaccagcccagucauccuugugccucccacuuuccacccaaaugugauucuaccuucauguaaccugauuauuuuuuuggcuuuggguuuguuuuccuaauacgcaugaguaaaucauuuaaauucauucccacucuguggaagggauguugaaguguuucuuaaagagacuuuagcuuucuauauaaugaauuaagaacuauuuaagauguuugaagcaguuuggaacugaagacccuucuuuuuuucuuuuuuguuuuugagauggagucuggcucugucaccuaggcuggagugcuguggcgcaaucucggcucacugcaaccuccgucuccuggguucaagcgauucuccugccucggccucccaaguagcugggauaacaggcaccugcuaccacgccuggcuaauuuuuuguauuuuuaguagagacgggguuucaccgucuuggccaggcuggucucaaacuccugaccucaggugaucugccugccuuggccucccaaagugcugagguuauaggugugagccacuguguccagccuaaagaccuuucuuaagaauuucuuauguagggaggguuaagaauuuucuuucaugugugaccucacuuuugauuuuggcuuuuuuccauggaugguuuguauguauauacaggauaauaagguaagccuaggaaauugcuacauacuaguuaguucucuguaaacaaacccuuaaaguaagugcuaguaaagacaacaguaugugcuuauaagucagccauaucuaacauauucaagggcaagaucaucuuuuucccacaguaaacaaagggcucuuuccuucuguuacauuuuuaguuugcaugggucaccugcuuguuagaauuggcguuacuaaaaauuaaugaaugacaauugguguacauggcuccaggcaucuuccauguaggaaauuugaggggcauuaggcagagaaguaacuguuaagccagaacucaaaacucucagugcaauuuuuuccccaucuaugaugccaagaauacuaguucugaaagauguuaaaucgauauucuggggggagaauuuccaugaucaaaguuugaaaaugcuggauuaagccaaguucaacacagcucuuuauuguaguucuuccccaguccuuuauuauuauuaugugugaaucacaggaaaagggagggacgagguaggcagcauguugaacaugcucagugacauacauuuugaggucccaagucccuacuuuuggagcuguaugauuucaggcaacaaucuccuggguaggcccuggagauuguugagaugauuagaugagccaaugcuuaauaaaaugcuaagcacaaaaugccuggcacguaauaaacaccuaacagccacagcuaauccuuuugaacccgaggcugaauggucugaugucacucauguuguggggcaugacagugcagcagaaagagcccacacuuaggugucaagagcuucgggcuccaguuuggccaccagcuagaccagaggacuuuugagcuacuuugcuacucugguguucuguuucuucauuugugaaauaaaucagugaucuuggugacuauaguguccagucaagcucuaaaauuguauguuccuuugggcuagaccuaagccagaauugacaaguuuagcuuaaggacagguauaucaucucugagugacugugugggugacauaaauuuuuagcuaauuauuauuuccuuuacaauguguguugcuaguaauaaaauaguuuacugagucaccuauggaaagauaagcuacaguuauagccuuuuuggcacuuuguaaucaucauaaaaguuaauauacauuugagucauaauuggaguuggacugccuuuaccguaaaacaggaggcaucaucuagauguuuguugucugugaugugauacagaaauguauuauuaggccacauggauauuuuauuuuuauguucaaaggcuaauuuucugaaaguugggucugggagucugaguuauccauaauuaaguuuucuaccuucugcuuucguuguuaaccugaguuaaaaccauaaaguaaauucgacauuuacuaauuugagcuuuaauuauuuugaccacuguguugguugcacugguugaaagcaugugcaggaccucugcuuaguagguaaggcguuguguuuuuuaaacaaggcuuugaauuucuaaauaacagauuuccacacuggcaguuugaaacaugguauuuguucaguguagguuuuaccuacaugagaaaaaucaaacaaauagauuuguucaguugcuauccuacaaauugucuucgcugagaaaauggacagguuugugauguuucugacuacaucaagacucuacuacacuugaucuuuuguguauugaauuaacacuuguucuugucauuuuuauuacaacuaccguauaaguuugggcugaaucauuuuaucaaacucuaaauuuuuaucaucaaauguggaaggccuaaaucaccaucgcuguccucaauuuuccaaccuaaagguguuuauuuccucuuagggguauaauacgaaggaaaguagugucaccagaucucuucuugguguuuuuguauuggugccugggguuuggguagaggaagcagcagcagcagcugagacuagaacugcagcugaggccacuugguaaagaacuuuuuuccaggcuaaggacuuuuguuuuguuuguuuguuuguuuguuuguuuguuguuuguuuuuugagacagagucuccuugcucugucucccaggcuggaguacaguggcgcagucuuggcucacugcagccucugccucccagguucaagugauucuccugccucagccuugcgaguagcugggauuacaggcaccugccaccacacccgccuaauuuuuguaauuuuugguaaaggaguuucaccauguuggccaggcuggucucaaacuccugaccucaggugauccgcccgccuuggccucccaaagugcugggauuacaggcgugagccacugugcuaggcccaacuaaggaguuuuuaugucauccucuauguggcagggagccaauaaaggcaggagagugauacgaugauguuugaguucaagaacagucccucugcaucgaauggcuucaaagacacggacgugggcagugacaaggucaggaggccuuaguccagguccaggcccaacaugaugaguuagccagagccggggggccagaggcaaagggguggagauaggagacaaguauguaucuugccuuccuucuaggcauuguggguuuacacaacugaaucagaugcgcauucuccucugggaauuucaucuauggaggcaguguagugcuucaguuucccuggcugaauguggcauuacgcagaacccucuaucugucugccgcacauuuuccucuuggucguaccuuguugcuuuccacagccuuccuuugcucuccuguauucacaucuugcaucagccaaaagggaaaggucugaaagaccagcuuuguuuuucucccagcuuguacucuggacccuguuagccaacaguauuggcacugccucacagcgauggucagucccaaauuaaacagccucguuaugacacccuacagccaggcugcagcucuggacuugugcuucugcacguuuccuuccaguugcuuucguccagcgucucggucccauugaguaagggagugugugcagaguaugucccgagguuuucuccucagucaagcagacuacauuucgccagguguaaaaucgguaguuucgaauucaccccuuuucauggccuugaggagaugcuugucuccuugucccaagggaauauuggugcauaaaucauuucccguccuaggcauguucauuccagaaaccuuucagaacagaguguggagucuucauaaaaggaauuugucaugagcgcagggguuuuuuuuuauuuuuuauuuuuuaaaggggaaggcaauagagguauucauuaucugcuacagagugaaaagggcccugcuuuauguuaaauuggacuucauggaaagauauugguaauuucuccuauguucuuugugcuccugaaaucagagugggagagaacuuugauuucaaaauuauuuucaccacccuggaucacagagaaacacacuuuuggcugccuuuaaacacauuaaacaucuggucagcccagagaccacccgggagcccuguagaccccaaguaacugaguggcugaggguaagccagcuucucuagacacacccugacuuccaccccaagucuuguugaaauacaggccugacggcugucccaggaagucaguuggcuugucagacugccagugugguugaacggugagguggcuagaauucucugggaggcauuuuuggcccaucugccugguagcaugacagauguguuaguccagacaacugggucaucgaaugaauugaaauucaauuuacacauagggauuaaguaucucaguauuacccuugccacaucaaacuucauugacagagccaagaggaaaaugaaagucauucaauguuaagaaaagggaaacaagauucuaacauggaaagggaauauuuugcuuacuuuuaagacuguagguuacuuaaauagaugcaaugcaagcuauaggagguuuggggcagauggucuccuaggcuuaaaauggagagauuuuaaacuacgaggauccuggaggucuugugacauguaacucugaaaccucaguccaaggccaauuugguuuaaguaaucucagucaaauauuuauuuuguggccaugcauuuugagagggacagagaacacaggucauucaaaacaugccuucaaugaguuguacucugcugaggggcaagaaaaaugcacaugaaacaaugaaaaguaacagugaggguuuaugucuuaaacuguucauaugcuacaaaauccuaaaauaguacuuuauaauuaggagguguauaaggaguggagaagucacagccuguuucauaguagccaggauuugagagaagaaaccaggagguccuccaggggaaguaaaugggacaaaguuuaagacaagcaggacggagaauggcuuuuucaugggagcacgaauggugguucaacccaagcgguguuuacugagcaucuacuauaugccaggcacugugacugggggagggaagccuugccuuuaaaggagcugagagccuaagaggaggcaguugaugauagagcuguagaacacagggcuccugacacaguucacaagcuuugggaauuacaaucuggaauggugauagccuuggaaaccagugaaacaggguggcgucagauugcagaguuaagcucugaccauucuacuagaaaaguugcagcacacucuuggcucagggugguccaggccacuggaacaccagucccuaagguuucaguucucagaauccaccagugugauagcucaaacaaaauagauucccaugcuuugcuuucaguuggcacugaggccugguggagaaugugggcucagguuuaaagugcuuuagccuugcuagccagcugcugaaaccugagaaaauaaagugguacuguuacagaggguuggaccuguccucuuaggaagguuccaaucacagcgacugcuggaagagaaaauuuuauuuuaagauuaaaucuaaugaaagccaguguaguaagggaaacauuauuuuauaauuucuguuaagagcaaacauucuauaugauuuuuaaaaauagagcaauaaugaguguugccuguuuccaaacaagcguuguuuaaaagcugccugucugcuuuauuauuuuuuuccugggcuuuugcgagauaaugguaguaaaauaucaauuuacuaaaaccauuuuuuaaagucuuauaccucuacucugucuccaguucaugcaaguucuucuuuuggcaggauuagguugaauuuuaauacuaaacucuuacugaagaguuaagaagcuguggaacugguauacuuagugacugaucccucuccauauuaagcgugugauuugcuauuaccaguugccaguaauagaaaaagaaugugcucguguggguuuaucuguauuugucauuaaggcuuugcuaagccaaugagcccuagaagcaggcgugcagugggcuuucucccugucaggugagccucacgggcgcugcuccucuccgggcacuguggcuggccucagcacaggucugggcugggguagaaaggccugcauggccugaggacccaggugacuggggaucucucaucuguagcgguaaaguucugaguauugccaggccugcaagcacugguaggauuugauggaucccugggugauuauuuagccuaagcuaagccguaauaccuuugcauacauccccaagaaaguccuaaguguuuuguucccuuuccaguaagggagugacaaagagaaugcccaagauggcuuauaacuagcauugggauggcugaaagucagguaaguuuaguggaaugcaacaaaauaagcccaagauaggaguuuagaucuccgaaauguuuucauucuacugguuuaagcuguguaggcuucccuugcagguuauuaguccgugcucaccucucaaauugcuguuaaguugucagggugccugaggaagacuguggccagagauguggauucagacuacugugggagugggagggguagucacugcaguauguaccugaacaaucagauauacaaguguguuucuuaaucucucaacauccugacucccuugucuuuccuuucucagagagcagagcugacaucugauaaagacauguaccuugacaacagcuccauugaagaagcuucaggaguguauccuauugaugacgaugacuacgcuucugcgucuggcucggguaagguggcugcuucuaaacacuggaccucauucuccaggcaugcacgcacacacauuuuacugugcuuacuucaaggagacaggcaggaugcacagugguuaagggcaccgucuuuggaaucaaagggccugggugcuaauucuagcucucucugccacuuacgcugugagaucuugagaauuuauuugcugagccucaguuuccuccuuuauaaaauggaaaguaacaauaguccuuaccauagaguuguugugaggauuaaaagggaguugacacaucuaaagcucuuagauuugggggcuuggcacauagugcucugucaacauuagcuuuuaaucguauuaagacuuucagagugaugucauggaaaccacccuucaagaaaucccucaaacacugguuucauaaaaccaccuacccuauguuaaaaauuguagaugagaccaagaaguuaauacguuuuuauuccuaggguauuguaggaggaaaaugcagcagccaaguaaaaugauuauguagugacaugaucagauuccuuaguauauuauuccuuaauaguuaucuguuaccacucuaaggcuacauaauaaaccaccccaaaacuugguggcuuaaaguaacagucauucauuuaacuuauuauucuguagguuggugauguaggcugggcuggcugggcucccucacaugucaguggucagcugccgguugaguguacagcuuuagguuggguuugcagcuuucggguacucauaucccuggggcagcugagcagacuuggguucuguucguguggucucucauucuccaguaggcaagcuauuuuuucacaguaacagcaaguagaagugugcaaagccucuugcagccaggccuuagaacugggcacagcaucacuuuuacuacauuuuacugguugaagcaagucagaaggccagaacagacuccaccucuuagugaaaggauucauaaagucacauuuacagaggauauguauacacggaggauuaagggauucuggucacauuuacaaucuaccauaauugaugaauauuuccccuguucucagaauggccccuguaugaguucauucucacccugcuaacaacacagggacuggguaauuuauaaaagaaaagagguuuaguugacucacaguucagcaugccuggggaggucucaggaaacuuacagucauggcagaaggggaaacaaacauguacuucuucacaugguggcagcagggagaaguaugagugaagaggggauaagccccuuaugaaaccaucagaucucaugagaacucacugucaugagaacagcaugaggguaacuacucccaugagucagugaucucccaccagcucccucccaugacauguggggauuaugggaacuacaauuuaagaugagauuuggguggggacacagccaaaccauaucaacccccaagaagcucaaaaaagggaagagcuuuccacauacuuaauuaauagucaagugagaaauuuguggucagcagcaugguaggcaagacuuauccagaccuuuuuugcuuuaggguuuuuauaacagauucaacagauuguuagauaucuauguucgguauaacuuuugugaucagauugagcugggcuucagaaugacccagaacagauuaaaaucaguugugucuuugguagaaaucuagccauguaagagugaauguuuuaaguugaaaagcagaaagucugagaaagacaagagaggugguugcugaccuaguaacaaugagcuuacaaugcaguccuaauguaaaaauaacucuaguuauucuugggagagugauauauaucacacacacaaaaugggugugaaaagaguuguucuuauugcccacaacucuauaaauaucuuucacucauggcaccucuuuuuuuuuuuuagcaccuuaagaguucuuuguaacugucaucuucaauaugucccaggaaauaauaacuauggacauuuuuuguuccuacuucgcagaucuuagaauccaagaguuguuagugggguguacagguuggcgaagucauuuugcugauuugcuaagguugaccuuaagucuaguuuaaagaaaccaguaugcuuaaaguaaguuuucuuuaaauuaaacuuaaggacagucuuagcaaaucaacacaaugacuuugccaaccucuacagacccccugcccccauccagguaaaagagaguuagggagggucauuugaaguccugaacccacugaucagauagaucaagcugaggguuaaaccugggcccacacugcuggugccauggcccuagccuuaggcagaucacugcugugaagaagugaaagagcuucguucuugacuuuggaaaccaccuuacacugagcugggaguguuguuuuucagcaugaagcagcaguacuuguaacuaaaauuugugaagcuuuuaacugugucagaaacuacucuaaccccuauaacaucucugaaacgauagauucuguuaguauuucgaugauucccacgagaaaaccugaggcacagagagauucacuugccucaggucacacuauuagaagguaauagaacugggauagugagaaagugagggaguugggcgugagaguguguuuucuuucauuccuuugcugugcugccuccuugugucauaaaccccuucuagaauuacccaguuccagcuuaaaaacaccccaggguuuggccaguguaccaguugucccuucuuucauccagcuauccaguagaaaagcaaauggauuggaaaaaauggcugaaggcccagaggggacuuccugggcaaggagauaggacuauguucuauaugugggcucaaguaugggcauaagcaaacaugaaacccuucauaagcauuugcugugugccacacacugugccaugcucuuggggcacagagauaagaaagacuuggucucugucuguaggggaccaagagucuaaugaaagaaauacaaacaugagaaauaaucauugugauacccggugaggggugacauaauauaggaaagggcuguauaacaaaaauguaagagguaaaauauagaccuuugguuaaagauggcagaucgaacacuacuaccuuucagugugcaacuaaauugacgauaaaagaauugggcaugaacucauaaggacaaacgaaacaguaaaggaaacaaaagccaugaaguuuugaaagcugggaagaagaugagcuaguggggacagacuuggcaggcuucagaaggccgaguuaguucgcaguggggagagccaaaaagcaacccaguuaacacagcagaaucucuugggaccuaggaauugguggcauucaguggagggugagagugauguuaaacucaggaugauuggcuggaagucuguuuaagaaauagauccccugguuccuuuccucugucauguagcaaaggggcucauguucccugcccucagagggaaaccuggagauuuauuaucuggagaggguaaaacagaacccggggguauuucaggaacagauggggcuggggguaccuuauguaagacagagaaaauaaguucuuagauuaagaauaauuuaauauggugugaucccaaguugucuugucuucucccagucaguucccagaacacuggcagucuguccauuuacccucuggguaggggacugggaggcuccccucugggaagcuggaccaauucaaagagaguggcaugggagcucuccagugaaacguacagcucuguauuacaaagaauaaaacuucaaugagaaaugaaaaauuucagucgaggggauguugccuacauuugacacaccucuccugugugcucaaagcuucuaguccucuuuucgguguuucccucuucaauauaaacaggcaaccaaggcuccccagauauuuaggaaaaacuuguaacaugagagaaagagaaacccccaaauugggagaggacagccacuuacaggaagaaaaaaauucacagaaaaacauaguaaauucagagagaaaagcagaugcucgaacaauggcacaaaaacaggauacuauaaaacaggaauguucugagacauaagaguucuuaagagugugggacugucgugucaaaaaugaaaagcucauuuggaaggugagaagacacagaggauauucauucauugaggaaguauuucuuaaucacuuaguacaugggagaacaggcaccauucuagguucuagggacacuucaguaaauaaaaucuaacaauguuuucucuggcgauaggcuaauuguauuuauuccuucuguguuuccaaauucauacaugcaaauguauuuuaaaaaguauuauuuuuauaaguugucuaaguccauucagguugcuauagcaaaauacuuuagacuggguaauuuauaaauuuauuggucucaguucuggaggcugggaagucaaagaucaaggcacagcagauuuggugucuggugagggcuuucugacuacuuuuuagauggugccuuccugcugcauccucacauggcaaaggggacaaacagugucccucaagccucuuuccgaagggcacuaauuccauuccaugagggcccugcccccaugaccugcucaucuccugaagucccucuucuuaauacuauugcauuggagauuagguuuuaacacauggauuuuggggagacacauucauaccauaaguaaaagaaaauguuauuuuuaaaaaagaaaauaaggcugggugugguggguuacgccuguaaucccagcaguuugggaggcugagguagguggaucacucgaggucaggaguucgagaacagccugacauggcgaaaccccaucucuaauaaaaauacaaaaaucagccaggcgugguggcgcaugccuguaaucccagcuacuugggaggcugagucaggagaaucgcuugaacucgggaggcggagguugcagugagcugugauugcacuauugcacuccagucugggugacgagcaaaauuccaucucaaaauaaauaaauaaauaacaaaaaaaaauaagagaaugagcaugggaacauagagacagaaccggugcccugguggagagaucaaggaaggcuucagagagggggugauauugaugcuguacuugauagugagagcaggaguuucccagagggaaacaggccuuggaguagucuauuucagacagggagaacaguaggaccugaaggaggagauauucaguggggcuucgagauuucugguuugagcaaaagaguuaauguuuuuaauaaagauauuaaaagcagcagagccaucugagacagauugcccaucugucucuaucuuuuuuuuuuuuuuuuuuugagacagagccucacucuguugcccaggcuggagugcaguggugguaucccagcucacugcaaccuccuccucccagguucaagugauucuccugcuugagccucccaaguagcugggacuacaggcgcccaccaccacaccuggcuaauucuuuuuauuuuuaguagggaugggguuucaccauguuagccaagauggucuugaucuccugaccucgugacccaccggccucggccucccaaagugcuaggauugcaggcgcgagcuacugugcuuggcccugucuuuaacuuuaaaagugccagcuuaagggggauuuucuacguuacaaaucucuucccucauacagauucaucccacuucuagguugaugacucauauugguaacucuugugaaacaagagggucuuuaaaagcccuagacugaaauuuuucauuucucauugaaguuuuauucuuuguaagaaaaugauucauuguaggaacaaauuaagcauauuauauguaaaauguugauagauaauuaggucaccugauaaaacagcauuauauuucuggacccaucauuauuaaugaccuauauuuacguaacaguuuauauagaaugcuuuaaauauguaucaugucuguuagauauguaucugugauauauauguaccuucguggguuaguuauuauuagccccauuuuacaaaugaagaaaccaagacucaaguauuacuugccuaagaguacagagcuaauaaaugccagaaccaguacuagguuuguuugcuuucuuaauaccaaacccuguauuuauuccaacaugcccugccauuucuucuguauaauaaugaauauauauguuuugaaauuaaaggagacaguugauaaauuaagaaaugaaccggccaggagccgggcacagugccucauaccuauaaucucaacacuuugggagacccaggcaggaggaucccuugagcucaggagcucgagaccaaccuggcaacauaguugagaccccgucucaacaacaaaaaauaauaauaauuuuuuuuuuaauauuagcugggcacaguggcacauauauuuaguuccagcuacucaggaggcugaggugagaggauugcuugagcccgcaaguuugaagcuacagugagccaugaucgcaccccugcacucuggccugggugacagagcaagaaaagaaaaagaaagaagugaaccauggccauugcacauguuuccagcauguguugcuuucccaccugcuuauuacauugaugcgauucuguggaaaauacccauuuucuuuuguuugaggaauuuagagguauuuaucaauguguuguccgaggaagccugguuaguuugaguuacagaguuggaguuuguuugaguuguuacaaauuugacaaaugaucaacuuaaaaggaauguuguauuugaaugucagaaauucucaaaugcuauucuagugaaaaggcaacaacaacaaacaaaaaucaugcucagguagaaagucacuuguugaacaaauaccagaucagagccuguuaugucuuagacacuauguuaggcacucaggggccuauuaggaagaaggcagguacaguguuucauggaaaggucacaguggcuuggauuggagugguggcccuggaacuguagaacgguguuaagaguggagggauaauaagaagauaagauugauaggacuggauaauggauucaaaaacaagguaaggaagaggaagucagaguucugguguguaggaacagagggcuucagucacugcaaggucacaggaggagaagacaaagggaccaugaguucugguuuggacauguucagagguguguuguaccuuugagucauucaagugaaaaugccaggaaggccacuggauaugugacuuugagaggggugguaaaagccgaugauguaaauuuagguaucaucugugcuuaacucaucauuuauugacauuguggacauggaugagggagaaaguguagaggaagaagaggccuagggacagaccuucagauacucuuugauauuugauguugagguagaggaggauaaaccagcaaaggaaacuuagaauagccagagaggugagggggaagccaggaacucuuaggaacccaaagaaauaggguuuguccggaagcagauggcacuugacagugugcaguggugcuaggaaguucuucuacuagaggaaggcgauucugaagagugccauugggugcuguggauacuggugaccuuaacaaaacaguauuaauagugaugacagggaaaaugcuccuggagggaguagaaugcagaguggagaagaugaugaggacaagaccuagugaguauccacccccacuggaaaaaucugccuguaaaaccaggagagggccaggcacgguggcucacgccuguaaucccagaacuuugggaggcugaagcagguggaucacaaggucaagagauccagaccauccuggccaacauggugaaaccccaucucuacuaaaaauacaaaaaauuagcugggugucguagcaugcgccuguagucccagcuacucgggaggcugaggcaggagaaucacuucaaccuggaaggcagagguugcagugagcccagauugugccauugcacuccagccuggugacagggcaagacuccaucuccaaaaaaaaaaaaaaaaaaagaaacaaaacaaaaacccgggagagagggcaaggaacucacaugaaauaaggagucagccauaggagaguuuuccuguuugcauuuuguuuuguuguggguuuuuuuaauuuuuauuuuuggcagagucucacccugccacccaggcuggaaugcaauggugugaccucugcucacugcaaccuccaccuccagguucaagugauucuccugccucagccucccgaguagcugggauuacaggcgugcgccgccacgcccagcuaaauuuuugaauuuuuaguagagaugagguuucaccauauaggccaggcuggucucgaucuccugaccucgugauccgcucuccucggccucccaaagugcugaaauuacaggcgugagccccugcaccuggacuguuguguucuuaaaauggaaauggagcacguuucaguguagaugggaaaaaaucuugucaagcagggagaaaaggaacaugcaagugaaagaagggcuacuugaauguucaggauaauacuauuaaggaaaaacuugcuagacuacccacagacaccuuugaaaucacuucuucaucauggugaagaccacaggaagcuuugugcugaagucuuaaagagccagcauuuugaaagaacaugauucugucagugucaacgucaggcaauagugccugauaauggagacaucugugucaugauugccaugcucaguucaucuucacuuacuuuuccaggagcugaugaggauguagagaguccagagcugacaacaucucgaccacuuccaaagauacuguugacuagugcugcuccaaaaguggaaaccacgacgcugaauauacagaacaagauaccugcucagacaaaggugcguucuauuuuccauugcauugcauuaucagguuauuacaaaugcuucacuuuacugacuguacacaacagucccuuuuguauuauuuucuucuuuuuggagcuacccaucaugaacuauguacacaacaguucuuuuaaaagaccccacuuaaaauuguguaaggacaaauggucuucaggugguguuauaaauggcucuuccuuacucuuuuugaucauuuuggcauuuacccacuuauaaucucugucauccaggcucaaauuauauacaacuauuuuucacauggcccuccuucuuaaggaacgucugaagcccaguuaagaaguaaagcccuguuucuuugguuuccugguuuguagguuacguaauuagaagacuccaggucacgucuugaggugguccuagucucacuaagucauuucucagucuuccuaggccgaccaucaguacuauguaauccuugaccucucucgaugaugaugaaccuggguacaucuguauauauucauuuugagagcugacuuauuaagaauaaggucuuuggccuuagaccugaguaaagugaccagcuaaugaaaacuuggagcuugugauuuugaccucguuaauauugcaguuagcugaccauccacuaauagguaacccacugaaguuagaacaugcauauuaaagucuggcaaagaccuaaguuucaaauccuggauccagucagguuucuuagcuucugaacccauuuccuaugggccuugaagaagaugaaaugugagugcauguagcauggcaccugagaccuagucaccauucuguaagcauuaauugaauugguggagcagaagagaccaagccaauucaccaaaugagcauguguaauaacuguagugguagacuuugcaaucagugcagggguaacauauggcuuaagaaaacucagaagcacaagcauccccuuuuagagcucacccaucuguugauuagaaaugagaugcugccaagcuuuagcagcagacaggguauggauauggaaggcuguuugaugaagguggcgacaggccuuccuuggaguaagaaucaucccgucuucaggccagaaugcaugugggcuuuucuuacccuugccccagaguaccuuuguucuuccuccuccuccauccucccagugccugugacuggaauggugaauggcaccgcuggauggguuucugcagauguggaacagccaggaagccagcccuguccaaauugaagugcuuucuguaggaccaagaagggucaauuacuauuagugguagacuucacaagccaggcgguaggaaggcagggagagcccuaugagaacugagaccgacucaccuggcaugugcuggauccaugcauaaaagcuacuguaucaauguuucaguugagugaaugaaacaaaaaaagaaagggagaaaugaaaagugcaggugcaauuggugguacgaugacugccucagaguguguguggcacaauuagcuacuauuuacuaaagaugcauuuggcucuuaccacauuuuuauuugaccacuucucuugacuaaaucugcugaagucagagacaauuaggacucacuagcuugagggaagcaacucuccugggugaguuuuggcuuguagugauagagaguucuauccuaagcaagacuuaauuugacauagaguucugucugguuuguuaacagcaauggauugaccacuaauuuaaguuuuuaaaaauugguuuuaaggaaguaauugcaucagaucgagauaaaaaauguagaacuuuggcaggugaauuuaaaaauuaaggagcccaaaagauuuuaauacauuuauauucuuacuaucauuuguguucaauauaguaauaguagaaauucauccauuuauaggagauuuguugagugcuauucauuaugugucgaacacuguuugcagcacugauaaugauaauauugaucaugaauaacaugaauaauaaugauuaaauuuuucauuuugcuguuuaugugguacagccgaauugaacauugccucuaggauaccauuaguguagauuuugcuuuucaauuggucucacaguggcauuaaugucacuguuacggauauccuaucuaguuuguuguaaauuuaagugacuaaaaugcacaaaagggaaucucguuauuuguuugagaagagcaucacucauaagcuuuuacuucuguugcauuuccauggcauccaaacaaccagacauggauguggcagaucuuuacuuggccucauuuaaucaucccugcugucuuuuugcggauucauuuugcacauacauucauacaagagugaagguauuucagauuaguuccauauuaccaaaugguaucuucuuagucaagccuuugcuuccauacgauaaaacauuuugacuuaaaaaaugaauuuuccacccagagccgcuugaggcuugugcaccuccagcugcagggcggcuccaguucuguggaguccuucaguucccacacucucagaucccuggauugcacgcuuuguucagccugccggaucagaggcugagucagaggaaacugaaaagaucaacucucuuaaaugacuuuagggacucaaucacauggugaaaccauaugauuuguaauaauaaugggacaaagaugauauggauauggaugaauuaaacucagucucucauauuacaguaacuacuuagguccauuucauuucucaccagaacuuguuuaccucucucccuagucacaaaccugaguauucaccuauuugagauuucucuucccuuuucuaacuuguaauaguaaagcaguacuaaugagcagugaaaaggucucuagacuagaacccagauaauccauucucugaccuguugucugucuuuccacaaggcagccaauuaaugaugggcuuuucaugagaagaauagaaaaaucucagcaaaaauacugccaaugagcugcucucuucugcuuuacuuugguaccugaaggccugggaaggccugucguauuuccuucucucauaguaauagaaaggacggugacauuuucagugcauauugugcaccagugaaaugaaauuucucuauggccucugcuuuuuguaagucauggcagguugaaguuuagguaguacaggguuucuugcaauuugggaaugacaguuacucuuuauuauacuuuauuacauaccaccuucaguagaaguguagcguucugcucacugagacagggaccuauugaucuuacauacccuagaguacaaauggauccaccuggucuagcuuaugguccuuccuagcaaugaggguggccuuaaggugcagaaaagaaguaugauguggucagggucccacaggagcuacuugcacagcccaagaaggugugaggucuuuucuucuuacacucuuuaagccucuagacuuaacuagcaggccgccauuuuggaugaacucuagccuucagaaagcaaucauuugcuuugcugagccaugguauguuagacucuguggaguccuaaugaagaugguaggaagcucucaggaacuuaggaagaguaguagagcugagaaggauuauugucugcaguauuuuuuuugagacagggucucacucuguuacccaggcuagaaugcaguggcacaauuauagcucaccgcagccuccaacuccugggaucaagagauccuccacagguacacagcaccaugccuggcuaauuuuaaaaauuuuuuuguagagacaaggucucaguauguugcccagguuggucucgaaugauccucucaccuugggcucccuacccagccaccuuuagccuuuaaaccucaaugaaguugacaguguuuucaucagugaugcuggccgacaagaacuucagacuguuagagaaugaacaacuccuuugaaugggacuucucuaauccacugguucuuaaacuauggaauugucuggagaacuuaaauagcaguaaaagucagugccagcuacauagugcccuguauagcucagaagugaaggaguaaggagaacuggggcagugcuguuggguuggagcagucagagggagauggugaccugaagucagaccaauugaaauggaaccucuaguaguaggacuguauuuuuuuuaaugccuuucaggugauguggaucagcguaaccuugggugauucacauaagauggccagugauggugcugagaguuagaaaggcaagagauaauuucuguguaaauaauccuggggguuuagugagguaaaaggucagagaaggcuucauuaaggacaaacagauaguaaaagaagugcaacauuuggacuggggauagaacugcaugaacuagagcagaguuccccacccgcuucuggggccacggaccaguagcgguggccuguuaggaaccaggcugcacagcaggaagugagugagcauuaccaccugagcuccgccuccugucagaucaguggaggcgugccauucccauaggaucuaggagcgcaaacgcgauugugaacugugccuguugugcuccuuaugagagucugagguggaauaguuucaucccccuccaucccccccacccucccauucauggaaagauuggggaccgcuaaacuacagcacagauacuaagaaccauuuuugauaaugaagaggugguggaaaugaccucacaggguuuucuacugggaguaagugguggguugggugaggacuggaagcuacccaacaccugcaguucugaggucgaugcgggaugggagcugggcugugaugugcuggccaccugaacgaagcuguggaaaugagaacccaagggaagaaguuaaugugagagcaagaugggaggcaaauugacagugcugugacauggaaaacauaugauagaaaaugugccguaauagauaacuugguaacaccccaaaauacagugccauuaaugggaauagaaaaggagguugaucugauucagcagugaauuaauuacuacuuagacuugacgaguagaguuaaaggugguacagccaacaguuaauguccugcaggcugcuggcuuguugggaauaaugcugacuagagaugcggcugugagagguauucccauagauuucugcuugagcauugugcaguguccgagacccagugagugucguucauuagacaggugaggaaaucaagguggagaaaagaaguaugaugugaucagggaggagcuacuugcgcaauccaagucccuggaaguccuggucuaggguuugcugaagguaauauaacuagggggaagcauuaggaguaaggcuuggggauugcuccccacagaguggggacaggaaaagcccagucaggcgugagagaauaucugaaagggaacuguuguccuagugcccuguguaguucagaagugaaggagcagggagaauuggggcagugcuguuggguuggagcagucagagggagauggugaccugcaguuagaagaguggugagaaaguagaaaucuuaggaaauguccacuaaaacaaccucaccauguccuuaggauuauuaugaacucacuagcucuccgacuugccugaucaugcgauggguguugugcaaaccaugaacuacauggguccaucaugacacucacccauugcuauaaacaucacacaagugauuauuccaguuauuuccuaaacucauucuuugggggaaaaaaaaauuuuggaauauacucaucuauuauuucuucuuuccaacacauuuccuuaaaucaauguaaucuuucccuguuucccauaccagucaccugaagaaacugauaaagagaaaguucaccucucugacucagaaaggaaaauggacccagccgaagaggauacaaauguguauacugagaaacacucagacagucuguuuaaacggacagaaguccuagcaggugaguagccuggugggccucaggugggagggugccuacauaggccucuguuagucuaagugauauucaaaagugcagcaaagcuugcugucaucuuucugcugaaagcagucuugugggugcuugauuccagagcgagaagcaagaggcucagcaaacauugucuuuauugucugccagcucccucaaccuaccucuucgccagccaucgggcaggggauaggagguagccuaaaagagggaaaguuaacaucugaauugauccagaacaacuggauguagagagauggcagaguguggagauccaucagucuugcucacaggcauucuacauuucaaaauaaagagaacgaaaaguucuuuaggggaaggcaguucauauaaguacugcccaaaguguuaagaacguuguuucuauuuuaacuuaauuggauggaagugcaaauauuuuaaaggggaaaacuuucaagauuuaggcacacuugguagucucaaauccaagaauagaaauaaauuugcaugcuuuuuuucauguauacucuuuaaaauuuuaagucaauuauacuauguucucuguugaaaaaaagcaguuagaaaauuagaauaugaaaugugaguucugaaaagacaaaaguaguuuucaaguauggaauuaguuaagaucaaggccagauuuuucuuaucgagguuuuugggugguauuauuaacacuaaccaaagaaauuacuguaccuuccugaggaguuucagauuugcauaguuaccagguugcuucauugaauccagcuuuuuuuuuauugggguuuucaaauuaagccuuuuauaaaaguguaaguagauuaggcuugacaauaaagcuaaugucugcaacccuugaaucucuucuaaaguaaucuuccuuuugguuguuucagcugucauugcugguggaguuauuggcuuucucuuugcaauuuuucuuauccugcuguugguguaucgcaugagaaagaaggaugaaggaagcuaugaccuuggagaacgcaaaccauccagugcugcuuaucagaaggcaccuacuaaggaguuuuaugcguaaaacuccaacuuagugucucuauuuaugagaucacugaacuuuucaaaauaaagcuuuugcauagaauaaugaagaucuuuguuuuuuguuuucauuaaagagccauucuggcacuuuaaugauaaaaucccauuguauuuaaaacauuucauguauuucuuuagaacaacauaaaauuaaaauuuaacaucugcaguguucugugaauagcaguggcaaaauauuauguuaugaaaacccucgauguucauggaauugguuuaaacuuuuaugcgcaaauacaaaaugauugucuuuuuccuaugacucaaagaugaaagcuguuucauuugugucagcaugucucagauugaccuuaccaaguuggucuuacuuuguuaauuuaucuguuguccccuuccucuccucugcccucccuucuugugcccuuaaaaccaaacccuaugccuuuuguagcugucauggugcaauuugucuuuggaaaauucagauaaugguaauuuaguguauaugugauuuucaaauauguaaacuuuaacuuccacuuuguauaaauuuuuaagugucagacuauccauuuuacacuugcuuuauuuuucauuaccuguagcuuugggcagauuugcaacagcaaauuaauguguaaaauuggauuauuacuacaaaaccguuuagucauaucuaucuaaucagaucuucuuuugggaggauuugauguaaguuacugacaagccucagcaaacccaaagauguuaacaguauuuuaagaaguugcugcagauuccuuuggccacuguauuuguuaauuucuugcaauuugaagguacgaguagagguuuaaagaaaaaucaguuuuuguucuuaaaaaugcauuuaaguuguaaacgucuuuuuaagccuuugaagugccucugauucuauguaacuuguugcagacugguguuaaugaguauauguaacaguuuaaaaaaaaaguugguauuuuauaagcacagacaauucuaaugguaacuuuuguagucuuaugaauagacauaaauuguaauuugggaacauaaaaacuacugaauaaaucauguggccuaauauugaaaaugucacuguuauaaauuuuguacauuuuugaucaaauguacaucuccccuuugcuaacggccgucugcucucaaggaugacguggguuugauuucuaaguguuucacagugucuguaaaucaagaccaaagagccugucgaugagacuguuuauuaccagauucacuucugaauuggccagaggaaaucugaauguauuauccugugugugucuagguagagauauuggaaggcugccaggggauuucgaaguuugcaaccuuuauaggauaacugauggcaauauuaagacagacgccugcuuuugcaaauaacuuacaagacuguaaauuccaaagaucugaauggggcuuuccugauguugguaucuaaggcuuaggccuauagauugauuuaccuuuggaauugugcuccaaaugucuacugaagcuuaaccgaagaacuaauaaauggacuacaguagcucacguuacagggaaggaggguaggcagggaggcucuguguguuaaaaugagggucucacugcuuuaggauugaaguggcuggaaagagugaugccuggggaaggagauggaguuaugaggguacuguggcugguacuuucuguacuaaacauuuccuuuuucuauuuuaccacuaauuuuguuuuaaacugugagccguccaagucagaagaagacagcaaaaaaagcaacuuuuccaacauacaauuuacuuuuaauaaaguaugaauauuucauuuugagaacauucccuggaauugccacauaauucauuaaaaacauuuuuuuaagcaacacuuggaacaguguuuacuuuaaauccuuaauggccuuaauuaauucucagauuccugccccaucacuuacagaaccaauucacuuuagagugacuaaaaggaaacgauagccuagcuuucuaaagccacgcugugucccucaauuacagaggguaggaauggguauaccucuaacugugcaaagcagagugaaauucaauucauagaauaacaacugcugggaauauccgugccaggaaaagaaaaauuucuggcaaauauuuugucacugcuguaaagcaaaauauuugugaaagugccaaaauaaagucugucaugc

SEQ ID NO: 21525 - RNA, 6944 nt, Homo sapiens
cagacggcgcugagcgcggcggcggcgggagcggcgucgagugucuccgugcgcccgucuguggccaagcagccagcagccuagcagccagucagcuugccgccggcggccaagcagccaaccaugcucaacuucggugccucucuccagcagacugcgguaagucauuuggggaugccccugugcuuccucgccuggucuugucuggggggccaaagggggcgcgaaccccgagccccggacaucagccaugccugagaauuggggcugcagcggagucguggggaaggaaagggcuuccugccugcagacuaugggcauuagugagggcguguguguucgggagggggucgaaccagggggcugggaucuucagacagggacaggggucuugcucuagauguacugaggggaagggacaacuccgcauggagacccgagagggcuggugaggaggaggaugacgagcgggggaggaguggggagggggccguugcccugcagcgagguugggguacaguguggaacgagagucgcgggagggacaagggggcuacccucaccugguaccgaggagagaugcccggucuggcucaggaacgcgagccaggggaggaaggggcugcucgcaagcacucgggaggcgggguguccacaggagaggcgagugggcuacccauccugggggucugaacccacgcuuggaagacgggggcugcucagcagauagcucggggcugggggaaggggcgccugucgucggagcggggggaugacacgagggcccgccgacagcccugggggacgaguugcucccccagacgucuggagggggacucuuaccccaggggcagguggccgccuucugacgacuccuuggaagaggcggggagccgccucuggggcaggagggugggaagcgggacccagcagcuggggcgggaaggugggcggggggagcugggccgcgagacgcgggggccgcgcgucuggagccggggccugugggggcugcacgucugggaacccguggagacgcgcggcgggaggggccuggagcugccggaagccacggggagggggcgccgcgucuacagggagagacgggguggucugaggucccgugggccgcgugggcgggaagugccgagggcucggccggguucccgggggcugccggcgggaggagggcggcggccggguuuccgcggggaccuggcuccuccucccgcaucugaggcggaggccgggggugggccgggagcgggugcgcccggggagcuucucguccccgagugacccagccccggccuccgccaggggcgggagcgaggcccggccccgcugucgguuccuaagggaacggcggcucgcggggagcuggaaggggcgggcgccucccggagccuggcgcccgcagccccgccccuccccgcgggcccggcgcgcacggccgggcgguuggcggcggcgcccgcggccccucccccgggucgggcgcgggcgggggcccgcaagcucaggaaguaggggaaaggugacggcgcggcaauucccaguucacguuuccugcgccucccggagcagccgcugaucacgcuuuguucacaugccucgcccccuccucgcccacgcccccgccccgggccgcacagccaauccgggcucgggccgccgagccggccggccaauggcgggggcaggggcgcggggacgugcgagcggcgaggaauguucccagugacucacccgugagccucauugagguuagggcggccccauccgucggucuccgccagcuaggaucucccccgccguccgcccccgccccucgucugccucccccgcccgcgccuccgcccgcgcuucccuuuccugccucgcgccccacucccuuuccuccccucccuguuucccuuccuguccuucccagcucacgcucucuuucccugccgccugccuuucuuuuuuccuuuuuuugcauuggcgucuuggggcuguuacacacacgcgcgcuguccauugcagcuuacauaaaggcgggcgcgauuaugcaauuauauuguuagcgauauuucaagagcaauggcucguuuucuuaggauuucaacacgaaggcaucaugcauuuuugaaaaacuaguauugagaauaauaccuugcaacguaaagaauguuuuuugguauuuuuacacaaucucuacuuugaccaaacgagucuggacaguuuucuuuuaauggaaaauaggagaaauggugaguaguaccauuuuuuuuuagcguaguucaaagaacuuuacuauaaaacauuagguaguucuacaaauaagugcaaaaccugugcuguuauuuugucaucaagcaguucuuuaaggaauuaaaauagauucuacuuugauuaugcugacuuuuuaaagucgguuuuugcaaauuccaaguagaauauuaaauuuuuugauuauccaguuuuuaguaauauugcauuagcuauguuguaguuauguauggcaaaccauugugucaaauagauucaguaaaagggagcacaaauaugaagagguugaaaguuaauuaaaauaaacauuagaauuuuuuucuauguauaucacuugauuuuucuuuaccauaaucaagugaucaaauuuuagaucuuaaauaaugcaauuuuaacuugaaagauacccugaggaucccuuaucuuuugauuuuuaucccaaagugcaaagugacuuuccaaaggucagacccauaacaacaggccagagcucuacuacauuuugucuuuauuagaagguuuuggcuauuuuuuuuuucuaucagcaauuuguaccucaaaagaccucauaccauaccuguaauauuuaagaagauaaauuuuuugccgcacucuuaguuuuuuugcccgacuccaguugcagguagcuacucuggaaagucuauauaaaauacuccuuuucuucuuagccaaauacuucuccuuuuggaucacaaaugcauugauaauuuucgucuuaguccccuuaaugguaguaggugugccucucucccaugaacggauaucgcuuuaucaguguuaaagucuaaauguuaacagaaaaaaugaggaagauuuuauugccacuacugugagguuuggguuaccuaccuaacaaguguagcugaacuuccuuaguaucauaguaagugugagaggaaaauuauuucugauuuuaauuuggaaaguugugugaguuguaaaaaaaaaaaaaaaaaaaauuugcucauuuuucugugugucauuuggaugacaaaaaauaugcuuauaagcuuuccucuuuuguuuuuauaggaggaaagaauggaaaugauuucugaaaggccaaaagagaguauguauuccuggaacaaaacugcagagaaaagugauuuugaagcuguagaagcacuuaugucaaugagcugcaguuggaagucugauuuuaagaaauacguugaaaacagaccuguuacaccaguaucugauuugucagaggaagagaaucugcuuccgggaacaccugauuuucauacaaucccagcauuuguaaguauuauuguuuuuaagauagacguaaauuauauaauuucuuaaaauuuauauaauaaacuguagauuucucaugcuauguauuucccuuuucuuuaguguuugacuccaccuuacaguccuucugacuuugaacccucucaagugucaaaucugauggcaccagcgccaucuacuguacacuucaagucacucucagauacugccaaaccucacauugccgcaccuuucaaagaggaagaaaagagcccaguaucugcccccaaacuccccaaagcucaggcaacaagugugauucgucauacagcugaugcccagcuauguaaccaccagaccugcccaaugaaagcagccagcauccucaacuaucagaacaauucuuuuagaagaagaacccaccuaaauguugaggcugcaagaaagaacauaccaugugccgcugugucaccaaacagauccaaaugugagagaaacacaguggcagauguugaugagaaagcaagugcugcacuuuaugacuuuucugugccuuccucagagacggucaucugcaggucucagccagccccuguguccccacaacagaagucaguguuggucucuccaccugcaguaucugcagggggagugccaccuaugccggucaucugccagaugguuccccuuccugccaacaacccuguugugacaacagucguucccagcacuccucccagccagccaccagccguuugccccccuguuguguucaugggcacacaaguccccaaaggcgcugucauguuugugguaccccagcccguugugcagaguucaaagccuccgguggugagcccgaauggcaccagacucucucccauugccccugcuccuggguuuuccccuucagcagcaaaagucacuccucagauugauucaucaaggauaaggagucacaucuguagccacccaggauguggcaagacauacuuuaaaaguucccaucugaaggcccacacgaggacgcacacagguaccagccacuucuuauaucuuuaguguuuaaaugaagagauuuuggcugugaucacacauuuaaacccaggaugauaaggaauaacuugccuuuagcuaguuuagaggaugguauuuaccagugcaagguccuccaaaaggcuguauuggaggccgcucacgagugccauaauccuugcacuuuaggagaccaaggugggaggauuguuugagcauaggaguucaaaaccagccugugcaacauacugagaccucaucucuacaaauaauuuaaaaauaaguauguaaauacuuuauugaugugcuuuuguuucagucucucaaaugaugauucuguagaugucugaguaguuacuuuaauaagguaucuuuaaagccuuugaaucauaguuaaagucaggaagucuuuucauuuuuggcuuuuuuuaagggaugaaaaaaaacugcucuguugcccaaacuggucucaaacuucugggcucaagcuauccuccugccccagccuucugaguaguugggacuacaggugccuacuacuccacccggcugccuuauuucauguggggaagaguuuuguaaaugugaucaagugacaaguugaaauuggagcaauacauaucucauauucauuugacaguuugauuuauuagcuuuuauuauuuaaaauguaucuucucauauacuuuuagacagaauugaacauauaauuuacggcaaucuuaugcauaauaaugauuuguaugucuuuguuuuaggagaaaagccuuucagcuguagcuggaaagguugugaaaggagguuugcccguucugaugaacuguccagacacaggcgaacccacacgggugagaagaaauuugcgugccccaugugugaccggcgguucaugaggagugaccauuugaccaagcaugcccggcgccaucuaucagccaagaagcuaccaaacuggcagauggaagugagcaagcuaaaugacauugcucuaccuccaaccccugcucccacacagugacagaccggaaagugaagagucagaacuaacuuuggucucagcgggagccaguggugauguaaaaaugcuuccacugcaagucuguggccccacaacgugggcuuaaagcagaagccccacagccuggcacgaaggccccgccuggguuaggugacuaaaagggcuucggccacaggcaggucacagaaaggcagguuucauuucuuaucacauaagagagaugagaaagcuuuuauuccuuugaauauuuuuugaagguuucagaugaggucaacacagguagcacagauuuugaaucugugugcauauuuguuacuuuacuuuugcuguuuauacuugagaccaacuuuucaaugugauucuucuaaagcacugguuucaagaauauggaggcuggaaggaaauaaacauuacgguacagacauggagauguaaaaugaguuuguauuauuacaaauauugucaucuuuuucuagaguuaucuucuuuauuauuccuagucuuuccagucaacaucguggauguagugauuaaauauaucuagaacuaucauuuuuacacuauugugaauauuuggaauugaacgacuguauauugcuaagagggcccaaagaauuggaauccuccuuaauuuaauugcuuugaagcauagcuacaauuuguuuuugcauuuuuguuuugaaaguuuaacaaaugacuguaucuaggcauuucauuaugcuuugaacuuuaguuugccugcaguuucuuguguagauuugaaaauuguauaccaauguguuuucuguagacucuaagauacacugcacuuuguuuagaaaaaaaacugaagaugaaauauauauuguaaagaagggauauuaagaaucuuagauaacuucuugaaaaagauggcuuaugucaucaguaaaguaccuuuauguuaugaggauauaaugugugcuuuauugaauuagaaaauuagugaccauuauucacagguggacaaauguugauguuguccuguuaauuuauaggcguuuuuuggggauguggagguaguuggguagaaaaauuauuagaacauucacuuuuguuaacaguauuucucuuuuauucuguuauauaguggaugauauacacaguggcaaaacaaaaguacauugcuuaaaauauauagugaaaaaugucacuauaucuucccauuuaacauuguuuuuguauauuggguguagauuucugacaucaaaacuuggacccuuggaaaacaaaaguuuuaauuaaaaaaaauccuugugacuuacaauuugcacaauauuucuuuuguuguacuuuauaucuuguuuacaauaaagaauucccuuugguauau
